United States Patent 12,390,499 (BACTERIOPHAGE FOR MODULATING INFLAMMATORY BOWEL DISEASE) - sequence listing, part 2

SEQ ID NO: 38 - DNA, 177538 bp, Unknown
  source: /note="Description of Unknown: M16-5c Bacteriophage Sequence"
ggggctggctgtgctggcttaccgccactatacaggtgatgaaaatgattattaaagaaatcaaagggaacgctgtagagttgttcctgaaacgaaaagtacacttgattcatgggtgtaactgttattgcaacatgggtgcgggtattgctaaagaagtgaagcacaaaatccctggtgcgttcaaaattgatgcattgacgatgaaaggagaccagcgtaagttaggcactaactccatctacatgacggaagaaggtcagattgtcttcaatgcctacactcagtttaaattctggggtactggcccgcaagtggattatgacgcaatccgatcatgctttgtgagcgccgtagaacgcgccagtgcgtttcctgaaaaattgcctatcattacccctcttatcggtgcggggcttgctggtggcgattggttgcgtattagcgccattatcgacgagtgtacgggtgattatccaatcatcgttgttcacttcgatccatcggttgatccacataaggcggatttatcatgagaccgcaagaacaaaagctgttaaaacacaagctgaaacaactgggcgaagcgtatcaggattatgccgaagatgatgatcctgattcacgtaactacaatcaatcctgtatcgacgatattacagcggatatcctggatttcgttgaaaatgaaatcaccgatgctgttcgtgatgcggtagcggtggagcgagctaatcatgactgacaaaatcaaagctaaagcaatgaaggtgattgcgacatacggaacactccgttggtgtaacgcgcaggtgtgcgggtgtatgggttgcgcaaatcatactatgacgaaagaagagtatgatattgctatccagataccggaaatcaaagagcatcttgcgcgacataatgaaaaactcatgggtaaaggatggttttcaattggctaacgcacacattatagaaaaagttcgttgtcgggattgtcattttcctttgatttgcgtcatgaacattgacaaacccccttacgacgagtgggattggtggatatactgttcaaacaaaacatgcaaaaaccatgaaggtgagggcaaattccagaatcatattaagtttgtggagcgtgtcaatggctaaattgtattatcactatgcatccatgaacgctggcaaaagtgcgcgactattgacggacgcgcacaattacaaagagcgcggtatgcgagttgtaatctataagccagcaatcgacacccgcacatcaaacacagtgagttcgcgtatcgggctgaacgaaaagtgtgaattgattgcgcctgatatggatctgttctgggacattcagcgccggaataaaattgcttgcatcttcgttgacgaggcgcaattcctttcgaagaaaaacgttttcgatctatgtcgcgttgttgatgaactcgaaatccctgtaatggcttacggtctgcgtactgattttcagttgaatctgttcgagggttcttactggttgctggcctgggcagacgagatccgagaactgcgcggaatgtgtcactgtgggcgtaaagcaactacggttgcacgtatcgacgcacaaggcaacttcgtaaccgaaggggcgcaggttgagatcggagccgaagacaaatacgtttcgctctgtcgcaaacattatcacgaaaaacttcttgataatgttggtctgaactgttaaggtgtattcagacaaacaaaggagaacactatgagccgtacttaccgtaagaaatatgttccagtccgtgataagtcctctatcgaacaaatcgaagagacaaaagcattttcacagtattatgcacagcacggagaaagccctgatggtattcgttggtactcaaccaactggaaacacaaatcaggttgtgcatatatccggttcgataaaaacctgaatcgcgacggtaacaaagctcatcgtgatatctccgcgatgctttcaatcgcagtcaaaaagattgattcgaaagtacgcgctaaaatgcgtcaggagttacgccggatgaaagctggcgtgattggatgggatgaaaatatcgagaacgcaaataagatccgcgcttttgagcgtagcttatgctggtatgagataacttgatgtatttttagactaattttacataaggggcgattcgccccttttttgctataaatatatacaggaacggatctattgttgatccgtaagcacgtagagaattgcttatgaacattaaacgcatatctaaagcgctgatgtttggtttgttaatcttgtctccgtcatcacatgctgatgataggtcagtagtcgccaaagagttcgattactatatcaatgcggcgctacaggtatatcttgacaccatccctcccagcgtaaataccagtgaactattctataattacatggaacgaaaatggcagcagaagcaatgtaaatccgaacccgaatgtaaacgtttagggctacgggttgcaagtgaattcgccgctattcatcgttcataagggatgaagatgcagacgtttaacgaagtaacagaacgcgataccgcgagtaaaattgatgcctttattggcacttgcttaatgtctgtaacctatatgcacagcgcacattttgcgactggttcatattcacagcataaagcatttgaagggttttacgaagatatgcaggatttggttgataaattcaccgaaatccatataggcattactggtcgatacaaacccgtattaaaaacagaaaatgtgcttgacacggtcgcgtatctccgtaaaatagccgatgaagccaacgaaatctatgattcagtagatagttcattgaagaacgtcctggacgagatcaaaggcttgtgctatcaaacgatttacaagctgacaaaactttcttaaaaagagtttgacaagcgaaaaagtgatgatagaataactatcgaattgaaacataaacccaatggaaataatgatgaacttaaacactatcgtaaacaacccaaagaaaaccactctgatcgctctgggcgtaatcgccgcactgtggctggttccgaactcgtacactatcgttcaggatggtacggtaaaaactcaaaccttcatgggtaaagtttcaccgaagcctgttctgcctggtttccacctggtaaatccactggctgatttcgaggtgttcaacaccaaagacatcgcaatgaagtttgacaaattgcaggttccgtcccaggataaattcaaatccactgtggatatgaccgtgatgttacagttcgatggtagcaaagccccgatcaaccgtatcaatgcgggtagtcaggatcaggcgctggataaatatgtgactgaaaaacttctgtcaactgtccgtgagttcggtaaatctgtaccgaaagcacaggatctgtataatgcagaagttcaaagccagctacagatcgcgatccagcaggaagttgaagagtatgcccgtccttacggttacaccgtgaaacaggtattcttgcaggatatcgacctgccggaagcgatcaagaagcaggttgaaaacacgaaaattcgtgaagaacaggtgaacgcagagaaagcagaactggcacgtaaagagcaaatcgctcaacaggcagttgttcaggcagtagccgacaaagaagcccgtagcaacgctgcacaagctaacgaacgtgatgctgatgcccgtctgtatgcggctaagaaagaagccgaagcgaacgccattctgcaacgcacaatcaccccagaaatgatccgctggaaagaacttgatgttcagcagaccatcgcggaaaaatatcagggcggtgtacctcaaactgtcatgggttctgattacgctggtaaagtgattttcgattctcgtaaataagggtttaaagcccccagagcgggggctttctccgaacgagaatactacaatgaacataaaacagatcatccttactatcttcatttcgctattcttcggctttattggcggttttcttggtgtattggtgattgcgtctgttttatgattaacctttaaacgtggagcacgttatgaaacaatttgataaagctgtcgtaattggcagattccaacccttccataatggtcatgcagcaatggtgcgtaaagcactcggagaagcaaagatcgtttacatccttctgggttcagcatatgcttaccctaacgttttaaaccctctgacagcgaacgaacgcgaaagaatgatcttttcgtggctgatgactgaatacaaatacgaagatgtttgtcgtgttaaatttgctcatattcctgattatctttacaacgaagaaaaatggaaaacctctgttcgtacagcaatcgacgaaaccaaaggcgacaacatcgcgatctatggttacgaaaaggatgctgattcatactggctgaaagcgtttggatggactcatgttccggtagatccagttaaggttgacgggaaagatttatctgcgaccgatttgcgaccaaccatctttttgcataagaatggatgggataagaaactatctcgttatgttccttcgtctactgtgagttatatcaattcatggatgatgacggatacattttggcgactgtactacgaatacgagaaatgggaaagcgaattggagaaattcaaaaactacccatacccagaagcgctaaactgctgcacgggtgatagtgtggttgtgtgtaacaatcgcctgctggtaattcgtcgtaagttcgcaccaggtaaagacgcgttagcccttcctggtggacacaaaaacgcaaatgaaacgttcctggattgtgcgatccgtgaactgctcgaagaggtgcggatcaaagttcctgaaaaggttatccgtggttcaatccgcaattcgatgttgttcgatcatccgaagcgttccgtacacttctcaaaaccgactgtggcgcagtacatcaagttagagcctaacaatgatggtagtctgccccgcattatgggcggttctgacgatgcgttagaggcgttctggatgcccttacatgaggtcgtacaacgacaaggggaattcttcgatgaccactatcaaatcgttgtagctttcacgggactctgataaaagattaaaaaagcccttgcgttcgcgtgagggcttttgtattatatacacataccgcatgaataatgaaaaggaagaaaaatgaatacgatcaacgtttctaaagctgatgttatgaaagcaacgattattgctaccgaagccatttcattcatggctaagaaagcaggagttgatggtgctgttatcctgatggagattacaaacaacccagaaggcaacaccgcaaggtatttcaaagatcttacttcctatgcaatggaagaatttaaatgattaaacgtccttactgcctcgtaaaccgtccgatctgtgcgggtggtttacccgtcaactgctggcagttggttgaaacaggtgaagcgttcctgaataaacgcggtgataaagtattcgtctatggtgtggactcgatcgagaatgaaacgatggtgatcaccgacgagaaaacaaaagaaaaatatacgttgacttccgaccacgattgccgtaacttcaacgtgtactggaaatctaatgaagactttgaaggaattaaatcatgaaagtagcaacccttagcggtatctctgatgtaaaatgtcgtatgtcgctggaacccggtaatcgtgtaggaatcaaacacacgggttcagtaggtacgaagaattttactttgcaatctgttgcgcgtgataaaaacgatatggtttatgtgtttgttacagaaccgatgtcgaataatatccgtcaaacactggtgatgaaactgggaaccaaagatccggcaatgctgatcggtggaactgtagagcctgttactgttgcgagcgtcacacataagggcattgaatgcgccgtagacggcaacggcaaactgtcctacgaagggactaaacgccaacccgtcgatcgtccggttgttgttggggatatcttcacgtcagaacgccgtgaataccacgtcgaatacatcgcacaagatggttctctggtttgtcgcatgtactcacgcaagagcgcagacgataacaaatacatgggattgaccatcattgatggacgtgatgcgatcctgctggattcactgaatgttaaaattaagtttgcatactcatgattcaaacaattagcgttattatgggtgatgtcgtaaacatcaatggacacgattactacgtagcggaaatcaatacaaagggtaatcgtgagatcttggaactggacattgtaaggccgtccgaagggcaatcccttacaatcgaagtggttcataacacgaacacaggggaagacgtagtgaagccagttctgtcccgtcttccggtgttctactgtgaaaagtcaaaacgttggaaaatgaaatgaatccgaaagatttaactgatgtgaaagtgggtgataccctttacgatcctggcgaaaggttatacaatacccgtaaaacagcaaaccctcgcgaatttcacgttctaaaggttgcgcgtcaatatctgtatgcatccactgataaagacgctgatttgaaaagctggaacatcgagaaagtcgatcgtaagactggattgacttctggtagtgggggctggggcggattttatatgtatcgcagcgaagcagtatacaaagaaatccagtatcgtgctgaactgagtgaaaagatccgaaaagagttcggttctcacgctgttgttgttcctgaaatcactaccgctgaactgcgcggtatcgcaaaaaccctgggggttaaattttgaaaactgtaatggaaaccgtgtttggttctcacctgtatggactgaacacaccgacaagcgataaagactataaagggatctttctcccgcacccgcgcgatattctcctggggaaagccccaaagactatcgacaccagcacgggcgataaaagctctaaaaacaccgtagacgacgttgatcgtcagttgtatagtctgactaagtttatcagccttgcgtgtgatggtgataccgtagcgctcgatatgcttcacgcttcggatgacaagctgatcgctaactctgaaatctggcagtatatccgcgctaaccgctggcgtttttacaccactgaactaactggcctgttcggttatgttcgcaagcaagccgcaaaatatggtgtgaaaggttctcgcctggctgcactgcgcgaagttgtcgatgtactgaaagaaaccgaaacgatcggtggtattcaggaattcacaccagatatgaaacgctatacgcgtgaagtgaaagtgtctgacatcaagaatcgtttccctacaaacgagttctgccgattcgttaccgacacgacaatgaaatctggttgtcaggacttctatgaagtgctggggcgtaaattccagttcacgatcaaagccgatgaaatgcgtaagtcagtgtacaaactctgggatgaatacggagaacgcgcacgacaagcagaagccaacaacggcatcgactggaaggctttaagtcacgcgttgcgcggtggtatgcagttgatccagatttacaaagatggtgatatcgtttatcctctgcctgatagcgcattcctgaaactggttaaagctggcggcgtaccgttcgcaaccgtacaggaaaagctggaagaagtcatgggcgaagtcgaacggcttgcagcgatttcaacatatccgaaagaagttgaccgcgaattctggaacgatttcatcgaacgcgtataccgcgatcatgttgtggggtattacaaatgatgtatcctaaattgtccggcgctgaaattgatgttctgtataaactttacggatacgcaactaaagtgctagacttagatttcaatgacgtacccagcaaatcagggcgtgattccctgattcaaaaaggttacgctcgaagagtaacgggttatcacgataattcgaaagcatggttgctgattaccccactggggattgacgcataccgacacggtattaaaacggagtggcactaatgactgatgttattttgaacgttaaagatgttgtactgggcgataccaaaaacccagacgcagttacactggaacaggctgttgttcagatcatgcgcgatagcctccgactggaagttactgaacgtaccgaaagcaattacaagggcgggattgatggtcgccagttgtacgaagatagcaaacacgttaatgtaaccctatgggcggacattgacgaaaactcatacaaaatcgacgagattgattttgacgtatgaaaataattgacctctgcgctggtgtgggcggggttcgattaggatttgataaggcgttcggcggtgtcgaatgccttttaacgtctgaaatcgacaagttcgcacagcaaacatatatcgaaaactggggcgatgataacctacagggtgatctattcgccattgatgaaaacaaagtacctgatcatgatatcctgctcgcggggttcccgtgtcaggcgttcagtaaagccggattgaaactgggctttgatgatgtacgcggtacggtgttcttcgaaatcctccgcattatacgcgctaaaaagccccgtgtgttgttctttgagaacgtgcctgaactgctaacccatgacaaggggaagacgtttaaaacgatttacgggcttctggaggccgaaggatataacgtattctatcaacgcctgaacacaaaggatttcggactaccccaaagacgggaacgcgtgtttattgtctgcttcctggatgatgtattcttttcgtttccggttcccccgcgtacccctacacgcgtaggcgacatcctcgaagatgctgatgattcgttcaccctgtcagataacgcatggaagggctttagagagcgtaaggaacgaaataaggcaaacggtaagggtttcggttatcaggccgtcacaagcgattctacgcacactgggactatcacccagcagtattacaaggacggcgttcaatgtctggtgttgcaggaaggaaagaaccccagaagacttactccccgtgagtgttttcgtttgcaagggttcccagattcatttatcataccggatagtaaaaaacaggcatatcgtcaagcgggaaattcagtttcaatacccgtgattgaagccatagcgaaacaaattaggaaagtattatgagaaatcaaccagaaatcccgatcgataccgttgttgaatggcattacaaccactgggataatgatgaatggtctgccagccagggcgtattgaagtatcataaaggaaacttcatcctgatcgaactcgaaggtaagccaaccgtgctggacggtaaagatttggtaatgcgtccgtacaaagaaagaccggaaacaaaattcttcaaaaaagtgtttgcatccagtagttgatagtggtatcttagctttaccgaaacgaaactgaaaaggaacataccatgacttttaatgacctgtttaacggatgtactggcgctggtgcgaaatttaatctactgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgcgttcgcagagtctattcgtggtgtgttcggacactgattaatcaagccccgaaaggggctttttcgtgaggaaattattatgatttacactgttgaatgtttggttgattatgaacctggtaatctgatctgcgcgtctgataccgttatggactgcatcgacgcggtgaacaatcacgaaaccttcccgtatgttgcggataatctgcatttcactgcgtggaaagacggcaagaaagttgcggttgcttctttagtaggaaacagagtaggcgatacaataggcgctaacggctatgaacctaaccctgtgacatacgaagaagtcattggtaaaatggaggcggtatgaaggttaaaaacgccgaacgctgggagaataccaacgaaatgttcttcattcgttgcaaccgtaagcctctcaaatgcgggtatgacgacatagacgaagccctgagcaagtttaacgaaatcatccgttcatccgtctaccgtagcggggaacatcctggcgacctgtgggaactggtagcaaaagatccttacagtaacatcgtcctgaaatctgaaacaaaaggtaaagtatcgtgaaaatttatactgttgaaagtttaagcgaagattactatacatttagtgatttggtcggttctaccgtatcgctggaacgtgcgattgaaatggctaaaccttttgactgggtaagtatcactgaatgcgacggctttactggagaacgtctgcgcatagtaacactgagcaacgaaaaagccattgcgaacgcaaccaaagaaaacttacaatttgaggatgtaaaatgaaaatccgttctggttttgtgagcaacagttcatcaagtagtttcatcgtccggttcccgaaagatccgactaatatcgacaacctgcgcgaaatgatgggtgattgcgttccgaactgcggttactacaatcctccgttaacagcggaagaagtggtcaatcatgttcaccgtgacttaggcggtcatctgggtaatagctttgaatcgttctacgacgataaacgctatgactgggaaaccgaagaaagcgcagaaacccgctaccgttcaaaccctcaaattgcgcttgcgtatgacgggcgagactggtacgatctggaaacagaagagaaagacgctctgatcaaaatgtggttgtacgaagagtacaacacgaagttcggcaatcaggacggcgtgtttatctatgaattcacgtactccgatgaatgcggcccgatcggaactcaactggaacatggaaacatcttccgtaaccttgaacacacatcaaagagtcatcactgatggataagttaaaaaccgaagtctgtgttgttatgcctcgctatgcattaggggagtcgatcccctttagccaggatcgccccgcaccgtttgatgtattttctttgcgaaaatatcttgaacgatttgaactgaacgagtatactctccaaatcgttcgggtatggaatccggtaatgtatgcgcttgcgtttgacgttgctgaatccaaactcactacgatggatgaatacgttgaactcctggcgcgtaagttcgggtgtgatcgtacagtcgaagcagtaagcaataaagttaacgaaattttagaaaaattcaaatacgagaaaatttaaatgtcaatcacaaatatcgaattcaaaaacgctgtatcgaagccaaccccgacaaaccacgttttcgtgtgtgacgtatccggttcaatgtacaacgaactgcctaagatccgtaaacacctgaaagcaaatctggcgagtctggttaaacaggatgacaccgtttcgatcctgtacttctccagcaaaggcgattacggcacggtgttccgtggtgagaaggttagcaatgtctctgacctgtctaacatctgcgcggctatcgaccgttacctgaaacctacgggttgtactggcttcgttgagccgttgaatctggctgcggaaatcgctaccgatctgcaatccgaaaacggcaacctgaacagcctgatctttctgacagacggttatgataactgctggcgtaccgatgacatcctgaaagcgtgtgcggttctgccactgactttcaacagtatcgcgttcctggaatacggttattatgtaaaccgtcctctgctggaaaaaatggcagaagcaaccaacgcattgcacaaattcgttgaaggtttcgacgcatacgaaccagcatttaacgaaatcatcaccgcgcagacttccgcacgtatcgaagtcaaagttgctgatgctacccatgcgatctacctggacgaagggcgcgtgtatgtcctgaacgctgcaaacggtgttgtgctggttccagaacacatcaaaaacatctgggcgctgggtgaaaacgcgattaatgatgttgacggattcgatccgaacatcgccagcgaacagcaagttctgtatgtcgtgctttatcatgcactacacacaatgaaccctgatctggcatggaaagtgcttcaaaagctgggtgatgtccgtctgatcaaagcgtatgacaactgctttaccaaacaggactactccaacgcaaaagacctgattgcacaggctgttgtagatccgtcacagcgttttgttgatggtattgattacaacatggttccagacgaaaacgcgttcactctggttgatgcgctcgaactgctggcacaaactgacacagtgatcgacctgtcttctgagcactgggcgtacaaccgcacaggccgtcagactgtacagaaagaagatgatacactggatcaactgtctgaacagatcgcaaacgctgcaaccccagaagaacgtaaagcactggcggcgcaaatggtagcgcatgaagtatgggttccgaagttcacccagactacaaccaaagtatcggttaaacatctggtgggtaacagttcccgtcctaacatttccatcaacacggatctggaagggtatgtgactatcccagaaagcaaacagaaagaattcggtctgccggaaaaaatcgaaactaagcaggtgcgtaacttcaccatcgttaaagatggtatcgtgaacgttaaagttctgccgctggaaaccgatattccgacactgaaaaaccttcgtgcttctggcctgactatcaagccgctcgaaaaaatcggtgatgatcgtatgtctgttctggtagactttacctctctgcctctggttaaccgtggcatgactcgcgggttaagcggtaaagagttcgtgactgataacgtgcgtctggaaatcctgaaaggccgtcagaaggttatgaagttcttccgtgacaacgcgatcggactgcgcaacgcagaagggctgaaacagcgctttggtgaggctgcgggtgaatggctgtctgaacagggtattcgtgattacgggttctctccgaaggttgagcgcacagaatcgactgatgtttacatgtcgaaagaactgaacgtgaaaatcaagggtgtttcctcccttcctgctgtagcggctaccgtcgcgaagcgtgaagaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgctcgtttaagtcgcgtaatgtacggtgttgtagtagcacatgcatggttcgcggatctggacttcgaagaaaccaaagtttctatcgctgcgaaagatattcttccgaaagaagataatattccgtccgatttctggaaagtctgggaaaccacatcattcgaatgtgaaattgtcctggaagaaaaagaagtcaaaatctaacaatgtccgcccccgaaagggggcatattgaggaaaatactatgtcacgtaacgtattctggggtgaagttgtaaaaggcgatatcctgtacctgtccgaaccacaagcctatcgtgaaaacaacgaaaagaaccacgcatacgcgcctatgctgccggatttcgtggttgttgatgatgtatttgtcggtgaaaatggctggcagatcgatttagtcgggttcccttacaaaaagggtgcaatccttctcgaactggaagaccataatttcttcgcccatgttggcaatatcggagatcatggtgaattcggtatcgaagatatccgcgaaaacccgtatgtattcagcaactactacaaggtcggcggacacctgcgcagtgataacaaaactgttctgtatctggatggtcttctgtctggaatgcataatttcagcatcgagaagccaggcaacagcgcagaactctaccgcctgtttgagaagtacaatcatcaagatggtaaactgttgccgtcagaaatggcttacattgtcaaccgtctgatcatgggactacacaaaacattcctgattcactttgacggtgatgtacaacaggcgatggaaactgtgatcaccatcctgaaagaaaaatcacgctgcatggataccctgtcaaaatgactctattctttatcattgcattgggtgtgtttattctgggcgctgcgatttcattcatggcgttcgataagcgcgaatatcaaatggttgtcattggccttatcgtggcaagtatcccgctggtgttgtcatacaacctgtatcatgagaaaatcgcggagaacgcgaaatatgaggcaagacgatgaagattcgttctgggttcgtgagcaatagctcaagcagtagtttcattatcgggataggacttgtccgccctggtaaagaacaggaagttgcaaagatttacggtgagtcaaacgttgaatctctgatggatatgtttgatgatactcgtcctcgctgggatttacctcaaatacacgatgacggcacaatcacactggaagcgttcggatgtaatagcgtagaaataacccgcatctgggacaagttgaaagaactgaatctggatgatgttaaaatcgttcacttcaatgagcgcggcggcgaaccggaatacgacgatgaaaccggaagttataactatgactggtatgacgacgcggacgcattcgggccggaactcgaaaagaaatacaatctcctgagagataaccgcgaaatgttcattgaaggtgatgttcgttgcggtggtggttatgacggctaaacgattggtgatctgttatcgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaactggaaagcgaattcagtgatgaagctggggaatggctgctgtagcgggtgaatctgaaatgcttacagctaccgaaagcatggatgatgcatttgatcgcatcaagaaacaccagaaagaaaacgaaggtcgggatattcagtacatgctatcgttctggctggatggtgaaatcttctgtcatgctgctattgctgaggatactccggtcgatatgtgtcgtgaagaaatcgtgaagtacgtcaaatcttttatgcattaattaaatgagaattgaaaaatggcttatgtatctaaaaaaattgaaataatttcgtcgatgatgggtaaaactctggaagagatcgaccggattgggaagaactttaaagatgaagttttccgtttacctgaacgtgaaataaatttaatcccgtatttcaacacggttaaaattctgatcgatcctagttttggtctaacggcaactcattacattgtcggtaatgctccatatatgttcgtgttcagaaaatctaagctgattgcgtatttcgatcgcgctaatcttggacacattcgggcaatcatcgaccggatcgaccgttatgaagtcgggaattacacggaacaaaccagacgcactacatacggaaagattacgagtatgctggaacaaaccagacaattcgacggagctaacatcgaattgattgatgacctgctaaaaagaatcaacaagttcaaagaagcgtttgacgtaaagaaaaccgtgcttgctgaaccagaaacggtgaaagcaccaaccctggcatctttcgaagaaccagaaaccattccagtaaacacagcgttgaaatacatcatcgaaatcgaaccaacagatcttgatgcaacatgtaaagcactgaattctatagggattaattttactctctataataaattcagttaatccaaaaaagcccttgcgttcgcgtgagggctttgttatattacacatatcgaaacggaacagccaaaaggaacgagaacatgaaagctaaaatgatgaagttcgtaaaagactggagaaaaggcgcggcaatcggtgagagctatgtaatcgtagacatcgaaagcaacctgctcgaaggtgcgaacgttttagaagttcctcgttatggtatggttgaagccgctgataaagcaaaagaactgaacggttacgttctccacatcatcgaagcaatcgagaaggaattagcatgaacagcgtttatctgattgaagaaaccattatccagccaaacggcggagtgtatgaaaagaatatcgtgtgtgctgccctgaatgaacaagaggcagatcacaaagtgaaatatttaaatgaaaatgctgttgtatgtcagacgtattccggttatagtgttgcatatgcttggaaagcggttagtttagaaacccaaccatcttggttaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcggaggccgtgaagtcgaatgtagtaatttcatgcaagcacttgcgcagttcattgatactgcgattactcagattgaaaaacagggttgtatcgaacgtcgttacgcgaacaagatcgggatgattgaatattccaacttctgcttcgaagtcgaagaagtgcgttatgatacgatggatgaagtatacgaatatgtgcttcgtggtgaggaagtgattaagtcctataacgggacgaaggttgtcaataaccgctctttcatcactccgttcgaattgcgatatcaacagctaatgggctggatcgtgatggaataagaaaagcccctttcggggcttttttgttatgaggatgatagctggagtttgattctttctatttcttccggttcatcaatgatgctgtagtaaatcgttacggtgatcgcgttctcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggttacgtcattgttccagtcttttgttaagttgggatcgatatcgctatacagtaagcgaaggttaacacccattttatccaaccacctttagaaacgcctctaagcctctcagtgcaacgatatgttcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcgggtaactcttcctttccggtgcggtgtggttcgactgaaatcttgatctcattgccgtacagcttttcttcgtattcgtccaccatgatatgatgacgattgagcacaaacttaatcagttccccacattcagggcatttgatttggagatctacagtctctttgttgatactgtcgaacagagccataatgtaaacataatcgcgctgatgtctgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagcaatgcaacgtaaattgaacgttccatcgggcttccattcattataggttcaatctgtacggtattcttatttaacaaatagttggttttgaagaactcattcagttctgatttgttgaataggattttgtacagtgtcaataagtcgctgaactcaatatcacgcacggtaacatgacaggacttgcgtaacagtttaacgatattttccatatcttcaatagacaccagatccaggatcgcgttctttgtatcctcgtctaatgcattccattcgtatctttcgccgtcctgcttgacatactggatacattcaaggaataattgttcactgttgttacgatgtttcgggaatttgaatcccagagtaagcgagtcatcaagggcatattcattttgcagaacgtaatcagttacatgcatgaatgcttctgattgtccgctgcttcctttgattcggatcttgattgcgttcttaccgaacgatacgcaatacaccttagtgaatatgttttcctgttcggtgcgggaataacccggatacagaatatctaaaatttcatccagcatttcttgctgttctgtgagcgtcttcccttccatgtccgcgcttgtgagtaagaaactcaactgatcgcgcacggtaaacatagggaatcgcttcactccaccagggagttttacgcggattatatcaatcattttaacctcaaaaggggctttcgccccttattgtcctgtaaccacaccacgaacggcaattgctgcgccttcgataagtgattgtttgaatccgtcccaaccttctttatctgcttcaacaagccagcctgttttataggcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgatacatcatcacgaatagctgataaccattcgttgaatactttcaggttacgcgcttctgaatccacacggaacgttagcgataattcaccattctccggtcgggtgaatcggatctggggtacaccgccattatacacgtattcataacccagtgttttaccaggcaactgaacgccaacgatgctcaaccccatattgtacatcattttgtcacggaattctgttagcatctgtccgtaaacactatcaccaaacagggaagtaattaaacgagggcttaacgcccccatgattttactgaaacctgttttgttcagggacataatagctttatcaaccgtatagctgaatagcttgcttacgccccctgtaatagcgttcatgaactcgttcgggttattcgcgttaatggaactcatagtaccatcaattaaagtatcgcggatactcccgatcgtgctgtcgagaatgcgtgatgctggactggttgcgaatacaacactaaacaggttgcttcgctgaaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccaaatgtagaatgagggaaccgcaaactgtcacctgtctggaagtcacgaataaaccacacaggaggcgatttaataacttcaacgttcgatacgaagtcaacaatctgatccccgatactgccgttgaaatcgcttgctgtcgtctggtttgttgatggtgcaaaaacgtttgcaaccttcgaagcgctggaattatacgcttgcttaaccagtccggctaattctgctggagtaccacccgaagtagtaccataacccaacaccgtgaacaggtaatagattttaatcagttccagcaggtcataacggctttcgataacgaatgtattgtaatacatctttgtgcgcttatcagagccttgaaacgctgctttcgtaccgatgtcgattgcttccctacggtctgccagaataccaccagaaacggattctacagcgccccagataacgtttgatactgcacgggatagacctttagcaacaatactatcggtcgcgtcctgatagcggtgtgagttcacttcgttatcgttcaggcttcgcggtaaaagtatttgacaaattgggttaagtgtacccatagtacgggtattcaaaacctgtttgtatcgaacgttcccagtgttggcactaaggatctgttgcgcgttctgtgcggcctgacgcaatgagcgatagttatctttgcttcctggtgcaagtccaccactgaaatcatatgctgtaaacagcaagccgttattataaaggcttgatgcgttgtacgcgttatcaatacctgctgcacgttgggaaggaaattccgctgttacgatcggttgagtcaacgcgtttttagttgttgcagcacccccagaggggatgccagcatttttgatttcagcaaatgattgtacagtgtcttgcaatactgtaattttcatttaaatttcctttaagctaatgcaatcaatggtttacggtcagttcgttggactgaatgctgaaccgtgttgtttactgttttgttgttgacctgaacgctgttaggcgttgtaggctgaacaggcgctttcactgcttccggttgcttgtcaatacttgcactcgtttccggtactgcggtgattttttcctgccagcgggagatcatatcacgatatcggtctttatcgtcctcattcagcttgttcgaattgtttttctcttcaagcgattctatgagtttttccattacctttttatcgttgcccgtcagattgtctttgttcaggatttcatcgccctgatcgaattcattatctgctttaggtttcgctttctcttgcgctgcttcgatctgtttggtttcatctacacgttgacggttcgcggtattctctttgtcaacctcagcctgtaacagtgcagggttttcctgcaatgctttcagttctttcttcttctcttcggtgatcttctcttcgagttctacctgattgcgaagttcttcaagatgcttggattgtgctttctgtgcttctgtctgttgcccgaaactatatgagaatgtaccctgcgtagccttaacctgatcgacgagcttagaacgctgttcaacaactttatcgttctgatcctggatctcttgctgtttcaacagaaccaaatcatctttatcaatctcaagaccgtatttctgtttatcgcgtagcgctgataccttcatcccgcgtccggcgttagtaatcgtttctgatccggtatattcgcccagagcatagattagattaccgataccttccgtgattgcggttttaatggtatcgcccagaattttaaacggttcgaggaacaagtttttcaatgatccgcccaaatccttcatattgaagttttgcagcccttcattgattttttctgcaagggctttaatatttccgaagtatgatccaaataactctttcgaggcttcaccctctgcgagaatatcctggaaccacttctgaataaccttgctcagaacgtcgatagcgaatacgatactaccgataatcaaagtccatttggcaaacttcgccagcgcttcgagagagtatccgataaagcgagacagaagaccagatgtattatccttgattgaacccagcaacgcaagaacgcgcttactgaatttcttctcgtctttatccttatcgcggatcttcttcttgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgctggcccaacaaaatcgggcaactgttcagcaagtggttgttgatcctgttcgtattgttcctggaagccagcgaatttctctttgaaacgatcctcaaaggatttcacactgtctttgatgtccagtgtattcagcgcggtttcaagggtgttatcattgatatcctttaactcgcgcatcgaatctttatctaacgttgcctggatcttccgaacagttggttgcgcctgtggttttggtggattctgcatccgacgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttgttgaagaccaatcgaaggttatcaaaagtatgttcatacttagcttcgctgattttcatatcatccagattaataccgatctctttcagtatcgccattgctttatcgtcattatgataatgcaggtgaatcaaaaggaattcggtttctgctgcggttaattcgcgcggttgaatctctttgatgatatactcaagcaactgcattgggtctttcattgctttaatctgggtgaaatgacgatagcccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcgtcgtgtcggttaaattatatccaacatatgaaaagttcgctgataacgtctatcttgaattgttacctgcccttgtctcaatgagtgagaaaaccatcattaacggtacttctgaaacattgatgcagatctatgataaccagttaatctatcagttgacagagaaaccgattattcaggtatccttccagtataacgaaacgttagaacagcattactacggggttctgtattcgaatgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataatgatatgaagttgatcacgccgcctatcgacgcatcaaacgtgcgtattcctccggcttgcctgagcgggacgtatgaaaccgtgtttgattacatccgtgacaacgggcagagcgtagattcgtctgacttctgttatctgtgggaagatggttctggtatctttatgaaaagcaatacggagatcctcgcacaaaccccgttaaaggcttacaagttcaacgtaagtaacccgtttttaggtgacgctttggtattcactaaagcagaatacattacccataaggataacactaccctgttaggggatgcaagtttctttagtttctcgatgacggataaaaaactgtacagtgatatccttgcgagtaccgatattgaaaacgcatggatcaccatgaacaggaacgcggtatatgagaacaacttccagaacccagacaaacagggtcaaccgttccaggctgtgaagtgtcggacgttatccagttatgaaaaacgtattcggtttgatatcaatcagggtcgaatggatgttaaagtgggggcattgattgaggtgttaggggatgaatattcagggaagtatctgatcgttgaatgtatccgcgacgtatcaaaagatttccacctgcaaacattagaatgtgtacaggtggcagcggctactaacgacaccagcaaaaccagtgaggcttaggccgtagtttcttcatgatagcccatgaacaggtcgaacacgttgttcttgttctgtttacgggctttcttgatattctcgtagttctcgcgaggcatatcaatcatgaagcacttctgacgcgctgtagcgttctctgtgagcgcaaacagttcatcttcggtgtattccttgttaggattcagttcgacaataacacattgccatgtgtcaggatctgctgtctgctgcatctgcaccaggttagcgtttttcaatcccagattgtgcgccagcatttcatgaacgaattcacgatcgccgtcttcataacggagttcgttaccttcccaacggatcaggcggatagttttacttggttctgatttcataacgtggtttcctgctcataagttcgcgtaaacgtttcgtcggttcaggtgggtttttgatgatctcttgaatctgatcccacgtttccgccgacaccaatttcttttccatgataacgatattcgggttatcacagcattttccaaccataacacaacgcccacaattaaggcagattgtatccggtatcgttggagcattatcaaggaagcgaccgaaatcaatatctttcagcgcttccgcaacccgtgcttcaacggcttctttactcatatcaaccatttttcgcctcgttcatccaatcgcggaatttccacaatttgttctgtgctgcgatgtagctttcttcacggaaattagaagcgcaatagatcagagtcgggaactgaacttcgttattgcttggcttctcgtcaaacacatacacctgaatgttgttacgagttaaacgcggcgcgttcatgccagcaatcagagccagaaaatccgctttcttagttaagtgagccattgacataatcttttcctctttccgtatttcgtttcgatgtaggtaatgtaccattacattacccagaacacaagcattatttttcgatttcgtagcactcttcaacttcgatgtttaccagaggtacttcgatatcccatgaatccgcttgtgcatcgtatacggctttgtcttcgtcgttcagaggcagacaagtaacccaaccgtcagtaacgcgcatcacgcgcattttagaaaggctttcgagtgcgtccgctggcagtttttcaccaccgttacccagttgtgccaaacggtcttcatttaccagaacgattactttgccttcgagttctttagtgatttgcatgggatgttccttttgtctgtttcgtttcgatgtgtgtaatatacaaaaaagccccctacattgcaagaggcttctttagcaaaaagtgctatttaaaacagatctgcaaagataacgtgaatgtcatccggttcggtcttatcgcgtcgaatctttttgatgattggcaagaagaaactgtattccggttcgcccttcttacgcgttttcgatttctggagtccgtcaacttccatttcgacgatagcgccgatatagtcatctttgtttgccataatgtattcgcgatccagttcaccacgttcttctaacgggatgtacacgcggtgaataccgtcttcatcgtatcggtagtccgtatcagtcagaccggaacctgtgttcgttctggcttctcctgataagtcctcaaccacgaacccgccaaccttatgaggttctttggtgtgttcatacacgtcgatgattcgcagttcgatcggggttttgttcttcaacttcacctgatccgcaacgcgtgaatccttccatttgaaatcaacgtttttcaggattgaaccctctttaccgtcattgcggtaattgttgtaatcctttttcgcttccgcatagttctgcaccaggatagaaggaatcagcttaaccgatgttacaccagagccagccagcgcaccttccaggatagagaaacgatcgcaatatggttgaacactcggagcatcaccatagtacacttcatacggtacgatatcccagacaacataaacgatattgcgctgttcttcgtcgctgatagtgcctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaacgctgtttgaaggaacgacagcagttttttcagcagggacataaatcagttctccatcaagtacaacatcataacccagatattcacgaatctttttcagatccttgtccagattcaataaaccttcatactcattccccgcgcgggatgctttgcggatcttgtcttccagcagatcggacatacaacgcgcaccatcggctttaagctgcgagtaagcagggaagcgaatacgttttaaggctttctcactaaacggcgtagcgaggcattgaggctgttctggaatgagtttcttccatacgcggtttggtaacgttgtaccagcaccacattccagatcgcggttaatgatacggcgaagaacttcgcgatcattctcgttcaccgatgatacgatatccagcagacgatcacgggctgcattgcccgtatattttcgcgttgccaaatcagacatcaaatccgcgatagcattcgatagcggggttgtgcctggcttaccgtccacctgcggaaacttcttaatgtgaaacataatctgtttcgtgtacgtaatgcggaaaatctcttttagcagatcattacctgcattacgtttcaggatcgcttccttctctgaaattttcagagtcgaagcgagttcatttagaatctgtaagatcatgtaatttctcttcgatttcaaaccatgatttaactgactggtgaggcgaccacggggtttcacgttcaccacgcaacatatggaataacggcaactgactgatgacgttatgacattcgtttaagtttaccgcaagatcatcaacgaagcaaaccagacgattgccatatttggctttcgcttccaggtagcggtgtactttggtttcaccatgcccgacaaccatcacttctttgaatgcagaagggaacagcgtgttcaggttcgcaatacggttaaggcttgccgtaggagtggttcccagcgccgtgacagccacgaaatcatattgggctttcaggcggttgatcacaatcaacgcatcgtcatacgcgcttagatagcgaataaacgaactgttgttgtattcttccatgagaattttcgccagttggtgatcacacccgaagatttcggtcatatcgcggaacttttcatccgtaaccatatccagcgcgatatcggtcggcatgttgtgtttagacaaaaagaacggcaaccccgactgccattttacggcgatcccgtcaatgtcggtaagaataactggtttcaagatttaacctcataacgatcaaagaaaagggtacttttaaacgcttcaatatccgcaaggaatttgtcacgctcaaatgtacgataataatcaaattcgatgcacaacatatcatcgttcgtgacactgataccagtgatatcttgatgatatttctttgcctgttgcagaacgaacggatcaagatccgaacaatcgaaataaattacgtaacccatcatcaacccttgtacatataaacagcgtcgaagccaggaacatccatttcgactttatcgaacacaatatctttcagcttacatttttcaacgtagctgttgatcacgttcatgttgtttgcgccgatggtaacgtaatacacacccgctttgtagataacacccataatcagggtagaactcaaagcgccctgtgcgtggagtaatgccaacgggttaatcgcgcctttgaacaggaacgcgcattctactctttcatcataatctttataacctatcataacagatctctcaatcgggttaaatttcggacaaactcacgttcagtgagcacagtttcattcatcttattctttcccattgaatgagtcaaggtactttttccggttgcagccagcgcacggcggaaaccgtcattcaggaaaagagcattgtacgcgttttcaatcaggatttgatacgcttctgattcacggtgaatcggcatacccttccagtatagggtatgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtaaacggatgcggggcgaagttgctcaatgcgcatgatgggtatgaatcaccactaccaatattcataataactctcttaacgtatggtctacatagaaattcattgattacatcaatctcttcggagattgttctttctgttttccccgtataccttcatacaccgactcgattaaaagatctttttcgaatgaccgtaacattatgaacaccacccgccccgcaagtgctggttttcagagtttcggctttacgcgcacccagaaccagagttttaacaggagtcacaggagcagcgataaccacaacagcagcccaacgtgcgccaacagctttatcagtacccaggtcgattacagcagaggtattcttaccagcagccagaacatacgcacgggcttcacgacgagtgttgaagcaaaccagttctttcatgttgtaagttttcataatgtcatcctcagtttcgtttcgatgtgtgtactttaccacactcacgattcagcgcaagcattattttgcataaaaacaaaaaagccgctacctttcggcaacggcttgatttttaatacttttcttcgggctggaacaccgcacgacacgcccacatagaggcttctttcagtcggtctttcgccttttggatttgatggatacgttcaagcatcgcatcgagttcttctgtagtgaatgaatcggtatctgataccgcgtaatcacttgaatactcttcatccagttctttgaagatttcgcccagggcaacttctgcggccttgatgcggtttactttgtcgatcttttctttcgaatggggcttatagccctgtacgtcttcaatcgccattatagactctctgtaaaggttcgggcgataacgtcgcgctgttgttcaggagtcagtgaattgaaacgcactgcatagccggacacacggatcgttaactgtgggtatttttctggatgcttcacagcatcttccagagtttcgcggcgcaacacgtttacgtttaagtgttgtccaccttccactttaacagtgggttgaaattcaatatcaacttcacgttttgcgaatggagcaacgcgagctttaccgatcactgaatccatttcgagggttttggataccaccacacgaacatcattaccttcttccaggtagattgtaccagtgtgtaaaccttctaaaatctgatatgctttcattgtattacctttctacgacataataacgtaacgggttgatatggaacgccagcattgcacgatccagcccgttagggtcagttacttcctgtttcagtttccacccgcaatacacgcgtaagcagaactgaacctttccgactttaagccacggtttgaagacataaagcccccatgccgaatcattccacatcaacagataaccgtgacgcgaaggatcggaaccaccttctgttttcgggttgcccttccaggcgaagtctgactgtgcttcacgccctaagacgtgataagcgaagttgtacgctttgttacgccacaaccagcctacacgttgcgcatacacacccagatcgcctaagtgataccggatgttagcccaacgccggatatgtccaccatcaccatcgatcgggttatcgaatgtttccatccaacggaaccctttaggtaagtgtccggtttcgtcactgtagaacggaaccacgaaaggagccagcagaatagccagaacacccgaaagaatatccaggggaaccagtacaagccagcttgcgtatttcaaaaagcgcatatgcttctccagaaaaaaggctatccgaagatagcctgttgattaacgaactgctttgatatacttatacgcttctgcgaactcttcttccagagcttcgttacagaacgggataccttctgctttaaatccaccagtgataaggtactggataaagaatacagaagaatctatagagatcaactgatggttcgtaggttcgatatcagttcgacgaacgatattgacgatcgaccagtcaaagaatcgtcgatgatattcgtgtttgctattcacctgcggtgatgcaaagaaaccatcaacagaatacgcatcgaacgctttacgatattctttatcgaaatcagtgatttcttcggtaaacagtttcatcaatttaccgttgatttctttttcagttgatgcagcgacgatttcgcgaatttttggggttaactcaaacagcttttgaagacctttcatatttttctcttttaaatttgtgggctggaagtttctttacttcaccccgcattccggggaacctattaccggataccaacagagcctatcgcatacgataaggttgcatattccgaaccatttaacggcattgcgctacgcacccgaattggagcaggtgaagggactcgaaccctcaacaatctggatggaaaccagatattctaccaattgaactacacctgcgtatttggtggcccctgctggacttgaaccagcaaccgcgcgattatgagtcacccgctctaaccaattaagctaaagggccggaatttttagaactgtttgcgatagatctcgcgaaccaacggatcaacatctttcgcgtacttacatacgtcttcgaactggacgatgtacgccatgacttcatcggcacgggatttaagtttaccctgatgcgcatcaatgatcattgctgtcattacgtcaatacgcgctggggcttccagaatttcgcctttgtcgaacagctttttggatttgctgacggtatcagcgataattgcttgaattgatttagccatttttagatctcgtagattgcctggattgctttgtaatgtgcggaaacgtattttgtttccttctcttttgcttctttttcggaaatgtaacccgcaaccagatcagggtcaggaacattcgccatgtgagcgcttggcagtggaatatatttacccaggattcgttctgccgcttctgctggaacgtctacgcctacagaaacaactttaccataaaaaggttgttccccgtgctggcgtacaccaaccacgataccagattcagatttgatttcggaaccctgcggacgcgcagtagcttcgatgatcacatattcgccggatgcttttactttcagttcagacatttctttactcattgttgttaaacactactttggaaaagtcgataaacgattctaactcttcccgtttaatttgttccacgacacagccatatttctgcaagcgtgaaatccattcatcattaccacgatcgtatttatcgagataatacaccgatgtaatcgccccgttagcaacataccattcgatatgtttcgcgcagttagggcaaggcgatgcagttgtgtaaagtgctgcgtctttgagtataacacctcttgtgtgcgcactcaatagcgctttcatttctgcatgaatttcgttatcgtttgaccatgctgaatgttcaggacgatcaaccgctttcagtttaccgtcatcattcaccatatgattgttgcatgagttgcaacgacaatcaaggtcaaccgtattattttcgccccacgcgacggcacgaccaccaatcgcgataatagcacctacacgattcgaaatacattgagaacgttgactccgatcgattgctctcagcatattcattactttgaatttcattaacggtcatccatatatttcagaatgtctttgatgaaatcgttatcagggttgacgatgtgatacgtagtacctgaacgtgtcaccacttcaacaaacgatttgttcgccggaatcgcgtattcaacaaccggacttgttgcaatgtcctgttgaggatcattatcaaccaacccaaacacacaaccataacgaagcatcgttggttcagtacagagccatgcctgatgaatctttctgattttgtcactcataatactgccgcccatgttacgaatttagttaccggattccactgaatcccgaactgttgttcaacgatgttacgttgactcagaatacccagaaggaaggagaactgaccatcgcggacaatcttcactgtataaccagcaggaattttatcagcaatgcgctggcctaactggttgagtttcagttgaagttcaacaggattctcaactttaacacgatcacccagttcaaccatcacattttcattttcacgaataaccataatattctcctttgtttgtgcgggtatcttatcacacccgcactcactgtcaactgttttttagaagtcgccgtaatcaacctggaaacatgggataccgttcattcgccacatcccgactggtgtatccctgtcgtccactgcaagaacaggataatacttatcgagaatcttttcaacaagtatttgctcttttacgtggaaatcgtgacgatgatcaccttcttctcgcatgtagataccatcgctcaggtcaacatcgtatccgatcaggcttgcagcggtatcatgtgcgcactgtgcagtaccctcacgcccagacacaacaacacaggcataaccagcggccttatacatcctgaacagttcttgaacaggagggttaggcggatcgttgatcacctttgtgaagtcatacgggctgcgttgtccaactttggtcagtgtcccgtcaacgtcgaagataacacatttcggcttgctcggatctgcatagctcatagccggaacccagccacggagtttacggtactgttcgaacatcgcccagacacgggaaacaggtagagcattcacaccgcgtttatggttgcgtttcaggagttctacgatatcggcatcaatccattcgatatggaaatcagcattgaactctttcgcgatctctcgccacacatcatgatctttttggtgtaaatgggtattgtgaacgataacgttcttcccactcgccagggcattacgaactgtatcttcttgcacacggcaaacaaacagttctttctcttcggtgaagcgatagccagtgagatcaccgccagcacagtaaagggttttgcggatatcgtcacgggaaacagtcagcgtgttccccagttgacgtgctttttctttcgcccatgtagttttcccgctacctggtacacctacagtaataaacagattcattacacaatctcatattcaatcagttctttgttatgctcattcgttagattgagccacatatcacggttccagtcattttcgatccagagaccttctttgtccttcttcgcatcataaacctttccttcggttatgtcacggaaaaatgacttgattattttgacttgcatttctcagggtatcccacggtacacagaatgttatccgtctggtctttctgacgcttaacgtcattcatccagctacggaagattaacgaatcgggatatgaaagggcaacgtatgggtttccgtcataaggcatgacaaggtattttttaccgtcaatctctcggacttctgcaaccactttccatttcacattaaccggattcaccttagcggggagtgtaggcaaaatcttttctggcggcttctccgcgcacccaaccaacagaacgcccagaacaagggctaacgttgcaattttcatttgtcgtactccgccatatactcttcgaaggacttgttgatcttgatttcgatcagtcctggttttttaaacagcagatctttacgtccggcatccttgaccaactgctgatccttacctttttgttcgacatagatcaccgtattggtgttgtttgtctctttgacttttttgatatcagcctgtaactctttgatatctttagccaattggtcattttcacttttcagtgtgattgtcatgtacaaaagccctgccaaagacagggctacaatgacaggccacaccaaagaagttaactttggaaaggctggtaatgtcatttatattcttccggtataaactgttcgtagttcttcgccattaatgcaacgatgttatcgaccagcttttgcttatcggtatcatcgaaataacgcatcataggcccgaagatgatacgaccgtcaggggttaagtcagcgctcagggcgatcgcgtagtctttgcgtgatttgcctttcgtgtcttcgattgcctggaatgcttttgcagtcagacgattgagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcggtgaaggtttacataccagttggttttcgctttcacaaaacctttatcagttttgatcacgtaaccctcgaaaccttctttcgtgtaggcttcggtaatgaacgcatccagatcggtgatttcgattttctcgcgctcaaccaggaacggacgtaatacaccatctgcgaagatatcctgataatcgacatattcgcccgtgtcgttattacggatgttcaggatcaccactgctggttcctgatagccaattacaatacggtttgtcggtgcgacgtattccatgttgactgtgaaaccatcgttaaccagttcggtcaggcgatcgaacaatgcgcggttagtctggatcacgctcatagcgtccatagcctgttcagattgaacggatgctttagacttaacacccagatagccggaatcacagaaggtggagatcagggaaccatcttccttaatcatcacatccactacggtttcaccaatcgtcacaggagaggctttcagtgcttcccatgcctttacctcagcatagttgaaaaacttctccatagggcgactggcgagttttacgggggtatccccatccattacaaacatgatgccgcgacattccagcgcaccaggttttaaccagtcggaatagctcgccatgcgatagttaaagatgcgaacattggtttgcatcacagttttttgatcaatgaagtagaagcattcgctttcgttacacagtttcatcaactggttgaataaggttttctgatttttggttagatttgtcatagtgctgtttgttccattcaggattgatttttcggatcatgtttatttcaaaatcatgatatgtgtcttcatcgtgtgttgtcacgataagatttacacgcttacgttttttgattgccatttccagacgtgcggttttcaaaatgttactggggtttgtttcccgccagtatttcgaattgcggtatgtgtctaaccgcttccacaaatcacgacattttccaacatacactatccgaccgtcgatttcaataaaatacacacaatgccggaattcgccacatttaacaaaactccgatctatccttttgtctgaacccagacgcaaaggaaatattacaccaaacgttacatcgtccattatatatccaacttattcacctttccggtcaacacattgacgcagtgagcaatataatcaccgtgacacggtaagggtttgcaactacagcctaaccgcttcccgtccagttctttcagttcgtcgattgtgatcacgccagttcgaatcaagttttggaaatacgggatgaagttaagaatgttttcaccccgtgttcccttgtaaaagggattgccgaacttcgtacctctttgaatatcgacatcccaatcacttttatacttgtttacgacgcgacaatcaagcgtatttttgtcgccattttgcataggcttcgtcgctgatctcagtgttgaggttgccaaccaggtaagaacttacttcaacctcttgcggggctacctgtacgttgtcagacttcaaccatttgttcatccacggatacgggttcggcgttggtttaaatggagactgcaagccaaccgcgcgcatacgctgatccgtcaggtgttcaatataggcgatcgtacttttcagggatacgccgtctacatcaccgatagagaacaggtgttcagcccattctttttcctgttcgtacacttccaggaaaatttgtgtcgcttcctcttcgtactggtaagcgatttccgccatttctgggtcatctttacccatctgccagagtcggatcttgctttgagtgcctttctggtgaagtgcttcatcacgggcaatcagacgcatgatcttcgcgttaccttccatcttgccttgttcggcaaagttgaatgtgaaggtaaacgacacgtagaagcggatcgcttccagagcgttgacagcgtgcatacacaggtacagagcaaccttacatttacgcatttgctctttgcgtttcttctcgtactctgcgatcgattcgtctgggtatccgtgggacgttaacatttcgattttgagcacaatatttttaagttcatgacattctgcgatcagatcatcgtagtattttgtcatggaagcagaacgtttcatgatcgcttcgttgcgcagaattttatcgaactctttcgacgggtcgatgtgtaaattgcgctgaatgtgtgtatagctgcggctatgaattgtttcactgaacgcccatgtttcgatccacgtttccattgagacatcggaagcgatagggaggaacgccaggttcgggccgcgcccctgaatggtatccagcagggtttgatattgcaggtttgaatcgaaaatgattttttcgtgttccggcattttcgcgtactgcatacggtcgatagacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttattaaaaagcccccgaaggggcattgaatcaaattttgcaaccttcgcaatcttccgcttcttcctcacctgcaccgtcgcgggtgttgtggtagtacagcgttttgatgccgaaatagtttgcatacagcagatcttcaaggatgatttcagatttcactttaccatctgggaagttagccggatcatagtttgtgtttgcagagatagcctgatcaacaaacttctgcataaccgctacatgagacagataacctttgtttccacgttttgccattgtccagagataatcatagaagtcaatctgattattctggtttggtactacctgattgaatgaaccttctttcgaagatttcacactcacagggccgcgtgggggttcaatcccgttggttgagttacttacctgcgagctactttcacaaggcattaaagcagaaagcgttgagttacgcaagccatgttttttgatttcaccgcgtaaccattcccaatcgcagttatacacaggtgatgccagttcatcaacgtttttgcagtaccagtcaataggcaacagcccttgtgcatatttcgtttcgtggaacagtccacatgcaccgcgttcctgtgcgagttccatagaggcaaccagcaggttaaattgaaacgcttccatcaactcatgaacgtttccggcgtatgcttcggagtagtcacaatagttgcttgccagccatgatgcatagttggtgataccgacgcccagagaacggcgctgtttggctttcagagccgctgcaacagggtagttctggtaatccaacaggttatccagtgcgcgtactgcgatgcgtgtaagggctgggaattcgcttatatcggcattatcgagaacgatcgccataagcgtacacagtccaatttcgccagccagtttatcatcgtcatccagtggtgaagttgggatcgcgatttcacagcacaggttcgacatacgaaccggaacagagaaactaccctgctggtttacgtgatgactgttgaaaatgtagttgcgtccggtctgtgcgcgttcctgaacaagcaactggaacagatctaccgctttgatgcgtttcttgcgtaccgttgggtctttttcaagactggtatacagttcttcaaactcagtctgatccgcttgatagaacgcgtcatacaggcgatcgttcgcaacgtcagggctgaacagagtgatgtaatcgttattgattaaacgcttatacatcaaatcgttaagctgtacgccataatccaggtgacgaatacggttttcttcaacgccacggttatttttcagaaccaacaggttttcaacttcaagatgccagatcggataatacagggttgctgcaccaccacgaacaccgccctgggaacaggatttaaccgccgtctgaatgtgtttccagaacgggataacgcctgtatgtactgcttcaccaccacggatttttgaacccatagcgcgaatgtgtccggcgttgacaccaataccagcacgttgagagatatacttcacgatcgcggacgtaacagcgttcagagaacccagagaatcacccgattcgattacaacacaactggagaactgacgcgtaggagtacgcacacccgccataataggcgtaggcaatgacagtttacgatccgaaatcgcgttatagaagtcaaccacatgactgattttatcagcgtgtttttcgtcctgatgcagacacatcgcgatcagcatgaatgcatactgtggtgtttcgtagatgtcgccggacgtgcgatcctgcaacagatatttcccgatcaactgctgaacgccagcatacgaaaattcaaaatctttatcgtgattgattttcgattccagataatcaatctccgctggagtccattttgccaggatttctttatcgtatttcccagcgagaaccagattagcgatgtggtcgtagaacggaatcgggtcaaactgtccgtaaacggttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgccccctttgtttatactgccatagctgcttttagcgagccgtggtgattatagtctttcaaatggatggagtcaaagaattcttgatccaaatcaagtaagctatttaccttcggcattacgagcgtcggaagtggaagcggtgcgcgttccggcttcaacaactctttcgcttgttctactgcgtttttgtagatatggacatcaccgccagtccaaaccagatcgcccacttcatacccgcaaatatcagcgataatatgcgtcaggagagcgtaggaggcgatattgaacggcaaccctaagaagacatcaactgaacgctgataccactgtagagacagtttgccgttgattacgacgaactggaagaaacagtgacacggacgcaacgccatatcatccagatcaacagggttccaggcagaaacgatgatcccgcgatcgtctggtgtggttttcagttgttcgatgatttttgcaatctgatcgacaccagtgtaaaaaccttcttcaccaaacgagcgccattgatgcccgtagatcggccccagataaccattcgtataacccagcgctttagcctgattttcgtagttatcgtcccagatcgtccgcttatcgctatcttcgccccacgtcattttacgcagtgtttccacgttggtagaaccggacaggaaccattgtaattcatgcttacacggtttgaagaatagctgtttgctggtagtcgctgggaaaccttctgcgaggttccaacgtgcttgcatcccgaagatgcgcagtgtaccaacaccagtacgatcggttgattccgtaccgtgtgttagaacggtgttgacgatatcaagatattgtttcattttatgcctttttcgtatgtcgatcgacgataatttttctgacgcgttcgtttgattcgatctgctgaattttgaaatcagtcagttcatatttcagaaccgcttcacagaattcaggaaccgtgaacgaaacatcacgtttaaaagctggtgcattgaaagtgtgatgtccgtaaatgtgcgtcacaaccacttcgtcaaccagtgtattattgattgcttccagaagcaaccccttaccgccaatgagacacacatcacgatctggatgcgttgctttcatcacgtcgattgcagcagacaacccgccgccgtggatgacataatcagcaatatcgccttttttggttttgaggaaactaccagaaccagacagaacacaatggattcgcccttgcaatttaccaggcagagaagtaaaagtgttcgcacccatgatcaggacgctatctgcggtttctgctttgaagttctgtaaatcctctttgcagtgtccccacggtaaaccctgttcataaccgaaagcatagtccatttcgtacatatcatgaccaacggcgaaaactgcttttactttgctcatagcgcgatccacattttgttgtcttcaatagtcacgatgtagcccatagcttcaaccatgacgcgcaatttgtctttacaggcttcattgtacccgcgaatcttttcaaattcaacagaaaagatactcaatccgttaacatgagcgttaatgattttggattccagatcgaacaccatcacatctaacggactccactcaacagaatgaagtttttcgcgggttaacagggttgtgtgctttggtagtttcattggggtacagtttgccatagccattgttccattttacgtaaatcttcctctaacggagtgaaaccaaaggattcttcgatcacaccgtcttcccatacatcaatttccagaatttccgttaccggagggtttgacatcacatgatcacgacacgcagccatagcggtcataatggaatttgttactgtcagggtatttccctgaaccgatacctgaataatcatactttcacccattctttatctttagtccatgcggttttcaaggtaaaacgctggcggtaatgcatacccaaacttgggggatgcagcgaattgataccttcgacggcgatccgcattgcttcgaacttctcgcgatcaataaactgccctggtagaactggcattctcacacagtcccattcgtaagtatcgctgatctctttactggcattaaccagaatttcagcaatgtcaaaatctgtaggtgcgaaccatcccagattgataaacacgcgtttttgcgtaccttctttcaggttttcaaagtgcgcccatgttggacaactcatagtattttcctcataaaaaaaggaactgcttttcaacagttcccagtataacacagtgatttagtatttcaagcgccaaagagcgattgcttcatcaactgcttttttaatttcttccggcgtgtctttgcgtccggctttaaccagggcagagagcatagaacgaatggttgcattcatctgtgacttctcacgatccatctgtgcctgatgcgccttatcaaccgctggggcttctttcttcgctgcctgtggtttcgtaggctgtgcgcctaactcgtccttagcttgcgtttcagtgcgtttctgttcggcttctttcttcacatgaggtgcggagaatttaccagccttgaagttatcacgcataccttccaggatcttacgggctgtgtaccagtcagcaacaccacgaagttgtttcagggtatcaaccagcaaaccgatacttgcgcctttgctatcctcgtcaatgtcgatatctttcaaccattcaacatgtttctgaccggagtgcatgaaatcaaagctgctgaaactccagaaacctttacggttgctgatctcgcgtttgaagtggaaagtcaaacccgcgccgttatcaaactcaccgtagttactgcggaatgttgcccccgcctgtttcagtgcgttgaaatagtcatctttattgatgcggttaacggtgcgttttggtttctcttccggcgctggtgctgctgcttgctgtgcggtacgtttaacaaaagatgctgaacgatgccccgctgcaaactctgcgttcatccggtcgattaccgctgcgatgccgcttgcgtctggtttcactttctgcatttctttgaaagtgtcgatgatcatatccagacatgcaccgtcttcatcttccagcatagtacctttcagacgttcagcaggtttgaatttgttcacagttgggtcaacaacatactggaacacatacgcgcctttacgcatgaatacgtgacggtagaagtgaactttatagtgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcacggcttgccattttgtgtttcttcgtaccaaccagaaccagagtattaactgatacgttacccagtgcggacgcgtccggcgctgctaaaccttgaccgttcggcggttgacaagagaaagagaagtcaaagaacgcatcaccagaggtgaaacgatatgtcgcgtgaacagtatgaccgcgaacttcgctgattgactgagtataggttgttggttgtccggtgaatttcgtgaagtattccgcgaactcttgcgcgttgaatttcgtgctgaaatagtttttcgcaaccacgaaatacgctgcaaatttttcttcccatgcttttttgtttgctgcgtgttctgcgcgaacatcactgtaagttttaccagcgctgtttgttttggttacaacgtcatacgcttggttgattttctgcatgagttcagtgctaccaccacggtcggggtgattgcgcagagaagcacgtttaaagagctttgacagttcagctttagattcgtcgccagtagcgcccaaaatcttcaatgcttcgctgtgtgacatttgttcgttaatcattttccgttcctcaaaataaaagcccatgtaactcagtacacgggcaactttaaggtatttatgttttgctgtcaatagattttttcgaggaaccacaccgaagatttattattcttgatgcgtgtcaattcaatggggttatctttgaatgcttcctcaacatctgccattgtaactacatgtttttcttccaatagttcattatggagataaaacctctccacttcgggagaggtctttaaatcaaattcacgttctaacatgagattgccatatctttgattgatggttttgtgaaccgtccaaccttagacatgatgatgtggcggtcgaagtcctgcggatcaagatcctggtgactgattacaataacgttaccatctacagaatccagcagggatttaatcgcgaatgaaccctctttatcaagtggtccatcaaacacttcatcaagtaccagcagagacagatccacgcctgatactttacttgtcacgtcacgccatgtgaacagaatagacaagttgatgcgagcgcgttcgccttgactgaatgacgcataactgaaatcatcgcgccccagtgatttgatcgattcgttgaactcgtcatctaaagtgaactgataatccgcacccaacagatccagataatatgctatctgtttgttgaagtacggaatatagcgcttaacaatgctggccttaacgccggaatctttcaacatatcagtaacaataccacgaatgtatttttccttgacgtagccttgtcgtttttcgttcagttctgcttcctgctgttgcaactgcttcacgggttcttcatcaatgactacttccgcgcttgcctgttccatgatcgcctgtgctcgtttagcgttggcaacttcgttttgcagtgtacctttcagggcttcatatttggttttcagggcattgagtgcgcgttgctgttgaagcaagtcattcatgatcccttgtaactcgtcttgtttggttttgatcagggttaaacgctgtgtacccgctttgatgttctctgcgatctccgccatacgctcaggagtgggtttaatcgcttgcttacaggccggacactcaccgcctttctgatacatcacctccagctttttaaactgctctacagtcattgagagccgcgaataaccgtcacggagtttgttgatatcttccgtccggtcttctccagtgatcaccgattccgcaatctccgcttgcaactgcataagctgtgctttgatgttctttgcggtttctacgtgactatcgtagatctctttgtatcgggcgttgttctggttcgctttcgctcgctgttcgtcaatgaagcgctgatgtgttgcgatctgctgctggatgtgattaccctgcattgagagtgtatccaactgctgattaacaccgcgaatgtatgacttgttcagcttatccatttcactgatgacggacagagacagcaaatcttcaaccagtttccggcgttctggggttttcagttccatgaatggggtgtaacccgctgtacccagaacgataacctgtttgaagcccacaaggttgatgttcagcatagattcaagctgtgcctgataatcacctgctgcggagtcttccggcaacttctcgccgttcttccagatctcgaacaccttcggcttttgtccgcgcacaactttgtacgagtctttcccgtattcgatttccagttcaaccaggcatttctttttgttgacgctgttcaccaactgcccgacttttagatcgcggaatgacttaccgaacagggcataggttaacgcctcgatcagtgtcgatttaccgccaccgtttttccccgtgatcagagttttctttgccgtatcaaaattcagttcgatcggggtgttcccgaccgacaaaatgttttgatacgtgattttcttaaagtttagtttcatttaaaatccgttcacataattcagtgatcatttgaacaactgatgaatcaatactatatgatagagtatcgtcgtccagtgtatcaagcatgaatattgaccatgttcgtgatgaatgccatgcacccttcatgatggtcaaacaaactgcgctggtttcccctgcttcgtcggatgtggaaatgatgtgtttcattcccaacatacgcaacaggtgagaatatcggggattcgccccgaaatattcatcataacggctatgcacttgacacctccgcgtagagttcgctgatcagcttattcacttcctctttttcatcgtcggtgatctgcatgttggcgatatactcagtgataagcccacgaacggttttgatttcaaagtcggtatcgacatctgaatctgttttaactttgtctatgatgttgatttcataggcaatttcttcgattttggtttggaactttgcaagcccctgatcaatttcactaacaatcagacgcaccgcgcagttgcggaactgttcaagatcaacatctttctgtgctggatacatgatccggcgatggtggcacacagggttagcgatgaaagtcaattcaggcttgcccgtaaacacatagaaaccgcgtgtttcgtcttcgtcgttcgcgctcatagtcagaggcgtaccgatataaaacacgttgtcaccctcgttagcgtggtgatagtgtccagagtaaacacgatcgtacttcttcaagaaatcaggttccagcccatgatcggctttgctgttcttgtagaaatagtaaccagacagttcgaagtgtcccaaacaaaagttagctttcgattgtttgatgtagtcaaaaatacgctggctgttttcctgacaaatccacgggattaggtcaatcgaatttccgccacctaaatcaaccgtggtcggttcgtcgatgacattaaagcattcgtattgacttagtatctcgcgtggcgcgttggggcgtattttgtccttaaattggcaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactcgacgatctgtttgaataccgcatacaggttttcttcgttccaggggttatcctggcgaagtccggcatgggtatccccaattaaaacatagttcatataaacctcaaaacccccgaaggggtttatttgccgtatttttcagaagccatgatgaacaggtctttcaactgctggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgccttgttcttccgcatgaacttttgcgctttgcgtagggcttcctgttcaatgcgtgtacccttgatggagtccagttcttcttcacgaagatccagcgctgatttttggtgtacttcgtcgattacttcatgctgcacgttcatagtaagtgatctccatgatcattgtttcggcgtttattacatagtccagacgaccttctgttatctggaagtctggatctcgtacatctgtagggtcgatgataatcggaatccctaagctctgcaactctaatttcacaaggtaaggaagcagatcaatttcgtcgttagcatctgctaaaattttgttcaggtcaattttaattttcatagaaacatttccaatgttggcgattcgtccacaacctcgattttatctttgggttttttcgcggactcttcatactgattaagtttgtcatggatatcctgaatgaaagtttcatcggctatcgtggtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcgtcaaagttatgaaggccggaaatcgttgccgaaattccatcatcgatcatatccattttccagtcttcggaataacggttgaagttgtatcgacgtgccaaaccgtgagcaatgttcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatagttagatctggttaaaaagtatacggaaatgtactgttttctctatatataaaatataaaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggcgagtaccctgaaattgttctagcctttgatgataacaagtattggcgcagaagtaaagcctggtactacaaaaagaaacgaaaaatggaacaagaagcatcggattgggactgggatcgtctgaatggtttccttcacccgacatacgatgaaatccgtgctaatctaccgtacaaaggtatccgcgttgacttcgcagaagccgatgacgtgatcggtgtagtgacgcgtaaagcggtatccgaaggtaaacgtgtcctgatcgtttctgctgatggtgactttgcagcccttcaaaaatatcagggtgtgcgtcagtggtcgccaacccaaaagaaatgggttacaccgaaatatggttcaccgcgtaacgatttgcgcatgaagatcattaagggcgataaaaaagatagtatcgcttgcattaaaatgcgaaatgactatattgttacgaaggttgaaggagaacgcgccccacaaatcagggctgctgaactcgaagcctggctggaagcggacgatccgaccgtgggtatgcccgaagagtgggcgatccgttacagagaaaacgaagaacttcgcgactttgattttattccgaaagatgttgcaacggcaatcgaagaagcgtataatgctccaaaaatcgggaacaaagcaaaaatggagaaatacttcatggaatgcaaacttacccgtatgtatgaaaaactaagtgacttttgaggtaacaaaatgagtgtagaattactgcaagaaaacccagacatcgctaaagcggttaaagaactgatcaaagaagcgtcgaacgtgaaaactcagatcgaacatttccagggttctttcaaagacatcaaatccaaagcgaaaacggattatggtatcgacggtaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaacagtaccgaaagcgatcatcgacaagattagcgacgaagccattaaaaacaatctgctgcgtccttctgtggctaaagaccacgcgacgacgcaaacactggatgatttcatgtgaaatttaaaaccccgtttgacagttcagacgctaattcccgtttgaaaccgatcgcggtatacaaactgtatctggtgatgaaaaatcactttgctgggaagtatgacgcgatcaagtacaaatgggaaataaagatcactgaaaaagcgttcgaaaagagaagagataagtattttttcaaaaagttagccgaaaggtttacatttaaagaaatatatcttatacttctctccaacatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggtattcccctctcaacggtgtttcagtatagcgtcaaatcatcaacctcgtatatcagcaaactcgtacagtctggggtgatttcttatgaatcattcttgatcctcgactcgtttttagacatcataaataaacacgatgaaatcgcaacggatttcgtctggaatgaatttagtaaaaaactaaacgcatacagaaaattagttgaaatcagtaacgaagaaatcgtaaaataccgaaacttaatgaaacaaactttaattaacttaaacgagaaataacatatgtcattctttaaacgtcaagatccaaccaaactgcaagaacaagtcgccgctctgaaaggttcatccggcttccagaaagatgaaaaagagtggaaactcggtgtcgatgcacagaaaaacggttctgcggtgatccgcttcctgcctaaccgatctgatgatgaactggcgttcgtgcgtatcgtcaaccattcattcaaaaagaataaccagtggttcatcgaaaactgcccgtctacccacggcgattacgatgcttgccctgtgtgtcagtatatctctgaaaacgatctgttcgaaaaagcgaaagtgaaaggcagcgaagccgaaaaaacactgggtatgatcggacgtaaacaatcgttctgggcgaacattctggtggttaaagatccaatgcacccggaaaacgaaggtaaggtgtttaagttccgcttcggtaaaaagatcatggataaaatcactgcggctatcgcggggaacccagatctggatgaaccaggtgttgctgtgacctgtccgtttggtggcgctaacttcaccctgaccgcgaagaaagtaggcgactggcctaactacgacgacagcaaatttggtgttcctggcccaatcaaaggcatcgaagacgaagcgcgtcagaaagaaatcttcgaaggtatgagcgatctgcgtccaatcactgctccagaccagttcaaaccaactgcggaactgaccgcgaagttcaccaaagtattcggtggtgctgcaatgggtgctggcgcaagcgctggtgcggatctggattcagaactgaactcatttgacaacgaactgaaaaacttcgataatggcaaccagtccaaaggtgctaaagaatctggtggcgtaagtcaactgaacgtaggcggaagcgtaccggaagatgataatacccctccgtttgatctggaaggtggttccggtgatgacgacctggataaactgctggatctgtaatgcttacgggggcgaaagcccccaatttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggattgattcacgacgctcgcgaagcgggtacgaaaatcacagaatccaaaagcaaagaattccttgacaatgcggcggatcgcgttgtagaatccctgattaacggcacttttgcctaattgaaaactataggttgaatatgaaattctctaaacaaacgatcgacatcctgaaaaacttctcccagatcaacccgtctgtaatgctgaaaaagggttcgttcattatgacgaaatccatcaacagcgtagtttacgcagaagcaacgatttctgacgtaattgacgaagatgtaggtatctacgatctgaactcattcctgaacatgctgaacgttgtaggcactgatgccgaagtaactcacgatctgtccactggcgaaatcgtcattcgtggtgagaaaatgaaaatcgttgagcgttcaagcgatccaaccacaatcgtacagcctaagaagcgtctggaaatgccagttgcggatctgattttccagattagcgcgaacgatttcgaaaaactgatcaaagcgtcacgcatgatgaaactgaccgacctgtctgttgagccaatcaacggcaagctggtaatcaccgcgaaaagtaaagaaagccagtcaaccttctctgtggaagtgggcgattacgaaggtgataacatgttcaacttcgatatgaagattgacaacatgcagttcatcaacagcgattacaaagttgaaatctcttctcgcggcgctgcgaaattctcgtccgaaaacggcgttgcgtatgtagtggtacttgaagcaaccagtcagttcaagtaagataaacaaagcagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctggacgaatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctctatgacgcagaagaaaggcggtaaaatcattctgattgacgaattcgatcgcccaggcatggcagaagcacagaagcacatgcgtagctttatcgaagcgtacagcaagaacgttactgttatgatcaccgcgaacaacatcaacgggattcaccctgcgctgatctcccgctgtccggtagtcaagttcggttccccgtcgaaggaagaacgcgttgaactgatgaagcaaatgatcaaacgctgtttcggtatcctcgaaatcgagaaaatcgaatatgaccagcaggtgatcgccggattcgttaagaagcactacccagacgcgcgatccatcgttaaagctcttgggttctattctaagcgcggcaaaattgatgctggtattctgtctgagattgttggttcggatatcacaccagtaattgaggggcttaaagcgaagaacttcaaagcactgcgagccgaagcaatcaagtacgcgcctgagtatgaaactttcctggctaaacttctggatgcggtatacccgatcgtcaccaacgaatctaaggttgcactcattcaggcagtaggcgaaaacaacgcacagtacgggctggcagtgaacaaagagattcacctgcaatacctgttcatgggcttaatgcttaccctcgcgtgggaggcttaaaaatgtcactggctgcttttctcgatgaagaagaactgaacgaacatgaagcggcctggcgttctaaagactgggacaagatcgaagaacttgtgaaagagtacaccaaagacaaggaaaacaccttgtttatggtgctcgaagaactgaacaacgggaagacatcattacggatctctgcccttgattcatacgataagtttttcatcgacaatgcaatgagccagcatatcgaaacgctgattcctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacatgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgcatcgggatcgcaaataacaaaaagaaaatgttgtggcagtcttgccacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtactgactcacgcacaaaaagctgaatggactttgaaatacaagtaccggatcggtcattaatcaaaagcccttgcagaaatgcaggggctttgttatattggttgtacaccacttgtgaggactaaattatgaaaattcgtattgaagaaatcatcaaagctattgaatccggcgatcacttgatcaaccgtctgcatagcgaagacatcaaactgtctcttacttgcaatctctctgatctgcgcacctacgcatacgcgcgggatcacttccctaagttctatactcgcatcatggaagaatataccgtgctagttgaacaactaaatcggcctgacacccaacgctatcacaaattagcgcaacgctcgcttgatctgaccaagctggctggggtatcattcctgtcacgattaaacacggagaaagaaaaccgtaatgaatgaattttatctatccgttgagcaaatgggcgatcacatctacgagcgcttcattgactctgagggacgcgaacaggttcgcaaaacaaaatatgcgcctacaatgtttcaacacgctatggcgggtgtagactcgccatatcgcgacatttacggcaagacctgcatcaaaaagaacttcgaaagcatcaaagaagcaaaaaactggatgcagcgaatgaaagatgtaggcatggaagcgctaggcatggatgatttcaggctggcgtatatatccgatgcctacagaaaggaaatcgaatacgaccgcgacaagatccgcattgcttcacttgatatcgaagttaccgcgcctgaattccctgatccccgcgaagcaaaatatgctatcgacgcaatcacacactatgacagcgttgaagataaattctttgtgtacgatctggtcgagggcgggttagatgaatgggtagcgtcgaaagttgataccgaaaacgagatcagcgaagaagacttgaagaaaattgtttaccgttcattccagaccgaaaagtcgctgttgtcggcttatatcaaagactggaaagagcggacgcctgttattgttacgggctggaactcaaacaagttcgatattgcgtatatcatcacccgttacctgaacatcttcgggcaaaacgttgttcgtcatttcagcccgttcgggaaagtgactgcgaagacaacaaccgaccattacgggaacgaacaactgggctatgagatttacggcgttgctcaaatggatggaatggatctctataagaaattcagtttcaccccgcaaccgtcttactctctgggtgcgatcgctgagttcgaaacaggtaaaagcaaagttgattatgaaggttcgctgtctgaacttcgtcaagcggatcaccagaaatacatcacgtataacatcgttgacgttatccgcgtgttggatatcgacggtaaacgcaactttatcgaactggttctgtctgtagcatactacgcgaaaatcaacttccctggggttatgtcgccgcttaaaacgtgggacgcaatcatttacaactctctgcgtgaagagaagaaagtaatcccagaaaacaaacgccatactaaaacgccgtatgatggtgcatacgttaaagatccggttgtcgctccataccgttacattgtatcgttcgacttgaccagcctgtatccatctatcatccgacaggtgaatataagccctgagacaatcgctaacagctttgcagtgcgtccgatgcatgaatacatcaataagactgcgccgcgtcctagcgacgaatttagctgctctcctaacgggtggatgttccgacgcgatgttaaaggcgtgattccggtcgagatcaagaaagtatttgatcagcgtaaggcgtggaaaaaacgaatgatggcgggtgagcgaaatctcgaactgattaagcacgaactcgaacacctgacagacgcgcacaaccaaatgatcaaccctgatttcgagttctacgaagatttcagcgatgaatcaaaagctgtactgaaaacgctgtctaagcaaatgcttaaagccgtgaagaaagtgtgtgagaagaaaatcgcacaggcgaacaccgcacagcttaaccgtaaaatcagtatcaactccctttatggtgcgttgggtaacgaacatttccgttacttcgatattcgaaacgccagcgcgatcaccatgttcgggcagttggctattcagtggattgagcgtaaggttaacgaataccttaacgaactgtgcaacactacggattacgcatacgtgcgttactgtgacaccgactccatttatgtttgtatggacaacgtgatcgcgaaagtcggcggtgaaagtaagttcagggataacaaccattgggttgacttcctggataagttcagtaaagaacgcatggaacctatcattgataagggctaccgcgaactgtgcgagtacatgaacaacgtcgaacacctgatgtttatggatcgcgaaatcatttctggaccacctctgggatcgaaaggtctgggtagtttctggacggctaagaaacgatatgcggctaacgtatgggactccgaaggaacccgctacgagaagcctaaattaaagatcatgggaatggaaacccagcgaagcagtacaccgacagcggttaaaaagttcttgaaagaagcgatccgtcgcatcctgcaagaaggtgaagaatccttacacgaacacttcaaagtatttgaagaagagtataaggcgcttgactaccgagaaatagctggtgtatcatctgctaacaatatctcaaaatataatgatggtgctggcttcccaatcaaagggacaccaaaccacatcaaaggcgttctgttctttaaccgccatacgaagggtattcaaggaatcaccccgatcatggaaggtgaaaaggtgatggttctgccgttgcgagataaaaacccgtggcaagctgattgcatcgcatggcaatccggtacgcgtttaccaactgagatcgaagaagatattttgaagtgggtagactatggcggattatttgaaaaacatgtggttagcccgttgcaaaacatcacggaagcatgtaaaattgattacgaaaaacgcgcatccctgaacactctgttcggtgatgactggtaagacctgacggggcagaaatgccccatttatataaatttgtgaggaatatattatgcgtgtatataaaccggaaaaataaatgtctaataaagcactcctgaaaaaactgatcaaaaactcgaatagtcaatctgcgtcaattctgtctgaaagcgatgttttcaataacatcaccaaaactcgaacccgtgtaccgatcctgaacctggcgctgtccggcgctttcgatggtggtctgacttccggcttaactctgtttgctggcccgtcaaaacactttaaatcgaatctggggctggtgacggttgcggcgtacctcaaagcgaatgaggatgctgtgtgtctgttctacgattcggagaaaggcgtaactaagtcttacctgaaatcaatgggcgttgaccccgatcgtgtggtgtatactcgtatcacgacagttgagcaacttcgaaatgacgttgtgagccagcttaacgcgctggaacgtggcgacaaagtgatcattttcgtggactctgtaggcaacaccgcgagtaaaaaagaactggctgatgccctgtctgacaacgacaaacaggacatgacccgtgctaaagcacttaaaggtatgttccgtatggttacgccttacctggcggatctggatattccgatggtgtgtatctgtcacacatacgacacacaagaaatgtacagtaagaaagtcatttccggtggtactggtctgatgtattccgcagataccgcgatcatcctgggcaaacaacaggtgaaagaaggtacggaagttgtcggttatgacttcatcatgaacatcgagaaatctcgcttcgtgaaagagaaatccaaattcccgcttcatgttacctatgagggcggtatcagtatgttctctggtcttctggatctggctatggaaatgaacttcgttcagaccgtaacgaaaggctggcgcaaccgtgctttcctgaataccgagactggcgaactcgaagttgaagataagaaatggcgtgaaacggaaaccaactctattgagttctggaaacctctgttcactcaccagccattccttgatgcgattcaggaaaaataccgtattcctgacaaagagatcactgacggggcagcactcgaagatctttattctgacgatgaagtagaaccgtcaaataaatttgatttggatgacgatatccctgatgatgtggatatgtcagaagagtaataaacaactgggggctttgcccccttttaataggtgaatcatggacattgaacaaaaaacaaagaacattcttgatgaagcaatgcaggacgttattcaagaactgttgatcaacgatgaaaacgatgttgcacacttagtgtacatccataaagtgtattgggataacggcttgaaagtcgaattcagtacgccggacgaagataaagaaaaactgattccgctggttcacgatgcaatctacgcgcagatcaagcctaatctcccaaagcctgaaaagaccttatgggcggcgttgaaagtaaagctgtataatttctttcagatgttcgcaaatctggtttaagaggtaacaatgatcgtcgaaacaatattttcaaatctggtttttaatggtacgtattttgttcaggcgtggccccatttacgccgtgaatatttcgaagggaacgcgcaagttctctttgatttgatggataagcacgtacaggaattcaacagcattccttcacaaactgctttagaagtagctctggacaaaaagagcctgagtgatgtagtctacgaagacaccaaaaagatgatccgcagcatgaaaaatgcgccggaagatctggactggttgatgaaagaaacggaaacctattgtcgtgacaaggcaatgtatcgcgctctgtcccgtgcaattgagatccaggcgaatgctgaaaaacctgctggagaacgcaacaacaaaatccctgacgttggggcaattcctgacatcatggcggaagcgttagcgattagcttcgatagttcggtcggtcatgattacttcgaagactatgaaaaacgctggatgctttaccagtccaaagcgatgaagattgctttcaatatcccgatcctgaacgccattaccaaaggcggcgcagaacgtggaacattgaacatcttaatggctggtgttaacgttggtaaatctttggggctttgttctctcgctgctgattacctgcaatcaggtaaaaacgtcctgtatatcagtatggaaatggctgaacacgtttgttctaaacgtattgacgctaacctgcttgatgtgtcacttgacgatatcgacaacgggaacattacctatgcggactataagaaccgtatggaacgcctcaaacagtcgaaggtcggacgtttaatcgttaagcaatacccaacagcaggggcgaacgcgaaccacttcaaagcgctgattaaagagcttaaattgaagaagggtttcgtacctgatgtgattattgttgactacctggggatctgtgcttctacccgtgtacgcggggcggaaaacacatacatcctggttaaagcgattgccgaagaacttcgcggtttggctgttgaaacaaataccgtaatgtggactggtgcgcagactacccgcgccgcgtgggatgcttctgatatcagcatgggcgacgttgccgaatctgctggtcttccggctactgctgactttatgttagctgtgattgagaccgacgagttagctgatcagggcttgcagttgttcaagcagatcaaatcccgttacggcgataagaaccactttaaccacttcaaactcgaagtgcgtaagggtaatcaacgctggatggataccgacaacagcgatatcgggttcaaatctgattataaaggtcgtcagatgccgaaaacgcttgaagaagcacaaggtgctatggtaaaacaagctgaaactaaccgaagcagtaagttagccgaagtagcaaacagcacagacattcaattttaacggggcttcggccccctccaaaggtatagtgaaatgaaaaagattctcgttattgtgttcctgatcctcctgtctctgaaactggcagcaatcggggttatggcaaatgcttcctggtggcttgtgtttgcacctctgatcgtgatcggtgtgattaagctggctttctgggtgctgtttgttgtggcaatggcaaatgtattccctaaactgactctctggattgcaaaaaacgcaaaataatcctgattaggggttgacgggagttatgattgtgataatatgactcccgtagacaacgaaacggattaaaggagataccaaatgaacttactgaacaacccatacgacgaagtgatgaacccagaactggatttcagcgcgggttatttcgatgcagtagtgaacagcgtagtaaacagaggtttgctggttgaaatgctgaaaagtgggaaagcagatgttgaaggtagcgttgatttcctctggggcttcctcccaatcgacccagaattcaaactctgctgtaacgaagttcaggccaaaaacgttcttcggtatctaatcaacaaagcataaaattaagccccgaaaggggcttttttgtatctgtaggtattgcaatccttctcgaaaggtgataccttattctaaacaaacaaaggaggacatcatgaaacttgcaatcgcttttatcttactggttctaaacgcacttatgggctttccgttcccgtggttagtgcttctggctatcccgtttgcatggaacctgttcagaatcggtttagcgggttgtgttggtgtcctgatgcttatcatcggcgctatcggtggcaaagacgcttttatcggtgttctgaaagccatgaaagagggcgttaaagaaggtttagtgaaatgagtgatttattagatatgatacttccagacgaagaaccggagttcgatagtccgtatcgttccgaatggatcgtatcggttgatgataaaggctatgtcgatatcatgcgctggcctaatattcatcctggctatctggacgaaggtatcaatgcggaaatgctgggtatgcctgaacaggttgaagatcctgctggggtgtataagtggatttgcagcccgtgggaaacccgcgactgggaaagcaatattgttgatgactggggctttgatgtggtagaatctacccctctgttcttattaccggaaaaggtcaatggcaaagttaacgaaagcggaaacgaagcaacacaacaagataatggatctggtggagtctgataaggcgctaacctacgacgaaaagttattcattatcgaaaacttccatgaaggtgcatttacgaataactctgaactgggcgcgttctttaccccgatcggacttgctcgcgatttcaccattgatgcttgtaccagtggaagcgttgttgacctgtgcgcgggtatcggtgggctatccttcgcgatgcttcatatgatgatgtacgccaaaccgcgtgaaatcgtctgtgttgagttaaaccatacatactataagttgggtaagcgtatcgtaccggaagcgacctggattaacgcagacgcgttaacgacggagtttgatactatgtttgatatggcgatcagcaatccgcctttcggcaagataaagacatccgattttaagggtaagtatacgggcgcggaatttgaatataaagtgattgaacgtgcttcacagattgcccgtgcgggtacgttcattctcccgcagatgtccgcgaatttccgttactctggacggcgttatttccaacaggacgaatcaacgacaacatcgaaatgcaaaaagtttcttgatgaaactggccttgaaatgcaaccaggttgcggtattgataccggatactatctggaagaatggaaaggcgtgaagccgatgtgtgaagttgtctgtatggaattccctgaaccggagccagaacccgcgcaaaaccttttcactttcacaatagagtaaagactatgagcgatcaattaatcaaaaacatggatttaacctacagtgtgcgaatgattcgcctactgaaaaagccctggactgaatggacggcttacaagctgggtatcatcgacggtcaaggggaagtattgaaaaacccgaagacgaaggaagaactggaagcatattccccattccatcgctctgtgagacacatcaagcgccgtttaaacgcggttccttatatgtctgggttcatgaaccttacaagtgcttatgactcgttacggagccgctggaacctgaccgagcaagatcacgaagaaatcatgatgaacctcccagaacttcgcgaaagactcaacgaagaaatggttgcaggtgattcaggcggaagcgtggataacattgcttcgggtgtgactacaggcgcgatcacgaacaaagggccaaaggttctgggttctacgcgtccatataaacgcaaacgtaaaatcatgaagagtgaagaatgaaaccattaccgcctttgaattaccggatctgggttactgcgaacaattacacctggtttccgatccgtatcaagtacatgagcgacaccgcgatcgtgtacacgaacgaaagaaaaacttcatcgggtgtcgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggagaattcagtatccattcccgttgtccgatttgtggcgactccatgaaggataagcacaaaaaacgtttctggatatttccgtcaaaacgaggcacacatatgatgtgtggttgttttaactgcaactacagcaagccgttttctgtgtttctgaaagactattacccggatgattatacggcgtatttgatggaatctttcaaggatcgtaaagatttaaaacagacgcacgaagaaccgccgaaggaagaaaagaaatatattcctgaattgcagttctgcgaacgtctggacacgttgccagaaaatcaccctatcgttaagtatgttgcaggtcgtcacatacctaaagacaaatatgatcgcctctggtttacgcgtcaatggcaacacctggttaactctgtgaatgcggacgcataccctttaccgaaggatgaaccacgtttggtgatccctatctttgatgaaaagggtaaaatcgagtcattccagggacgcgccttgcgtgacaatgccaacgcaaaatacatgacaatcaaagcatgtgaacactcaacgaaagtgtatggtcaagataccatcgatccgttgaaacctgtctacctgcttgaagggccgctggatagcctgtttgtagataatgctggtgcgattacgggcggacaaatggcgctgtccgatgttccgtataaaaatatgcgtgtctgggttcttgacaatgaagcgagacaccctgatactactcaccgccttttaaaattaattgaggctggcgaaaaggttgtgttgtgggacaaatgcccgtggccgtcaaaagatatcaacgaaatgataaaaacggacggcgcaactaaacttgaaatcatgcagtatttgaaagataatactgtttctggactcacggcgaaacttcggtttaagtcgtggaacaaatcaccgaaaaaatgagattgatatgactgataaaaacacttttacatcatgtgcgcacctggttaaccctgctgatctggaatttgttgataccgaatatcaaaaggttctggcacgtaacggcgatcctctgcaatcaatgctggatctgcaaaaccacgcacaacaaagcctgtctgataccctttcatgggttccgcgccctgataacctgaaaacgtgcggtgatatcttggactggctgaaactgcaagatgatgcgattgcagatgaaacccgcgaactttacaccgctctgggtggtatgtctcgcggtgcaaaagcggcttccggtgtatggaaaccgtggaaagcaaatcatcaagaactgcgtagccaggtattcgcagaaatgaaagaagaagacaaactggaaatcctgtttgaactgattgatcagtggcacttcttcatgtgtaagttcctcgcgctgggaatggatgcggaaaccatctacaagctgtatgctctgaaacaggcggaaaacctgcgtcgttgggcgaacaactactaatggaaatcgccgcgctacatgccgtatttgctttgtcttatatcgtctgcgcggtgataacgtatctcttcggttggtgcgttttccacgttaacggtgttgacagaaaagccgctttgatagtattatcattgctatggtttataggttttttctacgtcatctatgaggggcgaaaatgattgacaaatactatatcattgttacgaaagacaaagacggctttactattccatacgttgaaaacgggaaaacgccggaactgtttgcatcaccgcaacttgcaaaagataaattagattttatccgcaagtgctacgaaaccaaactgaactacacgccggatgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagtgacgatcagaagtccgcgcatgatcgcgttatccacaacatccagaacgccattcatacaactattacgggtggccctggtgttggtaaaacaacactggttaagtttgtctttaacactctgaaagggttggggattagcggtatttggttaactgccccaacacaccaggctaaaaacgtgttagcagcggctaccggaatggacgcaacaacgattcattctgcattgaagattagccctgtgactaacgaagaactgcgtgtgttcgaacagcagaaaggcaagaaagcgcctgatctgtctacctgtcgcgtgttcgttgttgaagaagtctcgatggttgatatggatctgttccgaatcatccggcgcagtattccaagcaacgctgttattctgggactgggtgataaagatcagatccgtccggtaaacgccgatggacgtgttgaactctccccgttctttgatgaagaaatctttgatgttatccgtatggataaaatcatgcgtcaggcagaagggaacccgattattcaggtttcacgcgctgtacgcgatggtaagatgctgaaaccgatgtctgtcggtgatctgggtgtgttccaacatgctaacgctgttgacttcctccgtcagtatttccgccgtgttaaaacgccggatgacttgatcgagaaccgcatgttcgcgtacactaacgacaacgtggacaagctgaacgcaacgatccgtaaacacctgtacaaaacaacagaaccgttcattctcgatgaagtgatcgtgatgcaggaaccgttagttcaggaaatgcggttgaacgggcaaatcttcaccgagattgtttataacaacaacgaaaaaatccgagttttagaaatcatcccgcgtcgggaagttatcaaggcggagaagtgcgacgagaagatcgaacttgaattctatcttctgaaaacggtatcgctcgaagaggaaaccgaagcacagattcaggttgttgttgatccggtgatgaaagaccgtctgggtaactatctggcttacgttgcgagcacttataagcgcatcaagcaacaaacagggtataaagccccgtggcattcgttctgggcgattaaaaacaagttccaggatgttaaacctcttccggtttgcacgtaccacaaatcgcaggggagcacgtatgaccatgcgtacatgtacacgcgcgatgcgtatgcgttcgcagattacgatctgtgtaagcagttaatctatgtgggcgtaacccgcgcacgttacaccgttgactatgtataaggggctacggcccctatgaggttattatgaaattgagtatcaaagttaccgacatccagcagattctgaacgcagtcgaaaagattcgcgaaaaagaccctcatgcaaattccatgtttgcaatgtacagcactatcgatcctgctgatgtgatccgtaagctgaaatacattgacagctacaataaaaatctgtattgccctaatgggccaagttattcatggggtaacgtcgcccttacagttgaacttacatatgaagaatatggtgttgttactatgattcttcgtgtcatgcgtaacttacgcgaaaacaaagacctgtggtacttaccatgaaaacagatatctctatgaaattccctcgtcttcatgcggatctgattgctgacctgattttaaagacaccccgcgagcaaatcccgttacacgttgattatgactatctgtgtgaattcgtggaagctgttgaaaatacaaagcgactcgaacagtcgatatataactgtggtttgcgtcaattcggtatgcagatgctgagtaacgaagaaatcagtgagtttgatatcactcccagagtagcccttgcgctggctggtttcatggaagaatataagaggattcgtaatgtcacatcttccagttgattacgtatgggactatgaaactgtaggcccgtcaccaaacggtaaactcgttgaactgtcttacgttccgtttatcgacgacccccacaacccgccaacattcgcggaactggtttcgcgggggagaaaatataagttcgatttgaaaaagcaaccggatcgcattgctgacaaatcaacgatcgattggtggaaacagcaaagcgaagaagcccgtacaatcctgaaaccgtcgccggaggatttggaactgtatgcaggacacagacaattcttcgaagacctgaaagcggacggtgtgagccgttggcaatcactcgattacgttcgcggccctgaattcgatcgcggtatcctggttgatgtcgtgcgtaagatggttggtaagatcgacatcttcgaagatatgccgaccgtgttctggaatagtcgcgatgtgcgtacatgtatcgaaaaccgcctgttaacgcgtgatgcttcgacctgtcctcttcggaaagggttgcttgatggttttgtgatgcataattcaattcacgattgcgcgaaagatgttttgatgatagtctattcattgagatatgcgctggggctggaagaacccccaagtgaagaagaaaccgatccattgagtctgccgaggaaaagatgattaaattatcatttgtgggtaaaactgtacatgcaaaaacactgaacgaagcaaaagcgcagatgtttgacattctcatgaaccccgcgttcgttaaagtcgaatacgatgaatatgttgttcagcctggcgatagcatgtattcaatcgctgaaaaattatacggttgtggtgagcgctggcagtctatcgctaagttgaaccgtaaaaccgttagtaatgcaagctatatccttccggggatggttctgaaattgcctcagttagtcgaattatgataaaaagcccttgcattcgtgcaggggctttgttattttgtagggactgaaacaaaagaggatgaaacatgtttggtgatttgaaagaaggtttgaacattttaatcggatttgcgatcattggtgtgattgcgtgtgtatccggtgcggtgtggttgtcttatcaggcgatcgtgtggttaggtgaatggcttcacattctggcacagtaaggggatattatgcgtttatgtttagttggtgtgggtttcggtcgtgcgttaactcaagggttaatcgactcaatccgctggattcaaccacgcgttgaactgtacgcaatgccgaaccggatcgaatactctggtccaacaccgtacaaaatgaaaccgtatcaagcaccacgcgttaaccgtgtgctgcaccgtcaatctgtaaacaggggtaagtgatgaaagaacttacgatcgtcgcagcagttctgattttcgtcatagtttcaatgattatcgtcagactgtaccagcacggagaagcgtttgaatggttcctagatcacgacaaagcgtttcgaaagcatttcgctggtgagttcatctttactcatgtaagcgtagcaagcggcacagtaacgtttgattttgacgggaaagggaaatcataccatatcgaactttcccttattgaagctaaacgcgtgtatgatgcgacacaaaacggcggtatgcgaaagatgcttataccactggcaaaataattttaatagcctcttgcattgcaagaggcttttttgtatattgcgcacataccaaaaggaggcaactatgacacgtattaacacaatcgatccttctcttctgctgaacgaacacctgatcgcagaactgcgcgaactccctcgcatccccaatgccgttttatccggtaaggcaaaaatcaacctgtcaaaaatccctgctgtgtatacgctgggaaccggacacgtaaccttcttttacaataagctgggataccttcgcgatcgtcatgttgcattacgtgctgaatacctcacgcgtaacggtaaagaatacatggacggtgcatacgaagatttcgatcttagtccgctgtcaaactccctgtttcatcgtcatttgtgcgcggactggcaaccaacgccggaatcagtgaaaatcaatgttgagcgtatccgtgaacgtttcgaactgcgcaaacgtgcttatcggttcggtactgagatcatcaacgacgaagcggcatgggatacgtattacgaaaaattaaaagaaaaatacgattttctttgatttgggtattgacccaaatttcgatatgcagtatattacacacatcgaaacgaaacagacaaaaggaacgcatcatgaaaaacttagaagccaaagtagttaaagtcctggttaagaacggtttcaacgaaaacgacgcggtagcaatggttgaaaagaatctgaatgatgcgttgaaagttagaccagaagcaaaacctgctaaactcgcagaggtgattgtatgcatcatgtaaaagtaagcatcaaggatatcacggtgggtgacaccgtgatccacgaagggaaaatgaagactgtcgggaaaaacgatatcaagcacgaccctttgtttggtgttctcctgttcggtgatagtttcaacttggggagaacttttattgaccgggttattttcccgaaatggtatcaagggaaacgggtttaacaaatagcactttttgctaaagacttcacgggatagctttgatatagttatcccatcgaaacgaaacagactttaggagattgccatgtatacttttgacgaactgaaagccgcagcacagcctttactggatgcgatgttcaaagcccgtaacggtggcgcattcgaaaacgaattctttgaaactgttttcgttctggaaaaaggccgtaagtatcatcgtattgtgcaggatactcgcaacaaacagactggtgaaatgttcgatcagcgttcagttgctggtttcctggacaatgacggcaatatcctgaaagccgcaggatggaaagcacctgctaagggtattcgcggtaatatcttcaacaacccagagaacgcgatcgaccgtagcggttacgttcgctatcttcgctaaaatcggggcttcggcccctttggaatattaaaatgaaactatcagcgaccgcaagttggtcaatcttcggactgatagccgcaggggttttattcttcgcatggcaatcaagagatccgaacaaagcggcgtatgaagccgcacaacgagtagtagaacaggatgcagaagcgcaacacgaagcaatgttaaaacaacgtcgtgatatgggctttgtggagactgtgagttacacaaacgcttttggtgatgtcaccacgcgctctgtaaacgtcttagggcgcacgaaagggacaatgctcaccatcagacgggaaggaaccggaaagctcgtagacgtgtgtttcagcgcgattacggacgattccaaacgcgaactattcgccccgtatttttctacgccagtctatgctaaatttgacggcggagaaacaaaagagtttagcgcaagcagaggaagtaccgaagatttcctgtgtattacttccccgcaacgtttccttttcaatatggatcgtgctaatgttatgcaagtccagttagtattcctggatcattactccaaagtgccggaagtgcatgaatggaacctgtcaacatataatgaggttgtgaagaaatgagcagacgcccaaagaacagcaaaaccgaaatgtttgcaacgtttgatgtaaacggaaagaacattgagggtaaaccatgcacgaactcaaagtttatgcatatcgccggattgcctggtatgagtgttaagacttcgtatgattgtcattacaacgaagaaaccacctctgtttatttgggcgaagaactcatggctgaacgcgtcatgcagtgtgtgcatttccctggcgaacgtccagaagtgaactgttttattgttggttatcataaaggtattgtaaatgagcaagtataaagttggcgatatgtacgccccgaaatctattttaatggctgtgtgtcaaatggcatcagaagccgatccgattcgtcgtatgtatgacgcgttgcgtaagaatccgatggacttcaattcaccacgccggatcagtatggtgtatgaagaaacagggattctttatcttgaaggtattcccgttcctgtaaagttcaacgatatgaaagggcttttcaatccggtatgggttgcaccagaaccggaaactgaaattacgatccacgtcaataaaggtgaggaagtaccgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgtgccctggatgtgatttacctgaaactgagtacaacccacgggacgacagaaatcgcgcaagtgatcaataaactgcttgataagaaattagataagtggtactctacttgtagttaatcaattacgaggatcggatcatgttggtttatcgcgttgaattgaaagcgtctatattatccaaatatgatggatggtgtaagcaattaggcccgtatacgggttgtgtcggtgatgaagacgatctctatgagtatctcgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatttgtatggtgtacgaaactgatctcatgtttgcagggaacaaacaatgtgttttcagcaaagccgcaaccccgatccgttttattccattgtcagagatttattaatgccaacatatacctataaatgcaccaagtgcgaaaaagaattcccgaaaatgtccagcatcgcaagccgcgacgaaccgaaagattgtgattgcgggggcgaggcgaaacgaacggttgataagccgcagatggtgaaagacggattcccgtacaacaagtaaaccccgaaaggggttttctttttcatagaaccctatataatgcctgagaactaataaagaggtgaatatgagtttagatttcttaatggacgataacgagccgcagaaagcaccagaagccccagcaaagggcgctaaggtggatgaatcattctgcttgagcgaccgcgatcatattcgcaaacgtccgaatatgtacgtgggttcagtgaacaaagaagcccatgaacgttttatcatggggcaattccgcaaagtggaatacgtggaagggttggtgaaaatcatcaacgaaatcctggataactccatcgacgaagcgatccgaactgatttcaaatatgcgaacaaaatcgaagtgaagattgatcacaatctggtcactatttcggacaacggacgcggtattccacaagatgacgtgagaacgccagaagggaagattgttcctaaacctgttgcagcatggacaatggctaaatccggttctaacttcgatgacgaaaaccgcgtaacaatggggatgaacggtgtaggttctttcctgacaaactgttacagcgcgatctttatcggtgagacatccaacggtaaacgcaaagtcacgatcaactgtacggacggggcgcagaacatggattaccgcaccagcccgacgaaggagcaagggacaaccgttaagtttacccctgacttctctatcttcggcgtggacggtatcgacgaagagacaaaggaagtcatcaaagatcgccttatggcgcttgcagtggctttccctgccattaaattcacatataacggtgatatcctcccgaacaaattcgcgatgtatggcgcgatgtacggtgataaaacgattacccagacaaacaacaaaatcagtttcatcctggcgagcacagaagacggtttcaaacagaaatccttcgttaacggattggatacgaaaaacggcggtgttcatgttgacaccatgatcgacggtatctattccgaactcgaaccgatgatcaagaaaacacacgctatcgagatcccgaaagcccgtgtaaaagaatgcttgactttggttgtgtttttgcataacttcaatgcaccagcttttgatagtcagacgaaagaaaaactgactaacaccgctggggagttcaacaaccacgccggactgaactataaaaagatcgcgaaacagattatggatacttctgaaataatcactccgatcattgagtccgctctgattcgcaaacaggccgcagaagccgcagccattaccaaagcgaagaagaaagctaaaaaggcgaaggttgcaaaacatgttccggcatcagggatcgacactgacggggtagaaaccactttgtttctgaccgagggcgattccgccgtggggcagtttatcgagtgcagaaacgaagagacacaaggcgcatttccgctacgtggtaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgctgacgttgacgggggcgatattctcaccctactgattgcgttctttagccgctggcctgagttgttcgagaagaaaaagatccgttatatccgcacaccgattatcattgcgaaagtcggtaaagatgaaaaatggttctactcccttgaagatttcgcaccgttccgcgataaggcgaaagaggtacgatatatcaaagggctgggttctttacgtaaagaagattacgatcgggtgttgggcgaccagttaaaatacgatacaatcgtactgggcgacgaatacaaagacgttctggaactgtgtttcggtgatgaatccgatccgcgtaaagactgggtgaacggaaaacataaattttcggtgaaatgatggaaagaagtattaaagacgttgtgcaggtagaagggcttacgtttgccctttacacaatttattctcgtgcgatcccgcacctggtagacgggttcaaacccgttcaccgtttcttcgtgcattccgcagcgaaaggcggtacaggcttccagaaagtagcctctatcgctggcggtgttgcaatgtatggttatcaccacggggaaacatccgttgaagaggcattgtctcttatggcggcgcactggtgcaataacatcccgctttttgaccgcgatgggttctttggttcccgtctggttaaaaagccaggcgcaccgcgctacattaaatgtaagctgtctccgctgttcaaggctatctacatggacgaggatttaacaattccgcatgaagatcctgaacacgtaccgccagcctattacctgccaatcattccgatggtactggttaacgggttcagcgggatcgcgaaagcatacgctaccaacattccaccacacgatccgatttcggttctgaatggatgtgttagttacctgaacgggaaagatttcacactggatctgaaatacccgcatttcaaaggtgacattgaaaacggtacgatttacggcaagtatgaactccagggtaaaaccaaactggtgatcacagagattccggtcaagtacgatcgcgtgaaatatatctctattctggataagctggaagagaaagggtatatcgtaagctacaaggatctatcgaaagaagatttccgctacgaaatcaccctgaaacgtgagtacacaaacgggcttacccgtgagaagatcctgaaagatttcggattgattgagaactcaaacccgaacatcaacgttatctttaacgggaaactgcattcatacgagcgtcctgaaacgttgctgaaagacttcgttgatatccgtattggtgtttaccaacagcgtattgataaacgcatccaggagactaaggaagcgttagataaggcgctggcgaaggttgacttcattgaccagatgatcgcacagcctgacgcgttgaaggggcttagtcgcagcgaggcggttaaacttgtctctacgtggacgggttgcgagaaccacgccgaaatcctggttgcgatgaacatctaccatttaaccacggatgaacgtcaaaagctggaagacgaagcgaacgaactgcgtaagcaactgaaatactgggaagaaacgaccccgaaaactgaatatcttaatgatttgaaagaactttcgaagaaattgaaataatttacaaaagcctcttgcgttgcgggaggcttttttgttatagtgtcctcactgatttggggaggatataaaaatgttcaaaactcgtagcgacatggaaataaccatttgggccaaaagcatcatggcgaagcatggtttatctcattggtctttcaaaattaacggacgtttcaagcgtactctgggacaatgcagctacggtcgcaagttgatcgagttgagccgttctcacgttaaggaagatatctacgaaaacgttttagatactctcatgcacgaaattgctcatgctctgaccgaaggggctggacacgggatcgtttggcaacgcaaagctatcgagttgggcgcacagcctacaccatgcaaaagccgtatccgtgagaaatcagtaattcaggaaagcgaaaaagacgtatacgcatttttcctgaaaactccgaacggtgaagtttatcagtgcaatatgacagaaaagatgtacaatgagatccaggaaggtaaacgcaacattgcaaacatctatatttcaagaaacaaacgagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcattgatatgaaagaccgcgaacgtcagaagcaacaggtttacgaataccttaacaggatgtgcaaacctattgaatacgggcttgatcaaaagcctgtgaaatattcttgtgacgacataatctttaacaccaagtgagatataaacaatgaaattacgtcagttagcaccgcaaaccattcacactacgggcttcgataaaggcgaacgcacgaagtttaaaatggctaccagtgcgaaaacgttcaaaatcctgtcatcaaccatctacaaatacaagatccgcgcaatcattcgcgagatctcctgtaacgccattgatggtcacatggtagcgggtaacatgaatccgttcgatgttcagttaccaactgttctcgatccgcgtttcatcgtccgtgattatggcacggggttaagtgactggatggttaaagaggtgtttaccacctacttcgaatcaaccaaaaccgacaccgacgaactgatcggggcgctgggactgggtagtaaatccccgttctgctacaccgaaacattcactatcgaatccatccaggacggcgttaaacgcgcgtacacggcttacatggataatggtgaacctttcgttgaccaaatctacgaaatcgaaacagacgaacctaacggcgttcaaatcactgttcctgtgaaagtcgaagatatcgcagagtgggaacgtgaagcagcgcgtgtttacgaaccattcacgggtatccgtccgcgctttatcggtgttcaggttgatgtcaactggcaaccaaaagaagcagacgaacgcgggatcatccgttataagtccatcaactattccggcgtatacgcgcgtatgggtaacatttgctacccaatcgacatggatatgttcgaaaactcgctgttctattgctaccgtaacagcaattacgcttatattctggatttccctctgggatcgctggacttcatgccgtcgcgtgaagagttgagccttgataaagtcaccaaaaaagtaatcctggatcgactggaaaagatcaacaaacgctatgacgaagaattagttgcagagttcgacagacaaaaaacaacccgcgataaactcgtatggttcaacaatctgcctagtttgttacagacatttgtaacccgcgataaccgtttccgtgtgggtaaaaactcactggctgaaatcctgacgcatatcaaaagtcctgagactgcaaccggaaaatacgtctggggcttttgggctaacccatatgacgggaaagaatgtgtatatgagcgcgttggatctggacgccgttatgagacatacaaagcggaaaccaccaaacgccaggacgttatgcgcattatccaaccgtggcgacagaagaaactgttcattgttgaaaacgacaatgaagcgcgttcactccgtccatacctgatcggttactgcatgttgcacggttcggatcgtatcagtttcgtaaccaaagagattaatagcgatcctgttcaggacttgatcagaactgggtatttcgacgaatccgaaattgtcacactgaaaaccagtgaattaaccaaagaatttgacgtgtacacggaagatcgcaagcgctggaaagcaacgcgtgaatcatcttctggtgattgtgaatcgcgcccgaaaacgcctacagcatatcattacttcctggatgatcggggcaacttacagaaaaatgatctgtacctgaccaaagcacagttcgtgaatctggatgaaatgtacgctatgcgcctgtacgggattgatgaatatagccgactggatggcgaagcaccgaactattctctgggtagcatcgccagcagtatgatgaccatgttaacggttacagggctgaaagatgtgatggttctgcgaaactctctgtggagtcgcattccagatagcaacatgaaatgtcttgatgattatctggtaaaacgttttgcagacgcagcgaagaagatgaaacctaactggttccctgcatggatttcatcaaaccacggaagcgagatccgaaccctgcgtgattctatgggtgtaacccttgatcgcatggttaaaaaccgttacaatccagaattgtatttgttgcttgattatcttgatggtaagttcacctacgatactatcgagggcaaaaacaaatcaaaaactgtggtgcgtaaccccttacttcgtgaaatgtcaacgaagtattataaaatgcggaaagatatgaaagaacgcgttgatactgcttacgatttatttgcagaacgcaacccatcaatccattacatgttgctgcattcgtcttattctacattccgcagtatgtttaatgacgaaaaaattacgatggatttggtcaaccttatacggtggaaataatgagaaacgttaagatccttgatgatgtacaaaagaaagcagtctatgagggctttctgaccagcgcgaacaaaaccgcactggctaaacaatttggtgtaagcgcccgaaccatcgggcgcgttattaccgaacaacacgctaagtataatacggaagcatcaaaaccaattccgcaaacagatgtcaaatctaaaatgattggttctgaatcgtttattactctggtactggacggtaagatcatcacagcggattcgtcgcaccctaacttcgaaaaagcacacgctttaatggttaagggcgatatcgagggagttgctaccctgttggacacaacgcaagcgttgaagatttacagcaaaggcaacattaaaatcatcgggcataaagtcctgtacaaagatatcgtgtttgatagcggtatcacgcaacgtatcgttcgcgaaatgtacaacgatcgcccatatgagcacctggtgaacttcttcgagaagttgatggaaaacccttcacgcgatgctgtgtatcagctttacgggttcatggtgcataacgatatcgaactggcagatgatggagatttctacgcgtggaaacgtgttcgtgaagacttccgcgatctggcttccggtaagttcgataactcccctggtgttgtggttgaaatgccacgtaaccaggtagacgagaataaaaaccgaacctgttcatgtggtttgcatgttgccgcaaaatcgtacctgcctcactatggcggaggacgtgggcgagtcattcaggttaaggttaatcctcgcgatgttgtagcaatcccaacagattacgacaacgctaagatgcgcgtatgtcgttatcaggtgatgcgtgatgtaactgtgggattcagtcactactaaccccaaaacagcgcctggagcgattcaggcgcggaggattcgattatgaaattcctacagagcattcctgactactggcagaacttgagcggggcagaaacagccatcaaaaccgctaaagaaatctggaacggaggcaacgttaccgctggacgtacagaagacggcgaacagacatatttcaaaaaccttacggtattatcgcaacagcccttgcatttaatctgggttatgttatgctggtaatcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattcggaaataaactggtaaagaaaaatgaaaagaattctgacaagacttgacatccacaaatacgctgttaagataggtgacatgaagcgcggtgacttcaccaagttcgaaggggttgacctgaaagaacacggcttctacctggtagttgatgataaaacgggtaaggtagtattccgattctacgtagccccaaatcaacgccgtaagactggcgcaaaccgtactctgttacgtatcaaacgccgcgaacacgaaccatcagcgatggtggccttgctggatagtgcttctctgtacttcgttgcacacgataagattaaaaacctctttggtttctcaaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagacgaaatcgtagcaacttttgacaaaaccctgaccgaactcgaagcgcgtattgctcacgataacgaacaggtcgcacaggtagcagcagaccgcaaagcagcggaagaagaacatcagcgtaagctggctgaactggctaccaaagaaagcgatcataccgcaagcgcaacacgcgccggacgtatcgcggataaaatccgcaaactgctggattaattatctaaaatggggctgaaaagccccaataaggaaaataatatatgtttgtaatttcttcgtactatgattcacgtcaacgagtatcgttgtcttctatttccaaagcaccaaaagatatagatgacttcggattgcttaactttgtcaaaaaagaaatcgaccgcgttgttccagaaaaatacagaattgttaaaggatctgatagcttaactatcgtaaaactgtatggcgaagtcagtattcaacatcatgtgccattatatcctcgatgaacaacctggtagcgaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacacggggctgtatctcgttgaagccgacgaagatatcattgaaatcctcgaaaccgctcacggacattatgtgaacggatgcaacaataccccagaacaggatcacgctgtcaatatcgttaacctcatgttagggccgcgtacagatgacaacctgaaatgggcgagcgaatccaacgttcctcatgagtatgtcgggatgtattatcagtgcaacgttgacgataaagcgccactgataccggaaaaacagatcgatttagtagttcgaacaggtttcttcttatgagttcacaaattctgttcagcaaagaagatccattaggcacagattcatcggtgcagcgcttattctggcacatggattatacaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaagcccttgacttcggttgagggcttttgttatattggctttgtcgaaacgaaaccactaaggagattcaccatgactaacctgactaaagttaccgcgacatacttcatttcttctggcgctaaaaatgctatgtacaccctgcgtgtagagcgtcgtggaggtgaatttacttctgataactatatctgcaacctgtctactgacccagataaagcggaagcgaaagcgcgtgaatacttcgatcgcatggtggatcgtcttaaccagaccgatactttccagatggtgttccagggcttcgcagatttcgatctgttcgaacgtcgcggtaaactgtctgtacaggataccgaaaatctggaactgttggagaagggcatcatgccaatcggcaagcgtaaaggtgaagtgattgctgatatgccgatgtatactattctgtggtgggctgatcagtgcaaagaaaacggcaacgatagcccagtatttcaggctatttgctcttactgcatgggcgtagcgctggagaaggattatatcgctaaacgtgaagagatccgcgcagaatgggaagcagagcgccaggcgaagatcgcagcagcgcaacacatcggggaaatcggtaagcgtatggaaatgagcggggttgttgagaaagtgatttctctcggatatacccaagtttcttattacaccgaagtggaacgtttcatgaccaaaatcaacgtagatggtaacgtggttatctactacggtaacaaaattgttgaagagggtgatgtgattcgcttcaaagcgacacctaaacttcacaacgaatacaaagaagttaaacaaaccattgttcagcgagtaaaggtattataatgacatacgaagaaatgcttaatgaagtgtgcgcgggtaaaaccgcgtaccgtccaattaacccagatatgatcgtgtttcgtgaaggggatacgatcattcgacgttctcaccgcaaggttgagattaaccaggtattcattgcgagcgtagaagaacagaaagcgactgattgggatattgttgcagaagaagatcatcatgacgggcttgacctggttttcgttattgaagatcacccgctgggggttcgtccgtacatttaccacaatcaattcagaggcgaagtgattctatcatgacacacgacgaagccatgaaagccgctacacgcggttttaaagtcgcccctgtgggtaaggctgggttctttgtatatcacagcgtagaggctggtttccggcgaattacgatagggaacgttggatactggaacgatgaatatgttccgacaccttacgaacttatgcgcgtatgggacatatacgataaaagcccgatgacgaaagtaaaagatttcatcaatcgggctttgagtagtttgaaactgaaattatcatcgaatcctgcctaaaattcttgcggcctgattgcacacgatcattaacttcgtatcgacgacttcgggcttctgtatataccattccattagaatcgatccagaataatagttttcgagattgaaataaggacaactaaaggtatatgctaccggaacaaggtcttttgttggaagatacgggcttgcaatatctgagatatagtatagcccgtttatatgtctattatactcttccgatgtcttgtctataggatagccacccagatttttcgggttaatctgttgcggtaacttcccttcatacgcaattatatcaacaaaataattgacattcttaggtctgaaaccaaagattgccgaaaaatccgcacccgtagttaaatgcactatgtttaactgttcgatggatgcggattcaaacttttttgccttttcaatatccatcgtcggcacgtctataacgcttgaagatgttttccagactgaaaataagtcatcccacttgtaccatgttacaaacataatgaaaatagtgacgataagaaccaatttaatgaataactgtttccatgttttgaccgccatgatgaacgatattacccgttcaagcaccgccaatttatcttgtaatagcgacatgtttaatcctcaagttcggggatgccgacccccgaacatatttaggaatttacttaacgttgagtaaccaaaccagaacggttttgacctacacgggcgtttagatagtcataccatctggtcgcctgagaagaaacaacctgatattgacgatatccatcatgtatacgtccgttgttgtcaaaatcgaatacaccgccgtcatccatagtaagacgtaggttgacagcaggaccgttttggatggtgattacgctaatatccgggcttgattgtgctgcaactacagtaccgaatgcgttgccgttaaaactacccccgaccgcaggatagccagaaggttttgaatatggtgaataccaaccaaccccccactgaccacgataacgggcgttgttatagtaacgctcatacaccgtaaagttgatgttataaacggactgattcgccatttgtgacatccagaagggtaaaccgattcgaacggcattaccagcagcagacatccatcgttgtcctgtttcgccgaccgcagacgatccgatccacccaggaactcctacaatagccataaaatacctcatgaaagaggggcaattaagcccctaatttgttttcgattacttccagacgttcgcggatttcattgattgcgttcaccagaagcgcgttaattgcagacggggagatcgtcaacataccagtatcgcggtcttcgcgtactgcttccggtaataccttttcgacatcctgagcaacaagaccggattcacgatgatatacgatatcgtctgcatccttagattgtttatcgtagatataacctttaagctgttcgacttttcttaatgaatctttcaattcaacaagattagatttcagtcgaatatccgaacgaatataaacatcgttaaagttaccgttcccttctgcatatacaccacggttagtatacacgttagcatcggtaagcatcagtgatgtgcctaaacgatagttatggaatgttacaacttcatcgttgctaccaaatccgatatacataccgttattacctgctttttgaataagtaggtaacatgacgagttaaccgcagggccatttaataccattgctggcccttcaaccccttcgacatatgttcttttatatgatgaagtattaattgatgtccaacgcatgatacgctgactgtttgcgtaagcatccaaaacaccgtcaccttcctgtcggaatccggtatcgtcatcacccaaacaaatagcgtttgtgcctaaaccgttcagagtaccacaaccaagaccactgttaaaccttgcggaaccaggaacaacaagaccttgagagccgaccgttaactgtccgttactgttgtcgacctggaaaggtcgatgcccattccaaccaccatacggatctcccgaattagtcaacaggaaatatgtgttcgcaccatcgtttcgaataaagaacccatagtttccagcaaccgcgcggaattgaccaccgccaccaggagatgtactttgaacctccgcacgggcgcgaacataaccatcggttgaaacctgtaattcctcttcttggtcagtagaacctgttgccagtctccacaaaccaccctgaacagtttcatgccagataatgtctccgttaccgccacggaactgacgcaaatagtttttagcaccagttgttccaccagataaaaaatattgcgctgggatattctgaggaacatcattataatatgattgaacgttgatgctaataccgcctttagtgttgataaacaaagcaccagcaccacgaatataatgattatatagtccgttgctatctttataaccaaagtgagtagcaccatcaccaaccgcgtttccatcaccgcttgtatcaacacgaagaattgatgtgttcgccccttgtgtagcgtaatcagccccaacattcattctgccattaaacgtcgcctgacctgtaaatgttgaaagaccaggaacggttagatggtttgcgagaattaaagttccatcagaagcaaaacgacttgcatacgaaccaccaccagatcgaacatacacgttcttccctgtatctgcataaatcaaaccaagttcgttacccgcagaatcccggaaaaacaggtttcggtttccgtcgccttttgtgatcagttgggttcctgttaagttaccactgaccgttgtactcataccaacgtttaacgaagcaccggaaaggttaattgaaccatcccagccattaagcccaatctgagcgcgtagaatgcccgtagcgcctgttgtcttgtttggtgcatcatatgcttgtagttcgatagaacccgccccagtagttgcctggtgcgataatagagcagcaaggttagcaccgccagcaggatcggaagtattcgattttgtgttgacaaacaaagtaaacgtgcgcgtatgctgtgacgggaacggatctgtaaccgcgttgttatctgaacgagtagttaacagataaggagcattccccgcagtatcagcaaccaggttaatacgacgaggaaccgttaactgggtgttgttctttaatgtcagattacccgtcatttcgtcgccagctttcttcacctgtgcatcattcgttacgttgcctaatccgatttctgcctttgttggtttatcgttttcggtgtatactttatagcctttgtatgtgattgtgtttccagaagggagcaaaggcaagttagcctgactccagatagtattaccgccaacggtagtacccgcttttaaatctgccattattagatcctcaaatgcttttatgatatttataaaaagaaaaagccccgaagggcttttcttatttttgggctttgagttcccttacttcttcacgaagttctttgattgcgttgaccagtagtgcgatcgttgcagtcggggaaatcgtcaatatttcgttttctttggtatctttaccaacagataccgcttctggtaataccttttgcagttgctgtgcaatcaaaccagcttcacgggtaacaggttcaccaccaatatgatttgatttatcataaaccaaaccatcaagcagttcgactttatccaatgcgttttcaattttggtgaaattacttttcagtttttcatcagaacgaatatacacatcgttaaagtatccgttagcacctgctgtaatgttaccagtcgatgttgtaaagctaccatcaccatcaaaatagaatgcaacagagctttgcagaacaagacgaacacgagttgcgcctggtgtgaagttaggcatgtgaacgtccatcgcagcaacataagtgttgttccacgaagttgctttccagatactataagcggagttgtttactccaggaacatcaacagataccgcagcagaacgttcacgccattgatcccaaccaccgccatcaggagtacctcgaataatacctcggtcagtccctgatacagcgcttgtcgagtgtatcattccagcgtaatattcccatgtattcgagaatgtgtggttagtacgaattttcagtttgccgtctgcttctgcccaaacagcacctttttccgcgccgttattaagcctaaaccacaatacagagttaccgttgctatcgagatataaattacttgaactaccgtaaccttgccggaaagtcatcgcaccatcgcaagaaatcgacaacatctcatctgtatcagtaacgccacataataagcgatatacgttaccctgaactgtttcatgccatataacatcaggagcaccgccacggaatcgacgcaaatattgtttacttccactcgcattagggcttaaaatactatttgcatatacaccaggactaagcccattttgatgtattgtaccgcgttcaccgacaacaaacgaaccgttttcatcaaaaataaattctgctgtttgtgtgtttccggtcgccttgtttggagtagacgcaactatacgaacaccagtacggcggtttgctgtatctggaccatctttaaaaatgtatccgtcatcaacaggagtaccatcgtttttgaaatatgtaaatttaaaatgtctaccgaacgcagattgcaaaccaacgtcacctattacactaagtgtgccgttcatcgtgtcggcagtatttttcaatgcaccgatctctgctggagtcggtttgttgtattcgtcgtagatcttacgccaaccattagcgtcgccagcagaccaagaccaagcaccaggagaaccagaaccgcttcgaatatggaatacaccattatccagataaatctgagtaagagcattacccgtattcgacgtgcgccggaaattgacaacctgaccactatacgtattattcccgtaaggcccatcaacaatgtttccgtttactgacagaacatcgttcttttcggttacaacagcagcaccaaaactgtttccctgcatactgcgaggaatacccgtgatataacggctatcgtggtttgtccaatcagtaggagttaccgtattagcagtaattgccccgcttacgtttaacgtggttgcactcaccgcagagaaggtcgatgatccggctacacggaaagaacctagttcaacggatacctgttgattcgcagaatcaacaacaaaggaagtatttgttgttccgtttttgtatgcgttcagatagatcctgttgccaccgtcagcacgggcgttaatattcatagttgccagcgcaacgccggaagcattaaccccagtgatttgcataatgccctgttcggttgaaggtgttcccgtcacatcagaacgtttaaacaatatacccggagcagccccgcccgtggtgatatcgacataactttttgaatacagcgtgttcgctgttaagttaatacctacggtcacgctttggttgaacgtggtgttcttcgcaacagtaccgccgttgatcgtcgagagggcgtttatatcctccgctgttggacgatcgttttcggtgtatactctccaccctttatacgtcaatctgtcgccagagggcaacagagggaggtttgacgcactccagatacccgcaccacccagcgttgtacctaatttcaaatcagccataaaaatttctcctgtaatgactgtatttatgaaaaaggggctttcgcccctttatctcacgattgacagtttaacgtctttagccgataccgtaccgatgtttgtgttgtttggataacggtataaaccgaaatcaaacgtaacagcaccagcaggaataaccccttcgtttttgtagaatgaatatacgttagggatcgtaccaacatcgcgcatgttgattcctgagatatacgtattattcgcgtcccagaactgtattgtgatatacgcgcttttaccgttagtgattgcgttcacatcgcgtttcatttggcattgcatacgaatcgtatcaccagcttttaagccataactgcttagtgatgctttcgttaccgccgcttgctgggtagcagtccatcctttgaacgggtactccgctgtatttgtcgaagtgtattcaaccggatcagaaacaatataatcaagttcagcaaagttatgcgaaatgattttcttatcacttgcaacaccagtaggcgaaacgggtagagaaagcaatttatcaatcgggttctcatttccgcttgcgtccacttcggaaagtgtctgcattcgaacaccgttcacaccaagcgcagcaccattccggtttatttcttcgcgaggtacttttgtgatctggacgttgcgacattgcgccagccccactttaacggtagacggataatgatatacctgcgaacccattttgacgtttaccggatctgtcggaacagtgaaatatcctgataatgaatgccactgatcgggggctaatccagttgttcgaagaatggttgaagagatccattgtccggtactgttttcagtccacatatacaggtaaacttccccacctgcatcacgaagttcttgcgaacaatatagttcacccgtgaatttgaagatatcgcccagaaaaacatcactaccaacaatccacgtcccgtaatcgtggaagccataaagatccccgctattctggtatgtctggacatcatcgaccattctttctggaataccagttaccccgatatcactgaattcatcaaacaccacttcaacaaaactcgtagtattgtctttcaggctaccagcaccaccgacaaagttttccatgcaaatctttttcatcgtagatgaatagatagctgaataggatgaacggtgagaataattggttgttgtgatcgggatattaaagaaccgagtttcaggccacgcaacagaacctattttcctcattgttgctaaaaagtcatcgtcacttttgatagcatcgaaagtataaaaacatacaattctgttcgctggaagtgaattcaggtagtctttaatcgcattcccgttcgtagcaggatcaccatacatatcgaatgctttgtaatccaataatgctaaagttgttccatcaatgacagccaggttaattccgcgagcaacttgtgttcgtctgtttataatatcagccccgttaatagatacctcaaccgagttgaccgcagaatcgagattagttccacggacaacaaggcgatatttcacggcgtttgcttctgaaaacacattcgccgtgaaactatcagggccgaataacgccataaattcgttattcgccatttaaattattcctcccacacaaattcacaagtcttagttgttggatttgcgaagatttttacgtttccgattttgatgtaatcacgaacaaccagagtatctacagttgaacccgcaaccgcaaccgccccaatttctgccggagttggtttacgacctgcatgatagatcaggtttccgttgatcatcgctttgttgtaatcggtgatattgatattgaattcagtcaataccttatcgtcaatgccagttaagcgcatcttctggacgttaccagagaaatcacccgcctgaacatgtgccgtaccgctcacactggtaaagcgtccacccgtgccgtttacgctaactgacagcgcaccagtcatagtatcacccgctgtattgacataggtactgtcaagatgctgggtaaagtttctggtgttgattacggttgcagtagtcacgccgttatcattactgattgttacgccgttccaaccgttagttgcatcggttcgtaattgtaccgtaggacttgcatcacttgcaatagtcacatcacctgttgcgttcgtgttagccagtgctttaccattcaggcgcagagtagtaccggagtaagccattgtaccgttagatacatcaccaacagtcagaacgtcggtcgtgtcggttgtgccagttgacaagcgatacgtagttccctgaacagtttcatgccatgtagtatccgtcacaccaccacggaaagtacgaagcaagtttttagttccagcggttgctgtactcaaaacagtattagcataaaccgtgtttgctttcgcagactggttaatgttattgttcgtggttacggtgttgttaacagttaccgcagcgttagccgtcagagtcccgttagtggttacgttaccaacgaagttgcttgtaccgttgaacgtgttgttgcccgttacggtttgatctgcatcacgacgcatccagcttgcagctaccacaccacccagtttcaggctattctgtgctgttgcgttcaacggtaagaagttttgcagagcaaagttcagaccgcgaggcgatacagcgtagaaatcttccagataactatctacaggctgagtagaaccaaccagattatcaccgatgaacgtgttcgatttggtagtgataaacaccgcaccacggcgcaatgttgtagcaccccatgccggatcagtaccgttcaagaactgcatggtagccggagtaattgccaggttagtagcagtacccgcagcagcttcgctgttggttgcacaacgaatgataccttcggcggtatccgtcgctttcttcgcttgcagtttcttaggcgtgatgaccacgttatccagagtacctgcatcagtttcgccctgagtcgctacgcgcagagtaccacgctgtgtttcagtagcagacgcaatccccaggttaaccgttgtccagatagtaccggactgagttaaaccatcagtggttgcaaccgcaacatgactcgtaacgttgaagaactctttcagcttaaccggaacaactgccttattcgttgccgtacctgctgcaacttccgcagtggtagcgagggcaataataccatcaagcgattcagtagccttgcgatcgttcagcttcttaggcgtcaccgcacggagatcatcggttcctgtgttcgtttcgtcctgagttgcgatctcaatcaaaccgatacgcgattcagtagacgttttacgatggagcatttcaggagttactacgatcggcattgaagcagatccagcagcagcaccagttaccacttcgttttcggtcgccagaacaaccagaccttttgacttttcggtcgccgtcttctcgttcaatgatttcggagtcagtaagtcaacaccgttattgaagttgtagacgttagtaccagcatccccacgtaaagccccctccgctgtcgtagcgcccgttgtaacgagtttcccgatacctgctagggtttcggtcgcgcggcgcgtgtcgagcttcttaggcgtgattgcggtagtgtcatcagtaccagcgtttgtttctgcctgagttgcaatttccagaacaccacggcgatcttctgttgctgtacgttcgttaaactttttaggcgtaacaattacgtcatccaaaaaagtagccgtagtgttctggttaacttccgcagttgttgccagacgagcgataccacggcgtgtttccgtagcagttttattcgccagtgtacgcggggttactgccagttcatcagaaggcaaatcttcccagtttttgtttacttctgcctgtgtagccagcgcgatcacacccagacgagaacggtttgttggatcaacacgttcaatgatcgggcgatattgtgcaactacccattctttcgtagctttcagatacgacaattctatatatggaagatagtcagtatcggcgttgaaagtcagagtgtcaacactgaaccagtcatcaggtggataatccttacgctgtgggaactgcatcatgtttttgttggtgcggatcttttcaccggaatcatctttaactttgattgtgcagttctgcgttttccccatcatatacatactgatatacacgcgatcaccttcggcaacatcttgcggaagagtcagcgttacgttacgcacagttggaggactaccagcgatcggggtgataaacacgtaatcgttcggcaacatgttcaggtcatcactgatacgacgcagacgaacgcgctgatcaccatcataaacgacccagcggctattagcctgatcgaacatgaagataccataaccggaacgctgtgaagtcacagaagttacgttgttgataccgtcatagctgatcgtgtgtccgctaccaggataaacttgcagagtcgcaacgttcaccgaagcaaggagatccagatcgtaagttgtgattgagtcaccatcgtttgcgtatctaggcaattgcagagtaatcttgcctgtaccgctattacggaatgttaccatacccgcttgcagttggaaagaacccgcacctgttgcgttcacaaactgcgaatcgcggttatcgcgcatttcagaaacacgccataagttaccgttaaagataaacgctacggtcatgtatgggtgagtcagtcgataagagcttgactgaatatcacgcaaacggatctgtcgggtgtttgaacgaaccaaaaggttgttgagacctgcaagaccgccaccgtctttaatggtgataatatcaccctcaacaggggaatctggtagaatatatgtcagttcagagaaacgaccatcagccagtaagtacgtaccggattcaacagggagaccgtcagtgctcgttacgttgttatatacccattttggatcgttacgggttgagatccattttgtttcatcgaaagcacccgctggtgatggaatatctgcgcgagcgtaccaaatacgacgcgcgtacatgatagccataaacgcagcatagccacgggtagaatcgtattgttggatcgtgttaaattcgttaaaaaagtcaacgttcacgccgtcgctcaacacagagcgggatgctttaccaacgttgataactttttcgccagcagcatcaaggccacttgtggcgcggaatgatttagctaccattatcgttttcctttatcttattcaatactgatatttataaacaaaaaaggcgaccatcaagtcgcctttttctcacggtaattgttcagccaatctttaacaatcgcgtgatgaagaggattcgcataatctaatttgtttcttttcttgtatggcgtaaaagcgtttttctctttgtccgtcatttggaaaagggtttgaaatgatttgcgttgccttttcgtttgaactgcttctgtggtttcgataatggcatcaggaaaatatttttccttcatgtatttcgctaaccgcatatcaggcacaaataaattaatctttcgtttgctgttgttgtgtcggatatcagaacgagcgcataactgaaaggctggttcgtaatatttactgacaacataagcatcaactaattcttcctcttcgagtccagaggacaccgcaaccgctcgcaacatttgacgaagccagggtaacgggttgtaactgaataatgctaccacgttagtatagctcgaatagaagttcaatccgtgcgagttatacggaatttcttgcccctcgctaaacttcgatcgatacgtgttggtgcagtagatgaactgttcgccccctagaagcgcctccacgcgttttttaatctgggtgtatactgtcgtcccagattgagagagatcgcccgtataacgcgaataatccccctctgcgagcacatgtatatgtatgcgcccagtgtttttgtattgcttaaagtcaaccagcttttgaagcggtgaatctttgaactccacatcatgaaacgtttgcaggatcttccctgtaattgtgtctttgatgttggatgaagcaatggttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagaccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatatacagggaaaaatccttatacaaatcaaagtcatcaatgtttttcagtgctgcatgagtgatgaaaatcacatcgtaatcattgactacttcacgcagcgcatcgttattggttcttttggttcggtgatccgtgtccacaatcaccgcccgttttccttttacctggttgatgtaatagtcataagactgttttgataacatcatggaaatcgaagcgatgattgctttttcgcccgtttgattgatatggttcagaatcgcctttgttttaccgcttgacggaacacattcaatcgtattaaagatcatttattcttagcgtatttcttctggtatttcttgattgcttcgtcggtgatctgtttaggcatttgacgtgctttcttcggtttcagtggttcgacaccgaagatttcaacgccgtaatgtttcagcatcattgcaacgatttcctgacgaatgaagttttcgggaaattgatctttaatctgcttatgaagacgatcttcgagcgcgtccaggtgagtaggagtgatgatcgcggtgttatcgcgttcaacgaatttctccatgtattccatcgtttcagcatgaacagcatttgcagcagggagtaaaatttcacggctcatttaatcaccaataagttgtttcagttgcagataaccgccgataagtttgttatcgacaaaaatacgcgggtattgaaacgctaaactacgttgccttacccgttttgctaactcttcgatacgtgggcgatcgtattcaaagcccagatcgtttttcgcttctttcagaacgggataaaatgtatattctatccctttttctgtcaacagcttttgtgcttgtatgcacccgtaacagttatgaagactttcgggaatgccgtagatttcgactttcattcttctttccgtatggtttgagatcctgcaaaatacgctttttctctttgcctaacagtttttcgatattctcaacagcggttaactgagtgtgcagatcgaacaggtttgcaatctggtcttcctgcattttcagttcagattccatgttgatttgatagatgctaccaccaccgaaaacatgttgcaaggcgaaacgaagcattgcatcggatttacgtactggcatcggtgcgatgctcaacgtttccaggttagccccgaatgatggatcgatacggagatcacgcagaggattttcctttacagggcgatacgtgaatttagggatatccatcaggcacagatccgaaccagtgacaccagcggaaacctcttccggtgtagcgatacgcataacgttttcagcctctacacctttacccagattaacttcttctggttcttctggggtgaattcaccatcttccggtgttacttccttgaaccatttccatagtgatgcagggagttcatattcgtatccaccgtccatgataaaggcgcgatcttcgaactcaccaatcgaggtgcgatcaatcgtcacataacctttttcacgaatgatgtttgcgataccagttttccaggtcttttctgcaaagacttctggggatacggttaaaccgtaagtttttccagcgaataattccatgattacctcaaataaaaaggggatgccgtaagcacccccgaattatattacttatttgccagcagtgcaagttttgcggcggcttcgcgaactgcgcgagctttctgcgctacaacttcgatcgctttctggtgttctgccagtgcgtcttctactgcctgtgcagcagcgatgaccagttgatcgtgttgctgtttggaaatatcaaccgcctgaactgctggagtgtttgccggattaccagtacccagttcacggaagaatttacgctcacggtgcatcacaaacgggaggctacgatcttgcgtgattgtcgcgtcaccgtcgccgtcaacattcgaaaacaccagaacaccgttgttgtttttgatgtgttgcacaatgcgtttgttcgcagtgtgagagcgcaggaaacctggttcatctaccagaacatacggacggtcggcaacaaaacaaccaggcatcgcttctacgagcgctggctgtggtgcagcaggtttagcaacagacggttcggttactgccggagcgaggttaacaccaccatccagttcagaatccagatccggtttcgctggtgcaggtgcaacagacggtttgcctactggttttggctttttagcgcgttttggcgctggggctttagccggagcaacttctgtgaagtatttcgcttcccatgcacgaagggtgttcatagcgacacctgctggagcattgaaggtgtagcgatcaccgttacggcttgcgatgtttacaacaccgttcagtaattggtggatctgttttgactgaacactgttagcaatgtttttgccattgtcggtgaaaccttcgacatcaacaagcttgtaatctttaccagtttcgaagcgggtttcttttgttctcaccgtccacggatgcgaaccgcttcctttggtgatgtttttcagcggaattgaccacttccagcaatatgcacgggcttcattacgggttttgaaattcaggatcatgatattatctctcaattgggttaaatttatgctacgtggatatcttaacagaactaccaaccaggtcaagcgatatttttaatttcgatggaattctttttgaactcaatcattcgctgattatccgaaccgcgaaacggtttcttagtcggtcgatccttttcgtatcgtccatcgatcagaacatcaatgaatggtaacagcttagaacgttttgtatcgctctgtaaggcttcgagggcgtaacccgtccaaacccacacatctttatcaggaaacgtcgcacggacgcgctcaagcagttttaacaatactggatgattggtacggtaaaacggatcaccgcctgtaagcgtcaacccgtccacatgaggatttgaaagaagtttaatcaactcgttttcagtctcttcggtgtatggtgtaccgttgcggggattccaagtgattttgttgtagcaaccttcgcatttatgattgcatccagtcacaaacaacactacacggattcctttaccgttaaccacatccatgttatagatgcggtcaaagttcatcagcctttctcccctgggaacagattgttcagcgcttgggtatctaatttcatttgaatcattttatagtgcctttcttctcaaggatcagttctttgatcctttccacgattacggcgtattcccagttggctaacttctgggtatcacaccactgttgaaaatccttcattgcttttacgtgaccttctttccagtaagtcaccgcgatttcgttgcaaagattttcagtagcagtatttttgattttcatgatttagcccctatagtttgttgtctacaggggcatattataacatcatgcgtcgtccgtcaactctttttgaatccgacataatacgcatcagatccattccatgtggaggcgttaacgctacccaacagaacacgacaaggcatattattatgcgcagactctacaacctgggagactgaatccagcggattgctaccagacacccagcggagcagatgacgatcatcaccgttaatcggatcaacgaattcaaagctgataccgttttcaatcagttcgtgcagaagaaagtttatcgctttgcactgcgctttgttgatcagcataaatcacctaccagatctttatcaattttggtgtatgtgagcgccggatcatacttctccagcacgttctttttgcacgaatggatgaatttttccattgcgcgggctttcatcaacactttgaaatcttcaccaaagcattgtttgactgtgggaattgcacgagccgctttgtcacaatcaatgatcagcttgtattcgccttgtgttgtggcgactaccattgaaatcagaacacaaccatcaaatcctttttcattgattttatggaagttcagcttatccgtagtgcttgccaggttcgcataacgatccccgcgaatgttacccggagaactataccgagaaacgttgattgaaggaatacgaatatcttcaacgatatcacatgacgcaacagcttcaacgaaatcaagaattctggtcgctttgatgacgtgcgccttaaacgaaccgacttctaactcatattcatctttccagcctgaatagtagtcaacagcagggctaatcgctttcatgagcgcttcgggaatgtcaatgtgccataactgttctgcgtactgtttgcgccagtctggatacgttttacgtgctggtttgaatgcactaccgccgtcttcgaacatcatttctttcctctctttttcgtaaatgtcgtacacacttcttcgttcgtaagcgtcttttaggttgctgtttactatactatcatgcgtcagttcttcgcaatactttttatcccattcagaacacgcatgatcaaccatttcctgaaaaacgcgctgtggaacattcccatccacaagaatcctcaataagcgatcagtatcatcattcggtaaagtatgaaagtttttaggaagtttaacatagaagtttctcgcacgagaaatcaaccattcttcaccgcgatcacgttcaatagtgtaatcgtacatagcaaaaaaggggctttcgccccttcctcttatttcgcgttcagggagtcgatgtaagcgctaacgtcagcggaggttacagaagcggcatttttgccacccagcaacacatcaatcttcgtcacgatggtatcgacgcttacggaggtgtggcctacagcggcgatcacgtcttccggtacagtcagacccagactttcggtttgcttgttcagttcgatgatctccaggttgattttgacatcagccagtttgcgatccagttcgacgacagagagatcaatctctttgttcatcccttccagttcttcgatcttcgtctgcaagccctgccagatgttacgatgttgcagcgccagcacataatgactgttggacacttcctgccccgccgccagcagttttttgatctccgactctttgccagtgtgaaggtctttgtgttctttgactttctttttcaacttcacgatttcctgaacagcagaaacgcgagtatgttgcagacggtcgatctctttgatcaggatacgtgcagcactgcgccaggcttcttctggggaagtgttttgttcaattgcagtttcaactttaccagtcacgaatgctacgattttcttgaacataattttaccttatttgatttcaaattgattggtgaaccattcaggggctttaacaactttcccctctctgatataaccgattttacatagttcgttggtcaagtcaagtctttttccacccgccatgtaaaattttaatctgcttactgggatcaccggacggataacgtcgcgatagccgaaatgcgcactacgcaccactatagagagcatacgcaagcggttgatgcaaccagtatacgaacgcccagtagcactggagaagtcctccagcgtaaccccaggggcaatagcacctatcagatcaagataatccttttcaacccagaaccgcccaacagaacatttcgatacaccctcagccatttttgcgtttgggtgtttctcgtcttcgcgcttctttttgtcctcaaggaacttattgaagcggatctcttccagtctgttttctctttctacccgtgcgcgtacacgggagggaaacagagtatcaaggattttcccgatcatatcgttggctttccgtttggtagtttcagatcgaaaggaacgttcacaggccggacggtttctaattggagatattgttccatccccacacgcttaccacctactttgttataacgaatgttctttccgtcatagcctacagcctgtgaaatgtagtagtgtttagtttcgcgtaaacactccatccattcttgtgttccggttttgttgcgtacccgcgcctttaatggaaacatcattcaccccgtagaactttcagttcaccagacaaacgctgtagattggcggttgcagtatcgtaacgtttttcggtctctttcagggtagtttcccgcgccttacgcaagaatttttccagatcacctggtttcgtcaccagcttaccatctacgtaaattcgtcccagcaggtgagaacaatccagcagttgttgcgcgtcggctttttcaacagcaggtttaatcgcgacaaactttttaaagaatccgcgatcctcgttatcaaacagataagaatcttcggaataccatgttgtgccattggcatcaacgatcccattaacacctttccgatcgcagtgcgttaccttgataggaaacacgacagatgatagttgattaggcgacagaggactaccacgcaaagctaaattgcggtacaccgtcccaaaactttcttcgtcacgaaattcaaaataatcttttgtccagtacatcatttttcaatacctcatagtttcggtatgtgcaatataacaaaagcccctcactttcgcaaggggctttttgattaattttgatgcttagttcggtgcatcatttctttgttcttaccttcgttgaaaccacggacagcaggagcacccaaataaccgcatgtacggcgcgtgacgctcattttagccggatcgtgattgccgcagtgcttacagtggaaaccttcttctgtaggcgtgaactcgtcatcagagccacatacaaagcacttatcgaccggaaggttagttccgaagtaatccagtttatccatcgcataatcccagactttttccagggcttgcagattgtttttcatatcaggaaattcaacgtaactgatatgaccagcagtagcgatgtaatgataatcggcttcatagtcgattttctcgaacggcgtcaccttgcgatcaacgtcaaggtggaaactgtttgtgtaccagcctttatccgtgatccccttgacgcttccgaacttctcaaagtccagcttacagaagcgatggcagagcgattccgctggggttgaatacagactgaatccaaaaccagttttcttcttccatgcttcggttgcagcgcggagatattcaatgatcaatcgacctaatttctgggagccgatacgatcgaatggatgctggcctgagccaaacatcaacagcgtttcgtgcagtccaatataacccagactgatagaactacgcccatttttgaacagttccagaatttcatcatcaggattcagacggacaccaaatgcaccttctgtgtacaggataggcgcaacgctggctttaacaccacgtagactatcaattcgagtcatcagggcttcaaagcacaaacccagacgatcatcaagaatacgccaaaaagcctcgtgtgcgtcgtctgcttcctgtgcttcaagagcaatacgcgggaggttgattgtcaccacacccaggttattacgtccatcaagaatttcattaccgttatcatcatgccacacgctaaggaaactgcgacaacccataggagatacaggaacgctagaaccagtaatagcacggttgttagctgaactaatgatatctgggtacatgcgtttagaagcacattccagggcaagttgtttgatgtcatagttgcgatcctctggatcaaggttgattcctttttccatgaacataaccagtttcgggaataccggagtgataccctctttacccaggccgcgaatacggtttttcagaatcgctttctggatcatgcgttcacatcgggattgaccagtaccgaacgtaattgtaacaaacggggtttgaccgttcgcagtatgcagggtgtttacttcgtattcatatgactgaaacgcgtcgaaaacatccttttcagttttatctattgcatactgaacatcacgagggatttgatactttttggcatctttaaagtgcttatcatatgtcatttgaacatatggagccagcactttatcaacgttagcaaaggttgtcccgccgtactggtgagaggcaatctgtgcggtgatctgtgccataagagcagtcgcaacaccgattgatttcgggggttcgatgtctgcgttacccatcttgaagccattagccagcatacctttcaaatccaccagacagcagtttgtgtatggcgtgaacgggctgtaatccagatcatgataatggatatcaccagaatcatgcgcttctacaatgtgttttggcagaatgtggttacgtgcgaagtgtttcgctacgataccagccagcagatcgcgctgtgtcgggaatacccttgcgtctttgttcgcgttctcgttggtgatctctttgttggacagattcaccatgccggagatatctttgaacagcttacttttctgttcacgggcaatatcgcgatcgtggcgatattcgatgtatgcacgggcgaccgctgggttcgttttcatcagggattcttcaacgagttcctggatacgggcgatcttcattgcgctaccatcgcggatctgattgtactgaaccagcatgattgcggcatcagcatccgtcatagtaccgccagctttttctacagcaatacggattttttctttatcgaaatcgacgtttttaccgtcgcgtttttctactttcatttcgttgccttcattaattgctttctatatttcgcggttaaggctttgcgttcgtctttgtcggcgtactcgaagcccatagaaaccatttcggcaatcatatcaggtttggtaagtcttgaaaaccattttaccttatctggtatgaatttgtcatgaatacggttttcggaatagtcttgtttcagatatgcaagcaagttctctaaccactggatgtaatcgacatcacgggacaccagaccggatctgttgaatttgtgcttcacaataccttctgtaccgttgcataggttacacagtaggccgcgcacacgtccggcgttttcgccgtctaacgcatggtcatggtcaaggtgatgtttctcgatctcgccctccaggggacgtttgcagatagcacaacagcccccttgttcggtaaagagagcttgcttgatagttgggtagtcttttttggtaattcgtttcgtcagcataataacaccattcagtaaggtgtcattatttattacagggtgcggacgtactcacgaagttggtcgaacccgcctacgtgtttcccgtcatggaaaatctgaggcatggtcatccggcgcgtaccaacaagcgcttcgagttcatcgatcaccgcttcgttcagtacaggtttaccgtcttccacggaatccgcaacagacacgaactcatacggatgttttttcgcgtccagcaagcgctttgagttcaggcacggagcgcagttatacacagaagggatatagccataaattttaaacatgttaacctacattaaatcgttcagtgttaaagggaatgtatttacgtcgcgtttctggtagttgcacacgtagacttcttgcgttttgttttgctcgtaagagtcggtatgctggcctaacagatactttttatccagattatgaacgcggtatttctgcatccattcaatcaggatatcattttgttttccggcgtggtgagtcacattggacagcccgaacatgattccttcgctgtgcagttcatccaggaaagcatataactcacgttcgcgatcttcgttccagaacttgttatacactgcatcggtgatcaggtaaggcggatcacaatacacgaaatcattttcacagatatcaatgtcacggaatgaaccactggaaaactcaatgcctttcacattctttttgaaatgttcaaagcgttttactgttgcatcgttgagcgtccggcatccgaaattagcgttgaagtcgcctttgtcgtttgtccggttaacgttgctgaatgaatgcaggatcaggacatagagccataacggatctttgttctggttgtattcatcacggaatttcagatactcttctttcttgtctttccccagtcccttcgatgcaatcaattctcgcacaggagacaggtcaggaagcgttttaagacgctcatacatatcaataagcgtcttatcgtaatcgttgcttagaacgggtttagggacgtttaacgacacactaaggccaccgcaaaaacaatcaatgaaacgcatgtatgaacttctttcggggaacaacttgaagagttcaggtaatagagactgcttgttgcctgtataggggataacacccaaataactcatagaaaagattccagattgttaacgtatggctgaacacgaagaatagaatcgtgataataattctccatcagttcgaagcctttgaaccgtctgttggttagtatcgacattttcatcactgtaccagaaccagagaatatatcaagaaccaagtccccttcaaccgtccacgttttaatgtgatcttctgccagttgttcaggaaatattgctgggtgtttgaatgcaatctcgtccttcgttgagtgattgcgccctacagcgtaataccagatattacccttaattttatccttgccaacaggtttacgtttcttaccggaacgtgctgaacggttcttttcgttggtttcggaaaagtagctgttttgtcgtgcggtttccttttcagggaacttacacggaatgcggatcgggttgaatgtttttggtgcgccttttgtccacacgaacatgtattcaaagtcctgttcgtatcggttatggttcttcggtagagcggttttgtgatagatcatcgtatcatgcaaccgaaaaccttgttcgatcgcgtacaaggcttgacggaaagatgtacccgtttcactaccgttgatagtcgcgtcacccacaacccacacaaccacaccaccgggagcggtaacgcggtacagttccgatatcaactctttccatacgtgttcaccccagacatcaccagagccgttataatggcgcaagttgtcatacggaggcgaagttatggtcaagtcaacagaaccagattcaagctgtttaatcagctttacggagtcgcctaaatggaggtcaaccccttctttgattgtggtaatcataattcaccaagtcctttctcaaataaggcgatcgtttcgtacttatacccacgattcaccacgaagcaatgattttcgcctaatttctcaagcattgcaatagcacggtgttcatcttttttatctttcaacagataagcaatccgaacaacctcttttagtgtcgcgttgtccacctgttccaacttgaacccgtagcccaccaacttacaaaaaagccccttgcgagcgacaaggggctgattgttgtagaagactactgatccgttatcgttggcgcggatattaaatccttgctcgctcacggataacccctactgtatcggaggtgtttaatacaccgttctcgtaatacgtaatcatcgcatcacgccacccgtcaggaatctcagtttccagagtgtcgattgttttgaattccacaccgttagtgatggtcatcagcaaacctttcttactctgtttccattcggaacctttcgggcatttgtaaacgcctttccacacaccattcacgcggatagcgcacagtttttcagcatacttttgagtgtcgcgggtaacttcttgcagcaaaccgccgcccataccgaacgcgatgttctcactcgcccacttgttcgcttccatccaacttaacacacggttgattgtttcaggcccgtggatctcgtcgccctggatgattcgaactgaattatgcagaactttgtaacctttgctgtttacggtgtatccgaagatttcgcccagtttacgcagggtgtacatgatgttatcaatcatatcaccggaatcaggacgaacaaccagagtaccacccgcagcaatgatttgctctttatattcagcaatgcgatctacagcgcctttgtagtcccaggaatcgtacacacaagcgtagaaactatccccgaacatttcgatgctgtttttatatgcttcgtcttcgttctctttaccgtaggaaatcgtagtcgaatgttcgcgagccggaattgaaacaccgattgcttcgacgttttcaacttcatcaaacagagtttgatagtccgcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcaccagtcaggtcagaagtcatatcaaggtaatgagccagaacctttttacactcacgcgatagcgttgctacagatgacggataccagataccgcgaatcgtcattgtctccagccacccagccaaccatgagaattcacgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcggcaagaacccgcgcaacgaagttaacgccagcggttactacttcatcaaacttaccaccgcgagattcaatatagaacatcgccgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactgtttgcacgtaggacaagtgatcatggttcctactttagcggcttttgcaacatcgtacaattgtttgatgtccttctgccgctcggacgtaatgacacgcccgtttacttctttgacaaccgtttcagttcgaatagaaccatcggaatatttaacttgctgtttctttccagatccaacagtaagccccattgctaaacggcttcgaagttcacgcttcgttctttcaaccccgcgcccaacacagaagaattctccatcttcatcatcgagatcaaggtcatcaaagtcagcccagtcttctagcgcgtccgcttctgaacactcattcattccaaacatagtcgatccttagttgctggtcagtaagaagacccggttgtcgctatagtcgatgtagcaatcccaccaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttaggttagtgtcttgtctacgggagctatattaccacactcataactcccgtcaacaagtttttcgaattattttcaccaggtgatgtaataagtcagatcgctatatccgtcacgcttaggatcgctaaagttggtaatacgacgcgaacccgcgaaggtattgagtaacgcagcttgtcggttgcgctgtgtatcgaaagtaaacccttcttccgccagccattcacccagatccgcatatgctttttcggtacattcctgatccataaccttaccgataaaacgtttcatatcaaaggtatatgattgtttagtcggatatttcaggacatactcggaaatgtctttgcgggatgcttcgaccattttcgcgttgatttcgtcaacaagtttacgcgcacgttccgccagtgtcgggctacgtccacagcggggatcatcttgcgtttcgcgtttgacccactgtgtcccgcttcccgcctgtgcgttcacaccgattccattgatttctaccattatgtttcgccttttttaatgcctcttcaactgagaggcgttcgtaattacgtgattgttcgggagttatcaccagagaaaatccagagtaggaggtttagtgttaatccctaaagtatcgcagacttcatccagaacgttttgattccaaagattgaacgttggaaccttatacaatctggcaagccttgcagcgatcgcagtaccacctttaacacaaaaatctttctctaccgcccagaatagaacaaaatctgtaggtttgtccaggttttcggttaatacctgcattgaattgcgagcatatcggcgctgtacccattcgttttggttgtcgaagtgtccagctacctttctcgcttcgtcagcggctttgtacgtgtcgtattctgtatagtcgatgatatccttaccattcgaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatactcgcgatacgttcagggggttcacggctaccgatcagggtagccgtttttgcgttttcgagaacagatttaaaattcattgttcaggattgcgccccagttctcacgaaccagatttgacgcttcgttagtgaaggttttcttcgccagcgttggattttcgaactgttccaggaaaggtccgtagttacgttcgatttcttccagcgcatcctgtaccgtcagccccatcacgcgaccgaaatctttcgcggtgatattcgcgctgtcaatttttgacaggacgtttttcacacggttttcagtcaggaagcaggtgaattcgttcagcttcactttgtctgtttctgacagttcagaaggagcattgaagcggttcgcttgcttgttcttcttctcggtgaacttcgtcgttttgcatttgattgcaacacgttcaccgttcggcatgaaagcgggttgaacaggcttcatcacgaaaccttctgcgatgttctcaccttcatcatctttcaacatcatgaagtttttgaactcaggttcaacaccgttctttgcagggatcgcaccggagttcgccaggttaaccaccgaatcaaaggtgataggcaatgcgcggatctcgtcaaacgtaccgtatgccagcagtggagccattttcaggccaacagcaacagcgtaatttgcaacaacgttatcagggaggaattgaccattaacgcggatatcaaatacgtagaaatctttttcgccgtagtcaacatctttctgaacaccacgccccgcaaattcgccgtatacctgaacaaccaaagaaccagtatcagcatattccttatattcacaggtatttgctagaatttcccacagcttacgaacaggttcagagtattttgcaactactggttcacaaccgtaaaactgttcagcagggagaatttcaccgctacgttttgccggaatgactttgataccgtccgaagtgatcaggctaaaattagccccgtggatcttttcacgcgcaacccacacacaaccagtaaaaccattcatgatcacaccattgatgaatttaccttcataatggttagtcagagaagaatatttcacaaacataatttaacctttgattttcagttgtttttcaatttgatacgcagctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaatggtctgccggagtaagaacatactggttcactcattagcttcgcccagtcgcttaacgtcagagcaaattgaaggttgcggttacgcgcatcatcgtttttactgttgtatgaacgagcgacacgcagatcgaattcaatttgctttgcacggcggcggtgttccaactcagcaggatcgagtgattccggttctactggctttggttttgcttcaaccttcaccaaatcctttttgatagtcgaagttatcacgcccgaccagcgattcatcattgaagaattcatgtaaacctcttacgctaaacccgcttcctggaatgccagcgccatagcgccgttgattgctttacgtttgttatctggacgcggatcgcgtttagctttggtcttaggcttacgctgttcttcacgatgtttattaatgtacacacggcgcagagcatgtttcacttttggattttctgcgcggaaagcacgaattcgctcaatttcctgaacaatcacgtaaatgtcgccgttatcgagcatgtgctcacgggcgatctgtgcatagcccagtttcagatcattgaatttgaaatgaatctgtactttttcctgctggctaacttcgctgatattacgctgaacgattttcatagttactttcctttagtagaatcaattttacgaataaactctaacacttcggcatttctgctgtcaacatttttaagaacaaaagttacaactacattaacaccggatgcttcgttccaaccatcagcacacgggatcatcagatcatccagagtgttgacaaggttttccatatccgcagggtgatcgacaaacaaagtttgcgtttcggtgatactggctttgaatcgtttcccgatctgtgcttcgagttcgtccagcatcccagcagataacgcggcgatgtcgatgtttttcattccaccatacacaacatgaaatagtttcatatacaactaacctcattttcgtatttttcgcgttcgaaacagtcgggttcgttccagatctggtcaaactcacgtttcgtcatgatataaccacgggcgattttgcgagttagatctgaaccgatcggagcataccacaaaatcaatttacacatcattccctgaaccagacaatcatacagccctttttccagggtgcgtacatctgttacgctatcgactaaatcgggggcacttcgttcaggatggtctttccactgactttcgatgatgtcgtttagttccctgtgaaaataaatccaggattggaacgatgcatcaggcggatttgacttgcaaccagcaggataaaattcaagcattttgatcagcctcattcgcaatacagatcgccataaaggtaaacataacccccaacgcaaccatccagatcgcggttaaatccccatacaaagaagaataaccacccatcacttcaacgcgatatcccagcaagaaaacgagatacgctaacaccttatctttcataattcctcacagaaagcccatgcagcatgataaacgcttgcgcctttgtcatcgttcatgcataccacatctaccggacacacaacccgatacagtaccggatcaccacctattgaacgtgcagcccttccagcatagatacgagccagcccgatatcagcagtgaagaaaacacgatccagatttttctttctgcctttttcagacagagtatcagaatcacaaggaggcaacaacatgctttcgattccggcagcagtacatgatccgtgatagaactcaacgaactctttgcggcagttaatggtattcatggttatctccttgttttcagagattacagcttatcgctattctccagacaagtcaacaaattctttttcaacgtcttcttttgttctgaacaggtaatcagtaaggctacctgtcatcaattcgcgagttttagcaactgaacgaacacggcgttcacgttggctttcggcatcaccaattccgtgacctggttcccacccttccatatccaacataatgcgcgggtgcctcatcacacgaatatcgtttccatatgaatagctgttatattgcccgaatacaaatcttttgaatttttcgtgatgaacatcatcaacttcgacctgttctccgtagtaaacaatttcatcacagaacgcagcaagaacaagcccaccagagttttgaattttcaggattgcatggatcatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgatcactccatttgaagtaatcccattttggatcacaatctggacgcatagacggggtatgccagcgcttgaaccccaagagattacagaaatcgtcaatcagggtatcgcgacgggatttatattttgactggtcgccaagagcagcggcgttgatgaattcatgcagttcatttttcataattgttaccttatggttaaagttcttccggcctatccgtcgaacaattgcactataaacacactcataaaccgtgtcaataaatacttttaaataaacacctggagttctaagatgaaatcattcaaagactttacgagccttgatgaagcgctgatcaccttcggcggtaaggcttatcctaaatttggtcaggtagtcatcctggctggcggcgcgggttctggtaaagggttcaccctcgaaaagctgttaggtatcgaagggatcaccctggacgttgacgcactcaaaaaattggtcatgggtagtaccaaactggcagcagagatcaaagcgaaaactggtcacgatgtcaaaacaatgaacctgaaaaacccggacaacgtagcaacactgcatcatgtgatcgcagacgtgttcaacgtatccaacaaaaaccaggcgcgtgtgtacgctggtatcacagcagcaccggaagaccgtaaaccaaacctgatctttgacgtaaccctgaaaagcatgagcaagctggcaagtatcgcccgtgatgttgaagcgctgggttatcagaaagaaaacatccatatcgtttgggttatgaacgatgttcatattgctatgcagcagaaccttaaacgcgatcgtgtagtgcctaaagaaatcctcatggatacccacgaaggggcagcgctcactatggcgaagatcctgaatatgggcgactctctgaaacagtacatggacggcgatatctggatcagcttcaacaaagtaggcattgacagcgaaatcaagaaatctgacaaaggcggtatgtttgtcgttaagtctaactacatcaaagttaaggcaaaaggaaagccgcagaaatccattgatcagcttgataaagagttagtggcgaaagttgcagcatacgcaccgaaaactgatacatggggttgacaataggaacatatatgaatatgatgcacacacaaaccgaggaattgatatgaaaaagtttttgttcgatatggatggtgtactgttcaactgggaaggttcttttgttccgatgtacggtgacccggcgagaatgccggaagaagaattgaaaaaagcgaaacaggctatatcacaaactgacttctacgaaaatctggaaccattacaagagggcatcgacctgttctgtcatttgagaactttaggtcaggttgcgatcttaaccagcgtagggaaatacaattccgatgcggtagcagaacaaaaaagaaaagcgttgatgaaggtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttcccttttttgtttatggtgtgtaatccgcaaaggagcggttcacatcctgaatagtgatgttcatatcgtcgttcaggaaaacactacgatatttccctgcgctatcccatgcttgacgatgcttatcattgcgggagatcagaggacaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcgatcgccagtttttcatagaaatctgtacgaaccagggacgatacagcagcttcatattctgcatctgtcatgttttgaggacgtttgccaaatttggcttcgatcgcatcgctgaattttgcgaatacatcattgaattcaaatagcagcattgtttaccttcttagtttatacggtaatagttactggttgtgctttaacgtttaccgtcagagttgcagtaacagatccagaggttgctgttacgacaacatcaccttcactaaccgcatgaagtttaccaccaacgatagaaccatgaccggaagagtcaacactcagagtcattgctgtaccagaaggatcgatggtaaacagatcagttgcagccagatccgcatcacctactttgaaatcagcaggagcggttttcggtgtaattgttacgacaggttcagcaggagtaaaatcactcagcttatacagataaccgttacgggattcgatgaaatcaacatcggtgtaatcaatatacgcctgtttcagtgtgtcgaattctttcgcgtatttttacgccagtcttcgcttgcagcattcgcagccacgatgatatcaaagatccaccacggcagataggtaaagctggtgttacgccacgggatcgggtgtaccgtagtccatttttctgtagccattttcaaaacctcttagtttttctctatttagagaagtaaaattttgccgtcacaagacggacatttatcatattggttcacgcgcccatagccgttgcattcaggacagaacgggtttgttacaccgaacacattacggatcgcgtaagtggattgttcttctgtcagccctacgaacccatcggtattgatgaaatgttcactctgttccggcagcatatcggtatcgtcatcaaggataaggtaattcttacatccgaaggtgtcgatccatgctttgatttcatcaccgcgtcctgcttgtcggtctgttagattcgtacaggttttcccaatgatgcgatacaatccccacgggtagaagatttcccgtagagtatgggttgtgttgccgatcctccatgtagaggaaatgacaatatcacagttcgcatgatttacgatccggcgcaggtgtcgagcacattcaatgtccatatgctcaccaaatttcatgcaccgcatattatttagaacgccgtcgatatcaaggaagatgacgtttccgatctctttaccttctgataagtctttcaggcattcgtgatttaattcagtcatattttacctacaaaaaagggggctacgccccctttgaattttaatagaaaccgcgagcttcgttatccaggcgacggtctgcaatcatgtgcgcttccatttggcgagaaacataatcaggatcgcattccatttttgcttcttcgtagttgtcccaggtatcagcaacccattttgaaccgttccaacgagcataaccaggttcagcagggacaggataatcagcttcgtaagcgtggcgcagtgcttcttcaacagtatagtaaggagcatttgaattgactactttcttcactttaccatcagaccaaacaaacagaactgggtaataagcgtttttcatcatttcgtttttcattttgctttccttcttcactgcgagagccattcccccgccttcgagtacaaatatactttaaacgagggtatgcgtcaacaagttttttagcaaaaagtgctaaaacttaaatgtttcgaatcggctatttctggtttcgcgaacacgaacttcaccatcgcgcacgatatagaacgcaagtgatttgattgtgtcgattgcgcttgcatgtggacagctatcaggatctttgtaccagtctggggtttgtttaatccagtcatagatccaccacggacaggtataatacccgttagaactcgcagagcgccccatcatgaagattgtcgggctaaacccttccaaccataccagttcgcctttggactcgtcagaagcgcttacaggagcttctacgacatcaggtactaattggatttgatcggctacttccggcgcgacctctttaacgtactccataaaatccgcagaagcatcaataaccacatcgggaacgttcggggcttcgatgacaggttcacccatagtcacctcacctttatatgcaacgatttccggttcaggggaatcgatcagcagttccggtttttcttcatcttccggtaaagcagcaaccagatccgccagcatgttatcgaaggatttttgtttgttcagcttaaccgcaaacacagtcatagcgtaatcggctaaagcgcctttctgttcttttgcgtcgagggtacggaacccatcaactttttcgtaatcaatgttcattggtatctccaagtgtttatccaatatttatgacataaatacgtatatactttgtacatagggtaatcatagtggatattgaagtcaaatttttaaacacaagccacgtacagattcaggcagaaccaaacattgtctatgaactgcgtgactatttcagcttccagcccccaggctatcagtatcaggccaaatacaaatatggtggatggaacggttacatttacttgatggactacaacgggaaactcccgtatgggttagcctatctggtatccaaattcgcagaatcacgcgggtattcaatctgggttgatccaaagatccacgaaactgaggatatcacgcaagaagattttgataagtgggttagcgaacatccggtttatgacggcgacaaacagatcgacccgtactggtatcaacgcgaatcagtgttccacggtatcaaaaaccgtcgcggtgttctgaacctgccaacatcagcaggtaaatctctgattcaggggcttatctctcgttggtgtctggaacattacagcgggaaagtgttgatcatcgttccgactaccgcacttgttgaccaaatgatcgaggacatcgcaaactatcgtttgttcccgaaatcggcaatgctgggtatccgttccggtacagcgaaaaacagtaatgcactgatttacgtttctacctggcaatcagcggttaaaatgcctgccgaatggttccaacagttcatgtgtttgatggttgatgaatgccacctctcaacaggcatgagcatcaaaaagattatcgacacgatggatcaatgtatcttcaaactgggcttatccggttccctgaaagaagggaaaacgaacatgatgcaatacatcggtgcgttcggcaaagtctttaaaccagttgatacgcgtcgtttgatggatgatggacaagtcaccaacctgaaaattaacacgatcttccttcgatacaaagaagaagaggtcaaaaaattgaagggtgcggactaccagacggaaatcaagtacgtaaccagccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagacattgacgatcgtaacgaaatgaagaaaattgcagaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgtaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaaaatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacggcgagaagaactgaaagccgaacttgaaaccggagaagaagagaagttttaaaaagaaagccccaaccgaaaggaaggggctttttaattttgaagcatagttgatttttaacgcggtgtcgtcaccgctattctaaactgcgtaagctgattaatcagccagccatgccccacaaggggtactgtgacacattcgccgcaacatgcaatcgtatatttgcggggtagtcaatcgtagttcgtgccgttgcacactgttagcataaaggttccaggttgagaaaaaaatcccaatcacgaatatatgttgcattccatataggccattaggtttatccgattatgaaaatgcatccatcggtaaacatgcccttgccctacaattatatttactgctataaatctgggcgttcgtcttcgatacaaccactttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcggaccagcttcattgacaaacgccgtattacgggagttcatcggttgtttgcacacaacgcatttgcaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatggtatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacggaaatgtactgttttctctatatataaaatataaatattataaacagtacatcgtacttacccatcactcacttcgttcgtgaaaactcgcttcgctcgtttgaccttatagatctttattactataatggtcttctcaaaacaaaacttgttaacccagtttaggtaatttaatacctacgatctgactcagcttagatttacctgcaagagcagaccaatcatcacctttgatcaggcgatcagaatcactttcagcagtatacgggttcacggaaagaccgtaacgcatcagaatagcaacttttggttgcagggatgccggatctacggatactttgattgaacctgcttcgtcagcttcggtatacggagcgaagaacagagagcctacgtgatccatatcacccagatcatatttgcagccagtcagcatataatcgaacgggctgtttgtgtctgtatagacataataaccgttgttcagcttacctgttgccagtgggtgttgttcgtcggtttcgtgcatccaaccagacgcagccagaatgcctacaacacgcgctgttgcgaggacgtaggtagcatcaaatgaagtcgttctattcatttcctgccccatttcacacgctaattggtacaggatacgacccaatgctggagcatccttcgcggtgtatgcggtagtaccgtcaaaaataccatccgtaacgagtccatcaacgttgtaacgtttggaaacggtgatcagtgtttgaataatgtctttgttgacttcttcacttgccacggttcccagaatgtcttcgatcaccccatcagcttcgaactggttcgcttccaaatcctgcatcagttcaaccgtcatttcggttttaaacttacgcgagcgtaccggaatattccagcgatccatctggaaggaggttgacgcgatatcttcactggtttcatacttagaagtatcagcggcttcgctaaccagtcgaattttgctttggaacacagctttcatgatcgcggtgtctttgtcagtatccagagtgttcagggtaatcggtgcgataacctcataaacaacgtcagtgccgtcatgcttgaacaaatcacctttaacgtaggctttagtcagatcgatttcgtcgatgtctgtacgtccagagattcggcctgaataggttgcagcactggagaaagtcatatcaccattagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtgcctgttgcttcgttgataactttttctcgtttaccagacggaagcgcagactgacgcatcaacttgtgaattgtgtagtgtttatcactcatttctttggttcctgaatttatagggagtatattgtttatttatgcaacgaatttccattcaggaaatttgtcactctttaaacggtaatcaaggccagatcgagaaagccccaacgctttagcagcatcagaaccacttgcataaacaactccatctatcgacacagaacggcttattttggccttgtgcgcgtctgtgagcttagatccggttctgtcgaatgcagaacccttatacatagctttgatagtctctgaacgcttcctgttggattcttccgattgtttctttcctgtttttatttttgaaaggtgttcttttacttctggtgtcattctttcacgagttcttttggatatttcatgtttcttttcttctgaatgaaacattcccagcataggaccaccagaaccacctacgcccatattgtacacatcgggacgattgacgaaatccaaatttacaatctccctttccttttcatacatttcttcgcttgtatcaaacacgaacaaaatctcttttacgaaattatcaattccatattttcgttgggccgctttgattgctttaccagaacccatgtatgaatcgttaatatcatcagtcgaatgtgcgccgatatagatcctattgtttatagtgtttgttattttataaatgatgtgtttcataatatagcctcaatagttttcattatttatataaacaaaaagggaacccgaaggttccctttaaaaagtcgttgtttttcaacaacttataagcccttaacccagaccttacggaagtatgcgtttttaccgcacatttctttgctgatcataccagaggtgatacgatctgccggagcctgagagcgagagttcgcaaacgggttgatgccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgggaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagcctacggtctgggtgaaaccagttttaccaatctgcgcggtgtagttgatcaggtcaacgatttcgcggttgatttccagcatgatttcagttgccaggattgcagacagttcggcgtcagcgtccataccgtgtacagcgcgaagatcctgcgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacgttgccggaggttacgttctggaagtacgcgacaccagtttcctggaatacgtgcttaacgatagcgccggaagcgatagcaacaccagttgcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtagggccagtcataggctgaacaccgcaaatgtcgaatgcgatcaggttaggaatcgcacggcgaaccataccgattacagcagggccgatgttggtgattgcaccgctggatttaccagaggcaatgttggttgcgtcgtaaccgtggtcacccgcgatctctgcttccgccaggaaaccgccgaaggattcaatgattttttcgtcgcgatatactggatcagtatcagcatccttttcctgagtttccagaattgctgcaaccagttgttttttggatttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgcgattcagtcagatcttttgttttttctgaaacgatggtatcgcgtttcatgttggcgatctctttagcctgagcctgattagcttcgaacaggcgtttaacttcctgctgattctcggtcagttcatcttcgagttctgcaacaacatcaacctgcgcttctgggataactacgttgtgttcaacgaacagttctttcattcccattaccagagattcgaacagatcggccttgatatcacgggacacagcttctttgttttcagagagccattcctgcgcgatgtggtcgaagtatttattcgcatcttcgtacagtttattttcgatttcgccagctttttcggcaacctgggcttcaaccagttcatcggagagttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcggtttgcttgactgagattcggtaatcggcttaacgtaagcatctggagcgcttggcccccaaacaacatcaacgcctactgccaatttaaacccttcttgtacgataccgtaaccttttccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccacaatttttcaattaggatgcaagcattacgcggatcgacattcggtcgcggcgggtgattcatttcacccagagcttgacgggtattaacctgagttctgatataatcgtttactgcttcttctaatacttttttcggatacagtcgcttattgcggttgactttttcggcttgtaggaaaataccttcaatccgaagtttaccgtcttttttcgactcaccgaccgattctaaaattgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgcacgttttgtttttagcgcacgacgcgcaatttggcgacgttgagatttagttaaaccagttgtttgatacgcattacgttcacgagttttgcggtcttttttacgttccacattaccgcgcgaatctacgtgtttaacaatgacttcatctaaactcaaaccctcgacaatggacatcatagccagggctaaatgaggttcattgtccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgttgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttctttgatcagcttcgcttgttcgtcaatgtcttcatcagacattcgaagaatctctttcatgatgtatttatgggatacatatttccctactacaccttcaacctgtgacattaacgttaggcgacgttccatgatctcaatatctttcacttctgcgtaatatgaatcttgctggaaaatgaaggagattttgctaacgttctcttcccattcttcctctgtgatgatttttttcgcgatcaggttagtttttaacggatcggaaagcacagggctgaactgaatttgcagtgtgcggataaacttactaaatttcagttcatcacgggtgatttcgccaccaccaccaatttgcatacccccatcatcacgaggcatacggcttaatggcacacgcagtgattcatagagcttacggttaaaccatttgatatcatccatatcagagaagttagcaccgcctggaagcgtgtctacttcggtgatagctttaccgtcacgacgcatcaaccagtaatcttctgtcattgacaggttgttttgctggttcttaacagtacccgttttagcatcgtacacaacgcggtttttaagcccctgtgcaatgttatttacgtactgtgtcgctttggtgccacccatctgacctacgtcgatgtagaacacacggcgttcaggtgcgcgggtgatacggtagatgaccatcgcatcttccagtaaacgcaattggtttgctggcttgactgcgcggtgaagatatccgataatgttgttactacaatcttccagaccagaatgcgcatacacgatagcggagcgcgggattttaaccttctggttatgctgatagatttgcccgttgtatgtatagccagatttaggagcgctatacacgaaaaattcgcgataaccacggaatactttcacgccaccatcaagggtttcagtgatagattcgcggatcagttccatcgaacgcggatcaagttgacgcagttcgcggatacctttgctttcgtctttatgcatgattttatggaagtagatacgggaatccacataccaatcacggaacagacgcgcacccatgttatcaaaatcatagatatttagaacgttatcaaattcttctacgattttgtcctgaatcgccttactaaaatctgttttggcaagatccaaagtaatgatatctttgccctgttcattcacgatcgcatcgtcaataatttcagaaacagcgttttctacttctgggtaagacatgatgccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatctaattcgtcctcacgggcgaaattcttgaaaaagctaagtacattgccaaagcccaaaaagttcatagtaactccgaaaaataatgataggggtattgctacccctgtatttataacctttattcccaccagtccagcgcgaacgtaacctcaaaggttgacacttcgttgttgctgtcccagtccagggtaacttcgcctacgttagtagggaacagcccgtggatggtgtgatcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgcgcgtcatcgttatagatcgtgattgtccagtcatcataggtacggtcaccagcaacgttgattttgcggttttggtatcctaccggaactttttcaactgtagccgctggcatggttgccgctttacacttgaatttaaagtttttgcccagatacgggatctctacttcgaacaggttcggacgtgcgaaatcaccggattcaaaggcgcgtaaaatgtcagtaagcatttttaacctcggattatttatgggggcttttcagcccccttgactttatacggcttgcggccctaccagttcatcgaaatctgcgcctgtagacgttgctacgaagttcagagtgatgtagttgatagaacgaggcggtttcacgtagaccgttgctacaaactcgttacggtcgattacgtccggcgtgttgttcgtggtgtcacagattacacggtaatcgtagcaaccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagaaacgctatcagtgtaaacacacaggccagcgatatcacctgccagcggaacccaacggttcacgtcattgtatttatcatactgatatttatagttaccatccaggaagccatagcttgaacttacgttcagattgttatcaacagcagcaccaccactgagtttatagccagtacgccattcaatcatgttatcaaccgcagttgccagcgggatattcaccagaagtgagcgcggaggcgacacaaacacggtacaatcctgacgttcatcaccgattgaaataacatgtttctgaacggtagacataatctctacggtttcgccagcacacgcaccagcaatcaacagaggcacatgcagagcttcgcgatcagcgaacatatcccaaccattcatcagttcatcagcgcctacagtatcgtttgaggacaaaccaccgccgaactccaggataccggagaagcctttaggccagttcagggaagtaccgtaaacgtactgagagccaccgttcgcgaaaaagtcatccatgaagatgttgacaccatagatatctttatcggtcttctcggttgacacgatgaaggattcctgtacaataccaccacgacgcacaacaaaagcgtactggttatcggtctgtggcccgtaggtcattacagaacgaccgctgttcttaacggaaaccccagaagggtagccggaaatcatagcgccagaatcgtaagcagctttggagataatctccacctgaacagttgaacccagttcaccaggatacagagccacaacagacggcaactgatatttctgggtaagagtctggaaagcggttccctgaattgtttcttttgcaatatccaggttcaacagagtgatcccagaatcgctttcgatgccgtcaatcgtaatcgacgcagaaacaccggaagactgagaaacaatttcggtagtccagccagtagaaatatctgggtaagtaccaatctgtttagcacgggcaacgattttttcgcttggaatgattaccgagaggatcttgccgttactgtcaactttggacactttacctttttcttctacaacaacgctgttgtattttactttaatagtatcgttcacagtgtagttagaaccctgtgatgcgatagttgttttgatctggttaaaaattgcgcttgcgtttttagcggcatctttatcgacaacgcgaaccacacggagatcattaccgtactgcaagaagttaacagcactcatgaaatagtcagcggtcaagttgtcgggggaaccaaaatagtttaccagttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtctttctcgcagaattcggcaaatttcatttgagttgtaagccaaccgaaacaagcaagcgacataacgaggtcgtcgtgatatccttcttccgcagcccacgaaacgcctttttctgagaaagtacgaaattcgagtattgtctttttgttatttatgatcaatttatctttctcgaccaggtctttcagcgtcgaacatcccatagcttttgatcgcttagtctgtttcatacccagatcgttgtaactgtcacaaataacattctcatattccagttcggaaaacagagatttggcaactgaatgccctgtgctatttagctcaatgtaaatccatgcctcgttatacatattcagataacgtaacaggatgtccggcaaaataagatgcgacgttttgtttgagtgatacaccgcaacctgttcaaatggcatcgtcgtaatgtcgatgatgtgcattgcatggtaatcctgtccgcgaccttccgctggatcaagcaccgcaacatatttatgcccctctactggacgtttatactgataaaagttcgtttccgtttcatcaatatcgatccatgtgagttttgacaacttccagccagcgatcagagttccactggttcccatgaattccgcgcagtgttcctgcaagaatgcctctttgctggagccagcgatcatcttagcagaccacgaataaccgtcatcaaatacgccgttgtcaccgtctgtatacaatcgctctttaaccgatgtccagatcgccgtgtaaggcacgaagccggattttccttctatagcagcgttccagatatcatagaagtggttaagcccgttaggtgtcgttgtgataaggattttcgatttacgaccagaagaaattactggttgaatcgctaaccacgcatcaacaaagttcgggataaacgcgcattcgtcaatgtagatcatcgcgaaggagttaccacgcaccgcatcgggagaagatgcaaacgcaccaattttacatttgttgtcaagttcaatagaacctttgttccattcaacaataccaggctgcaagaagtcgggcagtagttcgatcgcctgtttggtacgatccagaacttccgcagacatcgaggctttgtgagccaacacaccaacatatttatcttcgttgaaacacacgaaatgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacgacatttcacccactccatcaacatttgttgcgtccatttagtctggatatacgcacgtttcaggtttgggttgccgttatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcattagttccgtaggggaaccaacaaatacggttgcattctcgatattcaaaccatcaccaccgcctttttcagcgcctggttttgtagtctcttccgtaatctcacgcatttctttgtgaatcttcatcaggccaatgtttgaaacgtttaactgattcatcaggcttgtgaatacctcgacgtggcgaggtgattcggagttcttcgcgttgtgtaatgcaatctgcgccatatccatgatcatctgattcatatggtgcgcagtcttacgcgcgagcgtataatcctcttccagatccggtttccggtctgctggatgtgattgaacgtcaaccagttcaagtttttcgtaaacaaccacatcctccccagactcaacgccgccagggagggaatcaatattcagcaattgctgcaaatctaatttttcatccattctcattccctcggcttaggaggttcatcaccagacgggatcggcttatcgtgcgagtacgtctgaatatattcttcgcccgtgtagtcctgcataggcaaatctaccggatcggcttgactatccacggattcaaagttatctttatctaacgggttcatgttagcgaagaaatccgtgtaaacggttctgatttcgcctttaacatcagttacaggcgggtacagataaccctgtaattcaaacataaatgaccactcaacatgacggcgttgatttgcatcgccctcgaatgtggtatccggcgcaaccgattggagactgattttgatgtctcggtcaactgtgatatcgttcttatgcagttcggtaatcttacagttgaagtgtggttgaaaatatggcaaaatctgttctgcgatctggaacatatcatcttcatatcgcgtatacacacccagttcgaaaatcagacgatatggcacagggttaaactgtgtgatcgtttttcgtggggttgctaactgtgtcattttttggttgaccgcgatactggttttacggattgcgttatattgcagatccaccagtgataagttcatgcgcggtaaaatcgtttccgttttagcaacgttttcctgactcaacgtgtagttgaatttgttcatggaagcgagaaacttctctttcgatgcataggtgatcggaaccttgatgtatttttcttgatcgccgcgtactcttttaacctgaacatggttaaacaattgtcccataagaacaatgtagttacgcagcgaactattataccagtatccaaaaattttctaatccccctgctggacgcgtccagacttacagttatcaaagtgccagcgcttcgctgtattagcggcgcacattatcccacaatgggggcattgtaccttttctcgttttttgcctttgtgagcagcaacgagacttgctatatgttctggtgatagcttctttcctttatgaacagcaccaattctttttctgaattcgtcggtatggtttttcccgtaaaatgggttgtttttaccgtcatgtttgcctttcatctgttcttttttaacaatgcgcattgcttttcgcgcctttgtcttttcttcaagaatgaactgctgttcttgttcagataacgatgaatagcgtttgtgttcataggtgaacatcatgaagaacgcaagaatcattttaggatcattggtttttgctaatgtcctgtgggccatcaaatgcttcattatatcaagttctactaaattttctggttcgtgttcgaattcaggaaataaagaacgtggtaatatatgatgtttttctgtgtgttcagtttttggagaagcctttatgatatcaacatactcaacgtatagatcatgaggcaaccattctttaagttttgtgtatatcataaaattctctttgaagagggtatagacttccgcctatacccatataacgtatttatggcagacttgcaaacggtgaaccgcgtccgttgacaacatcaaaagattcgatgaattcatcaccttctctttcaaattctttgtcttcttcgtactgttcaatgttgatatcagccagaccgtcaagatttcgaatcggttcgagatccagttctgcatcaggttcgatatggattccttcatttcgctgcaattcaggagccagttcttcacccgtgtaaatgaatttcgcaaggttgattttgcgttgaggacgatcaccgaactgatagaacggatcggcttctacccacgtaatttcaaacaagctattgtccatcgggaaataaaccaaatcccccagaacaggaataccaccatcagtttgatgtgcgaacaaacgagggttaattaccagtgtcatttcatcgtttgaactcaacccaaatttactaaagaaatctcgttgcccttcatagttggcatacgattcaatataagcagcaattttccatgacttcgtaaatttagattctcggtcttctccaagaatcttatcaatattcacaaagtcgcgccggacgtaatacatatcaggcgatttcatctggattgattctgctgtcaatgaatcatgtagctgttgtgtcgggttgtatttgtaccagtttacatacgggttagtgacctgatcctttaagttacgatcaaccccttcccccgtagacaactgagcgaataaactttcatcccagttttgcattattccccctacaccataatgatcggtactgcgtcagacatcgaaattagttcatcgcgcagactttgcagtttggtttccgcttcctggatcagtcgcgtaccatctggagcaacaccaccaggcaattgcatcccctggaacttagccagaatttgtccgttgatctctttcaccagtgcggtagagtagtcttttacccagcggttgttatatgcagacgttccgcccgtaacagttgaaccctgtcccgctcgtacaccgcctacaacgctgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcgcctttgttcacctgcccccatgcgcagaactgaccagtatcatcgttgaaccagtaatcaggcagtggagccagcaggtcttgcattgagcgttgataggacatcatctgggtaaagtatcccatatccgcaccgtatgcgttcataccgtacacgcttgatgcacatcgaccgcccagagaaccaccagtaagccccattaggaaatcggtaaaccacggataaaccgctgtcccgtccattgtggtcaatgaacccatgtttgtgcgcaataccttcgtgatcgcgaagatgtgttctttgctcaagtcgaatacgttgcgcgggttatcatcacccagtgtcaaaatcagatacgttttgtttgtgccgttataatgatattctgcatacaggtctaaagcgcgttgaatgcagtcataaatctgatcttgtgtgatttcgattttgatgattggtgcgcccagacgacgaagaatttcatcctttaactgttctggattgttcgtaatcatatgatcctcaaaaggggcttgcgccccttgttaaaattatgctaccgtcacagtacattcagcagaggtaattttggttgagagtgcatcagtcacttcaactttatatactcccgcttctgctactgtagccaggcttgcgccagtttccccagtaacttcaaccgtatctttaaaccatttgtatgtatatggtgttttgccaccagtaacaacaacggctaaatccatattatcgcctgttgtgtaactcttcgttgccggaagatccgttgtaaacgccagagccggacgagtagttacagtcacagtcgcggttgttgaatcgttggtactgttcatcgcgtcagttacggttacatagtaatcacccgcatctgcgctggttgcagcagacttgacgatagaagaaccagtttgaccagttaatacagatccgtctttatgccatacataggtgtatggagttttaccgccgctaaacacaacttccagattcagaggatcaccatcaacgacagaaacatcactcaagtttgtgtcgaacttaggaatcggatatacggtaatgtcaagttcatcagaagtaatcacggtattttcagcgtcagttacgacaactttatatacagcggaatcacttgtagtgatgttctggatcattacacttggtgaatcagttccgatattttcagtccctttcttccactgatacacgtaaggcagtttaccacccgtaacggtaacagataaagaaatatcatcaccctcgatataatcggtacgaccgacaaggttttgagtaaatgacaatggaattttcttcgcttcgtatttggtatccgcttcaacttccgtaatatacggaaccagagcgtcagcaacatcctggtgagaggctttattctgttccagatcatccagacgttgttcaacattaccgccaccgccagcagcttcgagagcagcaacgcgagtagtcagatcagcgatcagcttatagatacctgtttcagagccagcagttttcacaccgattgctgttttgttgtcgcgagccgttttctgaataccatctttgaggaatggatcagaactggttgcgtcaccataaacagctttacccatcgcgatattagccgcaacaagtccagttgacgtattacccacaattgcggtaacatcaatcagtgcctggtgatcgtctcgctgtgtgttttccacattaagcagacggcctttgatgcttgttggctgggagtcagtaccgatatcggtcataacctgtgccatttcaccgcgcagaccatcatcacttgtttcaccaacgatcatattcagatcgctaatgctacgtttcattgtgctgatatcgtaacggatactacccggaacctgcgagttaccaacagcgctttccagaaggattacgcgaggcagaacaccaacaaccggatcattcatctgggtttgcagagtaacgatgttcgtttctgccgctttcatgcgtgaatcaatactacctgatccgcctgtacccgtgcgcccgatatacgtgttgatgtttgacagttcggtgttaatgccagtgatatcgtcaccgatatggttcaatcgaacataaactgattcaaacgttgctaaatgcttcggccccatttcgttacgcagatccgtaacttcatcagtcaattgacctacatctgagtttacccagtcatcttccagcttagtaatacgtgcttcgtggatggataccgcctgagcgttcgccattaccttgtatttcacgccggagccagtagaggacggatcaacatcaccatcttcgttgaagcctggatacgcccccagttcacctttcaggaaaatgatatcttttcgaatcgtgcgatgtttaggatcggttgttgcatcccatacaccaatttccttttcgatatcctgaattttcagagtgtggcttgctgtagttgcctgtacagaagacatatctactttcagcacgtcaacatcagcgacaactttatccagtttgtcgatcacgctttcatcggagattgtcgcgaggttttcggtaatgaggttaacctgatcgataacttcgttgatttttgatgtctgggtagttgtgtttgcttctaattgtaccgcgttcttttgaaccagaacaccgcatctgtttaaagaaccctcgttagtggttttggttttagcaccatcgagagtttcgccgttaacaatccaattgatctgggtttgtgtggtgtccgtagggacaccatcaacaaacgggatctttggtaacgggttaagttttgaaatcatggattaacccctttatcgtactcgaattacatagttgactgcaacgtttttcattcgcgtttcgtttccgccagttgccatagctttagtgtatgctggattcagttgcataattaactggtcgttcttttctgaatttttcaattcgtatattgcttcggatgacggaagattaccaccattacgatagatcatctgtaactggtgttcgtgggatttaaacatatcatcctggtaagtaccgaaaccacgtccaggatctaatccacgtccagcatcgaaaccgcgagcagcaacaccgcgcatatctgggaggttgaaaatatccccagcaccgccgtatgtatacccgatacgggaaaacagaacagggtatgtgttgcggttcattgcgcgtccgttacagataaaaatatttccatagtcggagttaaatgcagatagcatcatacaaccgatcggaatatttacttcaacgtcgctttgtgtctggtatttattgtcagcaacaatagaaccctgatacagcgcaccgccagtgatagcactgtttctgttgcttggaactacgttagcgccagcagacaacgcggtattcgctaatccggtgttgacatctgttgataatttaaccaaaccaaatgcagagccagaacccttcacagcagcaagtttttgcggagtaattgcttttgtgttatcagtacccgcgtttacttcctcctgtgtagcgatacggagtaagcctaaatcggtttctgttgcagtcagacgaataaacgtgtatggtgaaattgcgaaaccgtcacggatagtacctgcgcggacttcggcaactgttgccaactgtaccaaaccgaaattactttcagttgcgtttgactgtaccggaaccatagcagcaattgcttgcttcactttaagcggagtcattgcggtcgtgtcatcagtaccagacgttgcctgtgcagtggttgacagttttgcagaaccccagacgttttcttttgactgacgggtgttaaacacatagttcaatgaacgcggtgttaatgaaaccagatcgttcgttacggttactgattctgcatcagttgcgtaacgggtgtacccccatacggtttgtgatgcatgagggttttgtagacggtattccagcagagccggagttacgatcgtctgtgtgtctgtacctgcatcaatcatttcctgtgtagcaatagcagcaataccacgcacaccaggcgcggcattaggcaagccaacatcagtacgcgcccatgatccgatagatgcaagcgcttgctgaacattcgtgtacgtgctaggccattgcgtaccagcaggatcaaatgtcacgtaaacggatttatcgcttacgtggttaattgtgttgttcatttattgtccttatgcaatacgcttgaaatagtaaaccgtaacagcaggagtaaccggaagatctgcttggcctaatttcgaccatgtaccataaccagatttagcctgtacgtcgatcgtgcctaccatactgatcccattttcggaagtgttcgttacaggatgcggaaccgcgtcaataaaacgaacttctaggatctccccatttaaaccctttcgagttaccagatcgaaatatttttcatcgttcacaaattcagtaaatttgttataaacggtttcgcatacggttgatgcgttcgttgtgttgtcaaaaacaaacgggaacccgtaaacatgaacagtcgctttcgtctgatctggatctgggttctgaacagtaccatcaaacgtaatgctttcgacctgctgaaccgcagacggtgaattatcttctgccattgttactaccccattaatagggatttgttcagacagagaatataagtcatcaattgctgattgtacgttggggtattctaccccttttcgaagttgatcgacgtttgcgccgccaatggtacgtttaccgccaatcagcggtaatttcgaacccatttcatattgcaaaaaatctgcttcgcgggaagggactttcgccccctcccttgttttggaaataaactgtgtcatttatgctacccttatccagcggtgaacagtaatatacggcgggagcgtttttagtttatctggggtagtgttaccctgatttacttttaatacatcctcacggtatttagtgtaacctggccctgttgcatctggatcaacctgacaaccaccgataataatgatcccgttgtcatccttaatcagcaccttatcggttgaatggatttcaggaacgttaatcggtttaatttcataaccacgttcgccaccagtaccaccagaagtgtgagttggttgacctgaaccatccagatcgttgttgttcaaaccgaaatcactatctgcttcgtcggtagtccatccagcaaggaacattccttccgcataacgtgtccagataccaaagcccatataatcgcctgggttagcatcgttgtgcgcgttttcgtagattgtcccgattgggtgaataacgtcaaagaacgcttgcaaatccagaagacgaccactaaacggttctgcgacttttcgcgcggttttctgagtcgggttgttataatcggtgtattcaatctgattaaccagcgttacttcttcttcgttattcagataaatcttatcggtgtgttctttaataccgcctacaccgtcccattccattacagtgccgatatcattgttgaaccagcgaatagttaccacatcgcgagtttccagaggttgagcaaacttaataccagtaacctcggaatcaacaaaaatcagactgtaatcctgaccagaaggaacccacaaaccggagtttgcaatacagctatcttcgtcataaccttctgcgccctcacaaataaatgtcgggagatccgcatcacctgctttaacaagctgtcgaccgttcagcagcagttcgaacgagttcgggttaaccagaattcgcggactgataccaaattcagcagtggtgaatgtgagtttattcggcagatcgccaacccaaatttcaccagggatacttacctgttcggtgtcacccgtgttatatacgcgcatggtatgcgcttcatacgtcgctcgccatgcggcaataccatccagataggtaacgaattgaagcgtatcaccagcgttacacgggtttttaagacgtatgtttacaccatccagttcgatcagttgtccggcgctcgcaccaggtgaaccgtaatcgctgtttgatgcattaaacccgttcttgtcgtcgatgtacagcaagttaccacgatagtaaacttccagtgcgcggacgttgtaagagttaccagggccaaacacattcaggaagtcagtttgtccctgagtcgcgatataggtttctttcgctacagtagccagatccgaagttgtgattttgtcaacctgtttgttttcaacatattcccaacgaccaggagaacaataaaccagttcgacatccatcaaatctttgtacagttctttgtagttcggtgaacctttgatggtatctccgcttgcagggacgatacggacgttgtttgccgcccacttaccccatacgtcacgtaaacgaataaccttgttataatcgcttacgctgcctttaggaaggtttaccgtaatacggttgttgcttgtgttcagcgcccatgaatcaccaaagataggggatagcgtaggcgcggtatgcgttttccacgcacccgctggatgcgggatactcccatcacccagcttatcatacaattcggtaaagttggcgttagtcttctgaccaccacggcgcagataatcacctgcgccatcgtcaaccacgttaccgataataatttcttgtttcatgctgcgatccctgatttgatggtgtcaaccgctttgatcgagaatttaatacgatcttcggttttcgattgcacgtttgcgtaaacaacatcaccagcgccaacagtaaaattaagcgtatacatttcatcttctgtatttttaagaactgcgtattcggttgaataaacgcccttagccacacgatcgacggcaagcagaatttctgctgttttattgactgtgcctgtcatgttttccgcgtatacgagaagtttagcgccgctaaattcgctatatccaaacataggaatagccgttggtgatgctttcaaaatgagtttggtagtatcaacaggcattgtctttgaaccaaacattgattcaacagaataatcccatgtagaaacagaaccttctttcttcacacaccagattttaatctgagtatatggagaggttatgtaaagctgatcctgaacccctttgataccatcgccaacttgcggacggaatacaacaggacgatcaacagaaatgctaccgttactatttatgaaatagaacccttcaccgggtttacccgatggaagcacgaccgtaatcgggcctgttgaggtatccatatcatgcaatgaacccagttcgatcgggttgcctgaataataggttcgtggtagtttctggaaatatccggtcgcgtggagcagcattgtacccacaccatcattcgcagtcaacaaacgcacatcaccaaacgcgttgtacatgttggtgatgatttcgttaagtttaacaccgccgtcatacagcgggtcaccagttgacgggttgccgatctgccccacgtcaattaattttttaccagtttgatatgccattatggttttccttagaattcgaaaataatactgacttcttcggtctgatcaggagaacgaataatcggttgacggttttccatgtagatcatttgccctgagtcaagttcaagctgttctttcgtgtaatactgccccgttgcttttacttctggatcggtcggttgcgcctttttcagtaacgggtttacaattacactaacctgacggaatccacggttgccaggtaaagatgcttgcgggaagaacagggaatccatgtacgcacggaatcgcattgagtgaaccttcattcggaacaccaaatcatacatatctggataccacttgatcacgttgtcataaccccagcgaaccggatcttcttcgagttcattcgggaacggaacaacgatatgttcgttcgtgcatcggttaataaccacatcaggcgggatcgtgtagagatattcccagatatagccgtcacccatgtcgataccgttcgcttctccgcgtggaggttcgaccgattcgtgggtcggtgtccaaatgccaccaatgcgcacacattcaactttacccgtgatactggagattgagcaagaaccaatatcaggaacgtccacaacgcgatacaccatccatcctttaccgtaatcagtacggttataaggagcggagtttactaccacgatgtcattaatgtaaaagatttttgggttaggatatcgagtatcgccccagtctttacgcggaacgattgcatcaatcatttcgcctggtactttcgtcatcccgatcatatgcgtccacatatcaacgataccatctgtatcatcgttaggataagggggcgcgaattcaggatcggattcgttatccgcccattgttcagtacgcccgatcgacatatagatcgagttatgatcggggtcatccccgatcatttcgcgaaagttcatcatgttttccgtgcggaacttaccagttacaaccgcacggtagatgttttgttgagccattatgctacctttctctgagtcggtggattcggatcgcgaggattacccgcgtcgtctttcaatcgtttttccactaagttacggaactgagagtatttaaccgcagaactatcgaacagaggactttgatcaaatcgacgcgcggaaggtaatacaccattcagcggttgttcttcaacgtcatattctggtggaacatcgaacggttgccccgctttagggtgtggttcgtataatgcttcgcctgttacgaggtcaaatgtctggtttccgttaccgtccagacgggctacacgatcaggccaatacttcggataaccgctatcgaagcgatagtttcgaagaatatcaatgatcgtttcgctatgtgtcatagacaaaccggagttaatgaacaccgttaacatggtgatcccgataaaaccaaagcctaccggatgcacgaatcgtaaaacgtcatccttatatcgtgacgctggcagattcgaacgaattttcatcacatagtatgaacgcccacggttgaaatagtcgatcgagttgttcgccatttgcttaccacgcacaccgcgcagaatagttcccgtgaagttagtcttttcagacttgacaacctgcccttcaaggaagttcccgatcacgttatgcagagtcattgaccagcgtaattgaccgtcatcatactggcgttcgatatacgtcacgtttgctcttgcagttggtgtgtaaatcgtccggcctacgatgtcctgactaatattcgttgactgaaccagaatatcatattccagagtgttcgaactttcgatttctacggttacatcttcgttatacagcaatttgaacaggaatttatagcttgcttcgatgcctttcgttgagtaaaaatcactgcaacgagattcaaagaaacgtaccacttgatcgcgcttcgttttatccaggtagatattacggcggtttacttccgaccacagatattctacgctgttcttctcacgcggatatttgttcctgatcaggttcagcagtttgttatagtaggtgttttcacccagcgaaacgaactgcaaataatattcaccgaacttctcaaaatattgctgatccagatagctttgaggcgcaaagcgcgtaatcatatggcttaaatctgggtcaatcaaaccaggtgacagatccggtgtatacggtttttcgcgttcctgctgaatcagatcggcaatcagcaacgtgttatctggtttccagaaaatagttaagctgtcacgggcgcgataactcaattcaaagaacccaatgatttcgcctgaactcttatacaacaacacaccgttcgtatacttcgtgaatccggtaaacttaatgttgttaatgtaaatcgtaacatgtccgcgatcccatacctctttgttcacacgaagcgatgacgaagggccagcactatcggttacaaggctgtaggtgattttcggatacaccaccagaggacggttatcattagtgatccatgtgcgcacagagtcgcggaagaaccagctatagttcgcctcgttgtagtattcctgcgcaccaaatttccaaacagtcgggtcgtcgatatgagcgcgaatcgtcgcaaagttaatcgcaaggctggcagtatagccaggacgcaaatcatattttacagcaccaaccagtgcagggttctcgatcaataattcaggatcgggaagtgtgcctggatatttgtagttcgctacggaaataaaaatctccgtgccgttcgttgacatattggtgtattcatgctggatataaaaacgttcttcctcggtgttcccatacaggcgcacaaaggttttcgtgttttcttgccattgatacacaccagcagcagcggacggaaccacgttagcgggttttgtaggatcttgcagagcggttttcacttcacccgttacgagtgcatagagaataccatccatcacatccattttcttgacaacgatcttatcatttccagggacaactgtatagctgtcagtatcgaaaatcttttctccgaacgttggagaactcggatcggtgtcgatcggtgtctgtttcagtgcgatacgacgcacaacgtttttagcaaccacatagagccagtcatcggaacatgccattgcttctgcatatttcgatacgttaccaggcagtttagcaaatgtgttgtatgagtccacatcgaaatcaaggccagtctggttccccagtttggcaaacgtaacatcatcagcagagaatcgcacatcgtccgcagaccagcgaatatccgttgaggtgcgcccgtagaagatacgatcgtaacccagtacataggttgtgtttcggctttggtacgcaacagagcgcgatacagggtttcctacgcggtcgttaaacgccttgtagtaatgccatgtttgtcctttgtcgtttgacaccttcgccatgttctgaaaacgttcaaacaggtacaataaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattaaagttaacgtagttctgattattttttgcgaatttctcgtttatgaatgcatcgcttggcgtaaattcacgcatggttgaatatgcgtaagcgttaagggtaaacgtccagagttcatctgtataaacccagtcagacggttcaaagcccttgtgcgtaaccatgacgcggaacttgtaaaaattgttgggctgaacatcggaagaaaaccattcgtttacataagcataacccaactggaaccaggttaaatcttcatctggaatagttacaccacctaccccgcgagtttctgccatttccacgacatagtaaaaatccatgccgacgctatcccacttcaaataaacgaagttagcagccagtttatcaacgcgcaaactggtaattgacggcgctttaatcatatgtttctccaaatttgcgttttacttatatcccatatttagcaaacaaaaaacccctgccaaatgacaggggttgtaaattattgactgattggattcatcgtcaacgttgtatattgaggacgtagatcgttttcaaatacaatcagagaaccatcacgggtgaaaatgttctcttccagaggtgtaccagtcagttcgatgtaagcagcgctgaatcgctcggatggaacgttcaggacaccaagatcgaaactaatgaaatcattaaaatgttccacatagccgacttcgtaatatttatcacgatcggttactccaggatatttatcaaaatcgttttctgtataggctgcgataccgatatcaccgtttttgaatggcccgataaccattttcgcgagtccggtcgtggtgttcatatctgttgacgcatagcgcacatcatacgaatcaccagcagcatttgtgtacttgaacccattcgaaacaacagaacgtgatttcacctggtttaagaagtgaataccagacatcggggcgctgtaatagttatccagttcacgcaatagctgaatagtcgcagaagaaccaatgatcgacacgtccgcgttatcaacataagtcaacatcttggatttactgaaagatttgttgaaaatttcaacgttatctgtgtagtatctgtcaatttcattgattacttgaccacgcaaccattcctcagactcgatcaacttactgatatcatacgttactttaacgctttgtacaatatacaggtagttcgggtcaaggatcgacggcgtaatagtcgccaggttatacttcgccagatagttttgcatgtcctctttttgaacagaggttaagcgcaaccctgatttcggtttaacagcgatgaacgcatagccaggtttttctttatcagtaaagcactgaaccgcctgaataacagaaccgaaacggtgagacaggaacgattcataatccgatgcagtaacacaacggcgctgtgtctcacgcataataggcgcgagttcacgaatacgttcgatatcttccggttcaccaccaccatcagcgcctacatagtccgctgaatcagtcgggttttcaacaatacttgtaatgctgatatttgtcaatgtatccacataaacaaagttttccgcaccattggcttcttcgccattggttgaaatatattcaattacaatagtcgaaccgtttgcaggtttcaagcccccgatgtaatccgcagtcagagcaccacctgcgacctgttggctggtttcaccttcaccaaagtaaacttcggtatgtccatccacagtttcacgcatgtaaaaaattgttgatgcgcctgttgcgtttacgatactttcgtttgtccagtcatcccattgagcaccgttgacagtaacgcgaacctggctacggtcgatgttcggatctcgaaccagaatcgtagaaccatcatagatgacttctgtacggactaaacgcccctgtacgatgttcagcatcgaaacatagttattgtctttgtcacgaacgatcaccacgtcatcagatacgacgaacgggaaactgtttgtttctttcactgtaccgatgaatttcgtgccgcgcggaatacggatcgatgttgggttcagtgggtttttcgcagtgatcaggatcgaagtatttgcagcggtgcgggagtccggcatatagcccaaatcctgagcctgttgaacaacagaactacgcaatgcagcggtacgaataaacgattcgaacagtgcggtgttactcatttgctgaatgtacagtgtacagtatgataacagatccacaagtacgttcatgcgcgagccggagaaatcataatccttgaattcgtcctgacctcggagccagttgattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacaataatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaactggttaatctgagccattacaggcagttttttgagttcagccattgccatgctgtaggtgtctttcatcccattttgcagattagcaatctgtgctttgattccctcatatgcggccttagtcgcattcacagcagcgttagcggcatcaagtgcagcctgataagcagcagtcgttgcttcctttacaggttcccacatccagtttaggtactgatcgaacttacgtttaatcgaatccctttcctgtgtctgtgctttcagggttttgaataattcttgtccctgatcatacagtgcggagatctgcgcataggatgcatcaatgaacgctttcactttcgcttgtgcttgctgatacagatccattgctgtaaaccctgggaagttaccgcccagaatcacatcaagaggtttaatctgtttcatgatgttacggatagccagcaccgcagaccaaagcgggtttggtgtttctggaggcattgaccagatctgcatcatgcgcccgtacaaatctaccaaagcaacgcaaccgttttggaacatagtcaaacaccagtcaaataacgcgctacaagcgtctacaaggtcgcgagcgccagccttgacatattcaacggcgtagttgtaagaactgcctatagccccgtatattgcgtttatgacgctttcatacgtctgtgcgccggaatcaatcagagcttggaaagaatctttcagggattgaaccgaactatcaccaaacaccagatcgtaaatgttgatcgcaacacccatgatcgcaacagtcgggaggaaattcttgatcaaatcccacgccccgcccacgatgttaaacgcagagctaatgatctgtcggaataccttcattgcggtttgccatgcttgctgtgacaatgccagagcacccgctgtgatttcttccatcccgatcgaaagcccgtcaaacatcgtcgcaatgcccttaccgttcttaatcgtacccgtcagcatatcaaaagccagcttgaacgttttacgagtctcgttccacgcagacagcatagcatcactgatattcgtatacgggaaccctacggtcgccggaatacagcccaatccagagcgagcagaaaacaatctggcttcactcggtagcgccccatacgttgacgggagagcaggaggaaccggaggaatgctggtatctgcgttcgtgtttactgacatccctgtatatttgcactggtgcgcgggggattcgtcgtgtttcatgtacgcaatacgattaccattccagtaataatcaatgctggtaaacgcgcctgtagtctgattgtatacctgtcggattcgctgatcgcaacggggaccagaagtcagcaagtaaccaccggagttttccaccttgtacatcgcgagttcgccagggttcttgaacaagtttgcttttgacagatcagccccgtaccagtcattacccgcgagcttagtagccccgatagatgcgatataggcatcaatatccgcttgactggcgaaatagtaaccaatcttcgtaaccagaatgtcagtagaaacccctggggttccgtctggattcgttggtacgtttggagagttcaccaccggaagcggatcgcttttctgcccgaaaggggaactcgtatacaggtgagttccgatcgggatgatttcggtcgcccattctaccccaacagcagggtaattttctgtgtgtccctgccagataacgcgtctgtaatatccagcggggatctcagcatcgcaaggatgctgaaagttttgcataatcccatcaatgatggtttcataatccatgatcatgtttagcctacctgtacagtaccgccagtgatcttagtcagtgcgccggaatcaatgaaagtattattcgatgctcgcatgttgatattacgtgcgccaatatccaaatcttgctcaatatcaatcagagcattttttgcggtaattgttgcatcttctgttacggcaacggttgcattctgtttaacgttagccattaaattctgattcacgtttacggttacatctttttcaacggttaattctgcgttgcctttaatcagccccaaatattcaccttcaacggtttgattcacgttaccgcgcacgaactcggtcacgttaccatcaacggtctgttgaacgttacccatattgtaaatgaacgcatcaccttcgataacaacctgcaaattacccttgacgtttaatttacggccttgcatgacgatttgataatcatcaccaacgattttaacgacacgggttccatcaggacgaatttcttcgtatgatcctgctgggtgaacacggttgtaacgttcaaagcctggggtgtcgtcgaattcctgaatgtgtccagaacgggattcgaataccatgttgtatggatattcagcgttgtatgccgatttaggttcttcaaacattacgcgggtatcaccaggaacaaaaggatcttctggatttgatgcagccaacacaacagcattgtatgcagcactcaatgaacgcccttctggatctggaacctgaacaccgtatgattcgaggttgcccgtcagcacgattttagatacgcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttcgattgccatttgacgaggacggtttaacgtcacgtatacttctcgaacgtttgaagtgttgctgatcccctgccggacttttgccaaatcctgagcaaacagcgttgaaacttcttctgctgtgatcgttccattggttacttctcgaccaactgctttactgatcgcggcattgatcttcgcagtatcacgggttttctccatgataagcaaatgcccgatcccgatagtcggataaccttcactatcaatataccattttgtgcggataccttcatcctgtttaagcatgttttcgatagtgaacccgccagtatcaggacggttatcttctgggatctcgtcaagtgggcgatcatctggattgacagctaacgaactgttagcatcacgaataatcacgctcgaagaaccgcgcccctctgcgccaccacgagccagtacgttgacatcgttacctacataacgaggatactcaccaaacgggtcacagaagcctttctgggtgtccggtttctctcggtactcacccgcaaaggttcccagtataacgccgtcctggtgccatttatcgcgccagtaaccgataacaaaactaccgcgcgtgataccagtcggggaaaaaccaacaccagaaatagcggcgctgcgaatatcctgaataggcatcatccacggcaattcctcaaccggaataccgatagtttcagatttttgtttctgtgccggatgctcaccgaatacacgcacctgaacacgccccaatagacgaggatcatcgacttcttcgaccaccccctcaaagaaaggggagtatttatttccaccgtatttcataggtttgccttttccatttccttgatataatcacttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccggaattcgtagggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaactggtggaaagaatgagaacaacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgatagaaacccgcatgtgaaacgctggaacagtgaagaggttgtgatcccttatttcagcaacgcagacggaaagcgacggcgctacttcatggatttctatgttgaaatggataacggtgtgacctacctttgggaagtcaaaccgatgaaagaaacgttgcccccacctaagccagcgaacaacaacgttcacaacaaaaagaaatttgttgatgcgttgtatacttatgctgtaaacattgacaaatggaaagccgcgaatgcagcagcaaaacaaaagggctgggagttcaagatcatcacagaggacacgttgaaacgtgtgttcggatggaaagggcaataaataccctaaacggagggaattatgagctttatttttgagttcgagatcatcgcagaagaagacaagccaaaaccgccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctacaagcagcagattgatgatgaaatcgaacgccgtacagcagaaaccgaagcccgacgcaaacgtaacgactatcgcaaaaaacacgcggttgatatcgtaaacgatttccgaaacagtttgaagaaaatgactgttggtgtaaccgctgcgaaacgtcagaaggattcgaccgattggtttggtgatttcatcaaaaccagcattaagacgcacagggttgcgaaaccagcaacgggtcgcttgtatacgttcatctacgatgcgaaatacaaagacaccctgccatactgggatcggttcccgctgatcattttcctgggttcaggacgttcgaaagcgggtaacttggttctttacgggctgaacttgcactatgcgccaccgcgagcacgtcaagagtttttagaagaactcctgaaacgtggctacggatcaacagatcgactttctaacaaaaccagactgaaaatcaactggaacaacgtgaagggaatgcgcggggctgatcaaatgatcaaagcctatctgccagcccatctacgttcaccacttgcagagatcgccccaaaagattgggcgaaagcagtttggttgcctacacaggctttccagtccaaaggaaaaccatacagcgcgaagaaagtttggaacagatattaacaaaaaagccccaaccgaaaggaaggggctttatttttacaggatactcacgatttccgcgagtttgccaggggttgcgccaggtcgaaccttcatcgcatctttcaggtttttatcaaccatcttttctgcgtctttttcgttaaacccacgtttcaccaacacagcaataactttttcgcgaatacctttagcggcttcgttcaaatcttctgattcagctagaaccagtttagacagaacatcacctttgtattcctgggtaaagcgtttacccgataccagacgaggcttaccagaggcatctacaaccgtaaacacggcgtattcgcctgtagctttggttttggtacgtccggtatacaacaaacacatatcgttgcatgggagcttgtacacctttcctttcaccagtgcttcatccagaggcagatcaatttcgaaatcttccgccaactgattatacagatccagattttcttcggcttctttgtacagggaagcgcctttgaatttcagcggcttgtcaaatttcaggtcatcagcaggatcaccgctgtagaatgaaacagtgcctttcgcccagtcaatatacgctgcctgggtttttccagtggttttacctttcaggcggacaacacctttaccgaagtaagcgagatcgtgggaatccggcgcataaacatcgtaatcagcaccgtgtgcgaaatgcaggaaaccgatctgaccttttgatggagcaacaccgttgcgatcaacaagttcaacggttttagcaaattttttgttctgaacagattcagaaagtagttctttgaatgatttcatgttttcaatctcttttgaaagtataggtatgatatacctatttattgaatagatcaactaaaaaaattagatcgcgagcgaagcgagttccgtcaagcgaagcgaagacggatagttaacgattgtataaaaagtatacggaaatgtactgttttctctatatataaaatataaatattataaacagtacatcgtacataacactcacttcgttcgtgtgttcgcttcgctcacggtctaacctaaatatctataaaatggagatcatcatgaatacaactgctatgatcctgaaccagatttcacctactaacttcatgttagatattcctgacaatgattatgtaaaagggttgaaactacaagttcagggtgttacactaccttctatcaacattccaattacggatgtcccactgaacccaatgattcgagggaagatccctggatctgcaatggagttcgatccactgactattcgttttgctgttgatgaagaactgcgatcgtatcttggggtttacctttggatgctcggtactgtagatttcaataccttcgagtctgttcgctggagtgaaccacaacaggcaatggccttgcatatcctggataactcgcagtcaaaaactgtagcgacatttcgcttctatggcgcttggccctccaacctcggagagcttgagcttatgtatactaatgattcggatgaagccgtatcctgtatgacgatgttcaactttgcacacatggaaattgaaatcgacggaaaggtgatcgtgccgactccacggaaaacgcaaaaatgatttatggtatttgtggtaaaaagcgaacgggtaaagataccgttgctcaaatggttgtgcataacttccgcaatgttgaagttatcgcgttagccgacgaaatcaaagctatcctgaaacgttctatggaacatcatgataatacgcaattgcgagcgctggcagcgaagaacccattctatgagggtgatcgtgaagccccgctggtgatgtccaataacgatgcatacgcgctgttttctagcggtatcaaaaaattaagttctcgcgggttcttcatgagtaacgcagatgttatcgctcataaaatttgcgaagaaaacagccagccctggacgattcgtcgtttgatgcaggtgttcgggactgatattgtttgtaaaatagatccgtctatctggacttcgattgctattcaaaaaatgttgaaatcctatgcggatcactttatcattaccgatgtgcgtcaaccgcacgaatataaatacctgagcaagttcgggactcgctttgtgttccttgaacgtgaaactggtattgaagataatcattcaacggagcaaggtttgacacctggcttgagtgattatacaatcctaaataatggtacgttagacgatttgaaacgtaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccaaatttgcagtcttctggaaatcgacggttcgcagggtgtatcccctgatgccctggtcggcgcgatcaaagcacttctgccagcaacagcagaaaccgctggcgacgatgaagcgattgatgcatcaaaagcataattaacgcttaggcgtttaaccactggggggcgaaagcccccttttcatttggagtacacatgaaaagttttattgaagtagcgaaacccgtagttgatccggggatctatatgtgtgcgaagttcgatcaggcttcctgtgaagcgctcgcgaaggtgcaaaaacttctgggtgtagagaatcctgtttccgctgcaaagctgcatacaacgattgtgtatagccgtaagacggttgatctgttccctgcatccggtatctctgaacctgcccgactggttgacgtgtagaagtgggaaacgaaatacggtaatacgatcgtgggtgttctggagtctgattatctccatagccgcttcaaagatgcaatggatgctggagcaacatacgattatgacgattacaaaccacatgtaaccctcgcgtatgattcccgcatcgaagatatcagcggagttaaaagactgttgacattgcccgtagatttgactatcatccaggaagatgctgaacctctggatctggataagaaagtcgaagacatcacggagcacatcgaacatcgcggcgataagtgggttatactgaaccatgatcgcacgaaagaacttggtgaatatgattcgaaagaggcagcggaaaaacgtctgcgtcaaatcgaatactttaaacataatgggtgatttatgaacagagcacgattgatgtatgttatcaataacttacgcagagaagttaaccaaaatttcagtaaagcgttaagtgattggtatgtgacaaaggtttcaatgactacagatcacatcgcagaccgattcctggatcgttccgcgtcagtcaaaaaagactttgcggtctacagtgaaattcttaatagtctcgctaaacattattcgtgtaacgttctgcattacgcggtgaaagcgaaaaacgaaggtatgcaggaagttattgcgtatcgccggattaatggcaaagtgtttgcctgtgcgttcaccgtccagatgttcgaaaacatggatgattctgttgctcacgaaaagccagtgattgctgtacgattccgaaccgttatccctgagtacacgttgagcctgaacacgcgaaacgcgatccatgtaaactacatcgcacccaaaatcaagttcgagtatgacggctacagacgcgttatgtcacgcctggatcgcctgattgcttcaaaagattgtccacctcaactgtatatgttgaaaaatatttgaaaaaagcccttgcattcgtgcaggggcttttgttatattaggggtgtcgaaacaaaggaggcaatcatgaaactttactggctggtgttctcaaacgggtttgtaatgaaaggcactgttcactgtgcgaaaacttattgcaaatggaatgaatgctctttccgtatcctgagcgttgcatcttctcaacctgtaggggattactaatgactggtgataagtgggttgataaaactttgttgttgacagtaatctactttctggtaaaatacctggtgtagacaaaggagggagttatgagaaacttactgaatatcgcggaaatcttttgctatggtgtcgctgtgtatgtcctgtttaacggtgacggcgcgggatactggatcatgttcggtggtggcttgttcctctctttcatcaaaaaattttttaagtgagaaatatactatgcgctcaaatgtaccgaaaaacctgtataccgttattgatgctggttcgattcgtattgctgatgtaatggcactagtcgaacgcttcgatcgttcaacgacgctggggcaactgctgagtatggttaaatcccagtacccgcacaaatgcccgaaatgcgagggtaaagggttcgaagttgtgcgtgtcaacacgtatccttctggcttgccggattctggctgggttgatcagatggaagatttcaacgttacctgtgatatctgtaacgggcaaggcttcaccaaagaacgccttatcgcaaaacctgtcaaagtggaatatgtaagagcatgaaaattaccgatctcgtaaaagcggctaatgcgcttgtaacaagcgatcattacgtcgattactgcgagcaataccctgttcccctggaacgcgcaattgctcaatccggttatgatggtgtcagtaccgtaaccgttgaaaacctgaaaacgttcatcgtgtttgctaacacgttctggatgtacttacctgataatatcgggattcgccagcctactttcttcacgctgtgcatgttctgcgaaacttatctccctgaatgcgatgactacgaagaacattatggaaaaagtgaataaagtatccctgatgcagtttgataaaaagctggggtttgcattctctcacggattcgccccagacgcggaaaccatgtttaaaatggcttttggcatcgatccggctaccctcgatcaagaggtgttgtcagacatcaacaaaactggtacgctgtattatgcccgtctgccaaatccagaaaacggcattcagtaccaatcgactctcgaaaaactcaaaactgaactgaaagaaataggtgaattatgacttctacagctattcaacaacaaaccattgatcattatgctgaattcgcacaactgatcaaagagcataacgcttttgcggcttctcgtgtcaacgaagaaagcgaacatacccgccgatctctctgggttagcatttaccgcgaagtgtttagcgagaactccgctaacaaacacacacaggctgttgatgcagcagataaagcgctggcagcatacgatcgtaagttcagggtgcagtaatggaacggtctgctggtattctcttcctgaataacggcagcgttttaatgggccacgcaaccgaaacgcctcattgggacatcccaaaggggcatatcgaaaaaggcgaagaacctattcacgctgcgatccgtgagtgcttcgaagaaaccggagttcttgttgaaccgcacgaactggaaagcctcggaagactggattataccagtaaaaaagagctttacttattcgtgtataaaggcaataattaccccgaagccgataaatgcttctgtgcgtcaacgttcgtgaagaacgggcgaaccatcacagaaatggacggtttcaaatatgttccgtatagccagatccgcgatcatgcgcgtaagactatgggacaccttctatctaaacttgtgggatatacatcatgaaagcaacaacttttcaaatctgtcaaatgatccttctggctaccgcaacccgcgccgctgaacctatcgcgtatcagtcatggggtgattcattcaccgtgaaaaatattcgcgatctgcctggacgcctttacgcttcccctgatttcgaacccgtcgatccgaatgatttgacgctggaagaaatgaaaaatctgggcttccgtaagtggagcgacgattcaaacatgatgctgatccctctgtatctgttgccatacctgaaagacggtttccgcgctatcagtatcagcggtgaagaatttgaattcagcactggtgaatcagataacgatcatcgtatggggctgctgtctttcggggcattgcctaaatgagtcacgttgatttcaacaccttatctcaattggggctgatttggaaaatcaataaagatatcctgcatcccctggggctggcgttgacgcgtgatcctgaaactggcgtatcaatcggtgcgctggtttccgatgatggggtctggtcgttcagcgaaaaatcagactttgaaaatatcgcaaagctgaataaactttatgctttacaggccgaaggaaagctgttagagttcctacaacaaaacgtgaaagagtgatatattatgacttacaaagctggcgatcgtgtagtaaccgttaaggatggtaagtttgccaaagccggaacgcacggaattgtcaataccgaccgtgatggtattctgggtgtggttgtgccggatcatggaaaatcaacattattcgaaacagacaaagtgcgtatcgcaaccgctgctgatcctggttactatggaacccgcgacgagttcgaaagtgaaaaggatcaggagatcgcagaactgaaaaccaaagttcataacgcgcgggtgttggcggtgatttgccttaccgttgcggctatcaatactggtttgttgggttgggtggtgaatcatgtctaaagatgatattccggttcataaccgtatccgcgatcagttaacttttcgcagtcgcgatcacgcgattatggttgggagttatctgcattggtggaagaataaagatctggatctgaatccatcttatcagcgcccctatgtgtggacgcagaaagagcaagatgcgtttctgactaccctgatcagtggtttcccttgcggtatcatcgcgatcgcggttgatagccagttcaacgaaactcactgggtagaagtgatcgacggcaaacaacgcctgacgacgattatcaaagtctacgaaggtgaaattaggattcctatgccggacggttcccgtttgttctgggacgaaatgccacgacacgaacagcgagcctttgaaaacatttcattacctgccctggggctggatgaatgcaccaaaaaggatcgtctggaattcttcatcaaactgaacttcgcgggtgtgcctcaatcacaagagcatatgaaccgcgtccttgaaatgtataaggctgcaaaatgaacaaagacgaagaactgaatgttgattcagtagaaccaaaccagtttatcatcggtaaagaagatcatgaactgttacaagcggttaaaaacttgctgacctatgctcatatccgcgtaccgaatggcgataacgcaaaactggaaatcgcatgtgctggttacggttacaccgctaccgctgataaaatcattagctattcagcatccagaacccgtgaactggttcattaccgcgataaattgagtgaagaaatccatcaaactcaggtaattgtagatcaattgccagaaaaattcgattaaagtgaaaaaagcccttgcagcaatgcaggggctttgttatattacacacatcgaaacgaaacagagaaaggaaaacatcatgaacatgaacaaaaacattgccgctgtagttggttgtgaagtttctaacgcagaacgttatgacaacggtttctctttctgtgttccgactgaactcgatgcgtacaaagccgcttacaaataccgcactatgccgatggtaaacgttacttacgcgccgaacatcgaaatgtggctggttcaggtttacaacaaagtatgaacttccacgaacgcaaggccgcacgaaccgattattacatgcggttcgtgtatggctggaaattacggaaatgtgttgcatgtaacgggtcggggcgatatgatagcgaccgatctccgaaatgcagttcatgtaatggaaccggaaaagaacgctttaaacctgtgaggaatatattatgcaacatgtgaatctcaacccaaaaatggaaaagtatctgaatcgccgtcatgacaaccaggcgcaaagggatcaggaacgcgcaatcaacattgaaacggctaaactccttacccagatgttccgtaagtttcctagcaaattcccatgcaattctatgcattcaagtaactgtatcagcgtagaactggctgataagcgttgtatcagggttaacctggcttacgggttatccgaagacggatataacctggtgatgggctggacatcaatgatcggtaacttcgttgaacagaacaatattgagttcaatatgatgcgctctgatttgttccagtgtccggtcgattcaatcaatatcggtagcctttacgctatccttcgcgcacaatatgatttgtggagtacaaaatgaaagtaacaagtgaaaaacttgaagaaattgaaaaatcagcccgttcgatttcttctatgatgggtagtaagtggactctcgttgaaaatatgagcatccagggaaatcaggaatatggtttcaggggcaaagagtataaacgcgcgttctcatatggtgttccatatggcgacagccctacacagattaaaagctgggaagagggtctcggaaaatatctggaaaccgtagatccgcaaacggttctggatctggttagcgatctgtcactcgcgcttcgagacaagcaaaaagcagaatcagaagccgcgcactggaaagcaaatcacgaatgcgaagtatcccgcgcccgtgtcctcaaagagcgccctgatatgccgctggagcgcgtcaacgcatacaaccgtatggttgagttggagaaagagaacgaagccttaaaacagcgtatagcgagcctggaggatgtcaatcaaacccgcatgatgttgcagatgattcagagtatggtgattgatacccaaaacatgaaccgcgaacaactgcgctactggcaaacccatttccgcaatcctaacgggtggtgatatgttcggacgaaaacgtaaatgcaagcatgttgctaccggatggatgcggggaactccttacgcttggatgcatcattctgtaaccgatgggatcgggcgtatacatggcgatatgtatgcaacatgcgacaagtgcggggagaagtttttgatgtgtaagatacacgttgatcacgcgatccgtgagctggcaaaacatccaatcacccgcgccgaaatccttcgaatcctcgaagaaacaaaatagcactttttgtttaaaaagccccttgcaaccgccaggggcttttgttatattacacacatcgaaacgaaacagacaaaaaggaaatcatcatgaaacttgttcgcgaagcaatcaaactgggtaacgaatacaacggcaaatggtacttcatcatttatgacgacaacgcagaaaaactggaaaaagttgaagatgcgttacgtgcgatggaaactggtgcttctgttggtggtaaagtgatgacctgggaaaactactgcgacggttgcccttgctacaacgatggtttcggttctggtttctgggttgatgttgaagatgttccagcgttcaaagccgcatggaaaatcgctaagaaaatggcataattagcacgaattgctaaaactcgataaccctgaactgttattgtacacacatcgaaacgaaggaggaaatcatggaaatcatctacaaaagcaagaactacaaaaaagaagatgttgctgcggtttacatcaagtaccgtaacgtgaaatgtgagtacagcgggatctggggttacgaaatcgttgttgaagaagtcaacgccgacaacaaaaccatttgtagtttcaccactaataccgatagccctctgttcactactgaacagcttgaacaggcttatgaactgcgcaaccaggcttttaacgcggtacgtatcaaatgagattccgtccttatattgaattccttcgcggtatcagtgagatcctgaaccgcgaaatcaaacccagtccgttagccgttgagctttaccgactggatgcaacccccgaagatgcagcgaaagattacggagaccagttataatgttaacttttgaagagtataaagcacagcgtgatcagttaagcaactggcacagagagatcggcagggagttgagcgcgtaccctaaaaacgaaatgggtatgacgatcgaatcaatccgtaatacgccggaatacaaagcgaaacgtgctttgtgtaataaagttttccaacagcttcgcatccttaacgggaagtacatcaaaacgtacaaaaaagaactggctgacgaacgtaaactgaaacggagtgtaaaatgatgcaacacgaaatcaaaacagagattgacaaacgcaccttcctggaaaagaataaaacggtaacgctgatgcattactccaccaaaaacggttcgagtgagttctggcgcgttaacattgacagcaaaggccagggaacatcaatcccgttcgatagcgaaaaactagctcgcgctgtcttccaatcccatgttaaattttgagaattatattatgaaaactgtcgatatcgttaccagcatcaaagcgccgtccctgttcatctatcaacacggcaatatgcgcttcgctcgctcgaagttctacaactataatttcaacgttgatactggtgaattcgctcgctggggtgcaacatattcccacgatccagaatacgcaccattccccgaaattctcgatatcgagatcactaccaaatgcaacggaccagcgggtaaactctgcgggttctgctacaagtccaataacccgaacgggttcaacatggatcttgccaacttcaaaaaaatcatcgacaaaatgccctggcttactcaatgcgcactcggtgctgatgcacaggggcaaacaaaccccgatatgttcgatatgatggcgtatgcgcgttctaaaggcattgtgccgaaccttaccattgctgacgtatcaaaagacgttgcagcgcgtttagcggcggttgctggggctgttgcggtatcggtttataaacacgctggctttgatgtcgctttcgactcagtagcgaacctgacagaagccggacaacagcaaatcaaccttcacttcatggttagctcgaaaacctatgatgatgcgtttaacgtggttgatgccgtgaagaatgatccgcgcctgaaacaagtcaacgcgatcgtgttcctgggactgaaacaaaaaggacgcggtaagaactgggacaccgttacccgcgaacaatataaaaaacttgttgaatattgcctcgattctggtgtaggatttggattcgatagctgttcagcccccgctttcgttgaagcgatggagggacacccgaacttcgaacagtacaagcaatacgccgaagactgtgaagcgacgatgtttagctcttacatcaacgaacgtggtcagttcttcccttgctcgtttaccgaacgctgggttgaaggtggctgggaagaaggtctggatgttctggaagccgaagattttgtgaaggatatctgggaacacccgaaaacaaaacagttccgtaaagaactgacgggcaacaaggatcataacggttgccgtaactgtccggcttatgcggtatgtggtaaagatatgcgcgtacacaaagcccctgaaaccgatgtatatgcagtggagttgaaataatgttaatcgtatctcgtattaaatcatacgttcgtgatcgtgatattctggacgtgtcgcctttggttggtgaaactgttaccgtaagaaactatccggtgaatctggatcacgtaacctggatcgaagatgatgcaacaatcgttgttgaagggaagagacacccagcaatcacttttcacctgatctgttcaaccccgattacctgggctggatatgaaaacaaagaacagcgtgataacgctatccatgcgattgagcgtagaatgcagtttgcggagatcacattctgatgatttatcaatcccataatgattcaacgatgcgaatggttccggtaacggttgacattccagtaaaaccgcgtacactggaatcgttgattgaaaaatactctggaatggttatttgtccttctaccgcacaggtggcaatggcagaacgcgatgaaattgtatttgaatgtgatacgaaaggatatcataccgttgaagatatgcagatgattgaatatctctgggaaatccgaaacgctgtagtacatcacatactgaccgctgaaaagaaagccgaagccgtgagagaagttgaacagcgcgaagagatccgctataatcggatgtctgcacaggaaaaggatgaagcatatgaagtgtaccgccgtagttgatgaattaatgagcgcgtttaaaacgcgccgtacagatgggcgtattaaagatccgaagtcaatcgcgatcatcgaacggtacgcgatgaagttaagcgaacaggaattcacgccaaaggctctcaatagcctgatggttctgaaactgctgatcgcttcgggtgatgatatgccgcacgatgaaaacagtgctgaatcattccaaaaggcttatcgttcatggggagtgatttactcccgctcgctgggttcgtatgactccgttatgtggaacctgatgcacctggatcgcctgatctgggaagtgctcgaagaagagggtattgtatgaaaattcgggtagttgaagttcatacgcctggatgggttcctgaaagaacatacaagttagagaaacgagtatttggatttttatgggttccattgacttttaaatctggtattcatactatccaatacgatggaagaaccccagaagaagcgctggaattattcagactaagaacggaaaaacatttaaccgttgttaaggaaattgattatgaaactcgatcgtgaattaagcatggctatccgcactattgaaatgatgcttgataaactgagcgcaaaagaagagttttgtgtaagtgatatcgaagcggatttagttgaatggcgcggtgcgctttacgaagcgacaaagggcaatgatcccctgttcgatgaatatgacgtgtataacgtcaaggtctggaacactgaataccgtttcaagtggcctggtgacgcttacgggcatattcaaaccatttacgtaactggtggtatggtgtttgcaaccagtgttggggctagtgaacttccgatcaatcccaatagtaaagtaacgacaccgaacccattagggcatactaccgtttgtttgggtgtggcggaggatttctccccgaactattcaggctggatcgaagccagcaaaactaaccttaaaagagtataaattatgtggaaaattgttgcgtgtatttttatggttgtcgttgttgtgttcttacagtcaagctgtactgacgagaaagaagcacagcgtatcctggaagcacagggttatacgaacatccagttcacgggttacaagtggtttgcatgttctgaaaaagacacctactcaaccggattcgaagcaactggtgtgaacggcaagcagatcaaaggatctgtgtgctctggaatgtttttcaaaaatagcacaattcgtttcgaataactgttgacactaatccccattgtgataatatctctctcgtagacaacgaaacagataaacaaggggattaaaatgaacttactgaacgaaatgctggaaatggttgaagcgaacaaagaagcaatgaaagcgaaagaaggttgggtagttgttactgactgcttcaaaccgcaaagctggcttcctgtgttcctcaataaagatggtaacgaagaacacggcttctatgatgctgcaatcttcgaaaccgctgaacaggcttgcgatttctggtcttacctgagcggtgacaagcctttcaccaaatacggtgtttgtcagtgcaaagacatttaatcccagccccgaaaggggcttttttgtaggtgaaatatgaccaaagcagaaagaattatcaaccatcttcaaaccggattcccgtaccagggagatttacagcgcgatatcatcgaactgttatcccagcatgacgggatggaagcggagataaaggaattgacacaccctgacgtgaacgtattcgcttcactgatggatgatgtgatcgctatcgactcggacgaactgatctgcatcgagacaacgaacccagaagataagacgatcctgaaacaagcgtatgaacggatcgaagcattacacgatcgcctgttcacgttaactttcccaaataaaaacgatagaccttgttgacatcaaaccagattatgataatctgtatatgaaaactaattgtgaggaatatattatgaacgcttttgaaaaacgtgctgtcctgaaagatatcaaacctggcgcaatcctgtacgaagtaatcagtatcactggtgaaaaggcacagatgggtcgaaaacatatcatcactggcttcccgcgtgaacatcgtgggctggggctgtttgttaacggaatcactgtgtatgatgattgggaaaataaaggtcaattctctctggatgatcgtaacgtaactgggcgcaaccattataatttccatgcgttgttccgtagcgaagcagatgcgcaagcatatattgaacaaatcaataatgataaacttcctcctgatgacaaacaggaaagtgttgaaatgacgattcgctggaaacgcgatcgcgcggaagatgcaatttggggttacatgtaaaacgttgcgcctcttaaaccgtaaataccctgtgtagcccatagggtattttcataaagaggtatgtatgtttaaatttagtcagaaaagcctgaacaacctgcaaggcgtgaagccggaactggttaaggtggtaaaacgtgctctggaactctcacctgttgattttggtgtacgcgaaggtctgcgcaccgtagagcaacagcgcgaaaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctgatgaacagggcgtaaaactgcgttacggtatcaactggaagaacgatccaaaccttccgattgaaacgaaatttatcgacgcaccacacgttgaacttgcataaggcgacaacatgatttcacaattctatgttgacgctgtaaagcagtcacgtaacctgcaccttgcgcgaatcgttgatgggcgttgggggcaagaatgcggcggtgtgtctatcttcgaaactgcgctggatatgggccggatgtcgggtaaaaccaaagcggctttcgatatcatcaagcagtcgaaagggacactgaatatctacgttgcgccgacaaagcaaatgggtatttgtgctgcggcagaacatggaatggataagggcgctgattcgtctttcattctgtcgaaacgtcaagatctgaataccattttccgtggacaaacgatcaagtatcaggcaatcaacctgattttcgatgaatgcgacatgacgatcgacgaacggtttgaactggcaaaaacactgaccttgtgtatgcgttcaagtcatcttcacccgttcccatatatccatattatccgtttgggtatgtaatgaaaagtcatggttattcatcaagaaccatacaggaagagattcaatcccttgaatctcttctgagttatgtagatgttgatacatctacgggaaaagtgtattggaaaattcagcgcggccctatgtctcctggaagtgaagccggaagcaagaacgagtattcccaaattcattttaaaggttctatgtatttgcgacaccgaatagtgttttacgttgagaatggttatcttcctcctatcgtagatcatgtgtatggtgttgaaaatggagatacagcaagaaatctacagaaagcgacgaaccaacaaaacgcgatgaaaaagaaatgtaattcaaacagcagtacggggttgaaaggtgtttcttatcacaaagcaaatgggaagtataaagcgcagataaacatagatggaaaaagaaaatttttggggtattataccactccagaagaagcaaaagccgtttatgaccggaaagcgaaagaggttttcggcacattttttaacgaaaccacataaggttaatgtatgtcaaaatacgtattagacaccaatgttttgattagtaacccatattcaatctattcttacatcgaacctgacagcgaaatcattatcaccgctgcaacgatggaagaactggatcacctgaaaagcaaagagcgaaccgctcatgaagcacgactggcgatccggcttttgtccaaagcaatcctgggacaaaattatgaagcaattacccaaacaggggtttcgttaaacttatcgaacccagcagtaccggaaagcgtaacactgaaaatcgtcgattatgacggcaccgaagaattccctctggataaacaggatgcgcggatcattgcaacttgtattcagcagggcgcaactctggtgactcgtgacattaacatgctgttgatcgcgatgtctaaaggttgttcggttcttcaatacactggcgatgactcgctgaaagatagtgatgtgttgtattcaggttatatcgacctgcctctgttctgggaaactgttgaagtcctggagtatgtcgggcctgttgccgttataacgtattcatcgcttcctgacgcggatttctaccctaaccaatacattctatcgtgtggtgagattgtagggcgtgtggtgaatgctggagagtttcagcttgaagtgttgcctattaagcacgaacaggcgttaaagcgtaagctgatgaaaacaatccagcctcgcgatgctctgcaagcgtcattcgttgatgctattctggacaaaaacaatgacgttgtgaccatcatgggcgcggcgggttcaggtaaaaccatgctggctgttgctggtgcaatgcacatggtaaacgcgggacacttcgcaaacctgatgtatgtcaaggcagatagccctctgtcgggcgaaatcgggttcttacctggtactcttggcgaaaaactgcgtcctgctgtagaaccatgtattacgagcctgaacattctgtttaaggatcaaccggaagttgacaaatatgtagaagggctgctggagaaaaacgttgtccagttccctagcctgtattacttccgtgggcgctcaatcgggcatcctgatccgggtaaaggttctgttctgattgttgatgaatgtcaaaacttgagcaatcacgaaataaaatccattatttcccgttgcggtgagaacacccttctgatactatgcgggaacattaaacagattgacaacccgcgcaacactgctgttaacaacggctttgtgtatgcggttgaaaaacttaaagagtacggtcattcaagtcatgtgatcctggataccgtatatcgtgggcgacttgcagcttttgttgaagacaatttttgatcaagggggcttcggcccctttttcgtgaggtatacatgatcaacgttattatcagtccaaagctaattaccgtttgcgctaattgcaaaagtgggttagagtatgaactgtctgatgtacagaagaaaaacgaagtgttctacaacggtttcttccgtgctgctgattacatcgtgaaaaaacatatcgtctgcccgaaatgcggtagcgaagtgaaactattcttgtgaggttattatggttcaagttgtaagcattaccccaaaacaaactgcctgtcgttgtggtgctgttctgtcatacactgcgcaggatgtcaaagaaaaggtatcaactgattacactggcggtcgtgatgtgtatcgtgtgattcggtgtccggtctgtgataaggatgtagtagtatgaaacgtgaagaacgttatgtcgtgatgaaacatgcggatattgattccgcgttaagtgatagcgataaactgcttctctctgcggtgctaagtaaagttgagcgctaccgaaaagagcaacacaaagaacccctggaagcggttgttgtcgagcatgattggcctgaatatgaacaggtctggaagatgatcgaaacccgtgttgatcgcgaagaaaataatcgtaagtttgaaacgatgctggacaataaagaacgtctgggctatttctttgtggttgagactcaccaggggaaattcctgatcaccagcaacgcgcacagcgcaaaccgtttgaaagaatacacagggtacgaatatcgcgccatgttcagccctgattgtgggttcaacaacagcgaaatctttacgactagctggagcgttcactttaaacatgtggttcgggtatcgtttgatgaaatcatagcgctgtacgatccgattgcgtcaatttcaaactataacattgctgaattcatcgagaaaaagctgaccgaagcaaaacagcgtaaaatcgttgcataaataataagacgagggtatcatagccctctcttgttacaaataggtattacaatgaagaaaattatctttgctgccagcattttcttatgctctttttctggcaacgcggcgactgatccgttaggagagtttatccaaacactcccttctgtgaagtcaactttaccgctacaacaagcaacagtaatgaagaaagcgccagccaatgcccccagctatgttaaggaattggatgatattacaccaaagcagaaaaaggttttggagtacgctttcaggatcggtaacgaatacgatctcaaaactgcaaagccagttgaatcggaaacatcgaaacgtttgggatatcatttagcggctattgcctggatcgagtctcgcgcatgtgagaacgtagggaaaggcaaaaagaatcatcatgcttatggttgttttcaagtaacagcccgtagcgcgtccgcacgaatggataaatcatattccaaacgcgtagtaatcaataagctcgaaacccttcggggtggttccaagtacgcacttcacgaactggaatactggcttgattaccacaaaggcgacttgaaaaaggcgctggcgagttacaacgcggggttcaagtattcaaagaaagaagcccgtgattatgctcgcatggttaaccataccgcgaagctgttagaagaaaaacgcattatctgataaaaagcccttgcattttcgcaggggctttttattatgtgtgtaccaactattgaggattaaattatgagcacatcacatcgagttatcaccagtcatccgattatcatcaagccgaacatgctgcacatcattcagggtgtgttagatgaactgaacaaagatccaaaggttaaagtggaaaccatcacggtcgatcgtcatcgtatggaatcgttcagtatctacttcgcatacggagaagaaaaacgcaaactgtttatctgcgaaagtcaagatacgtatcttgatgttggcaacagcacaattcatagcggcggtgtttacttcaacctgaacgtgtggggcagcaacaaagagatcatggatatcgtgaaagttggtattcgtaagcacgtcccgaatgacgttagcatttacgaatgtgttaatgatgcaattgaagatcgctttgtgcgcgtaggggcttaacatggaaactaaactgacaccggaacagcagttagcgatcgttgatgaacgtatcgacgagatcagggcggtaatgaaaccttaccaggaaaagctgaataaacttctgaacgctcgcaaagacatcaaagaagagatcgatcacaaaaccgcttcccgcgtccgtgctatgactccgaagaaacgcatggagttttacatcaattcaccgaacagcggacgagagattttccatgatgcgactaagttcttccaggatatgggtttggggattgatggatataacccagaaaccaatcagcatattcttcgtatcgcgatgaatgaggatcgcagtaacctcgaaacagtcctgaaatcgcttcaacgcgtgaagccatatgtgaagccgatcggtggcaaattgctgttcgatatcttcgaacatacatgttcacagttcaatatgtactggttagcctttgacgttgcagaagaacgctggatgtgcttcacggattggagtctgaaacgcaatcaaaagccagaatttgaaagcgatagtttgcgatcagtgcttgcttatgtctgcgaaacccattattatacccctatcgaaaacgattcatactaaggtaaaacgatgaaaaaacttgcgctgttactcactctgtttgctggctttgctcatgctgatgatcgactggctgaactctgcaataatcgtgacattaaagacgttgcggtatgtgaacaggtaatcgctgaacaactggacgcggcttatgtatggggcgaagaaaatgcgcacctcttcaagcgtcagaagctggttaaacagcgtgagtttttgcagtctgaaccgatgatgaacctctgcaccaaagcgccaaataaggaacgttgtgaaaaactccgtacttacctggttgaagaatataacgctggtataggattatactgatgttgggattagtgatcttttatgggtgtgtgattgctgctgcaatcattatctggtattacgttaaaaagccaaacgaaagctcgttccctgtatatgatgacgagttggaagcgtggcaaagatgggatgaccaatttaaatgaacacaggttatatcttaatgtgtgttattgttgtgatcgcggggctggctgtgctggcttaccgccactatacaggtgatgaaaatgattattaaagaaatcaaagggaacgctgtagagttgttcctgaaacgaaaagtacacttgattcatgggtgtaactgtta

SEQ ID NO: 39 - DNA, 178849 bp, Unknown
  source: /note="Description of Unknown: M16-6c Bacteriophage Sequence"
cccgccatataaaattttaatctgcttactgggatcaccggacggataacgtcgcgatagccgaaatgcgcactacgcaccactatagagagcatacgcaaacggttgatacatccggtatacgaacgaccagtagcgcgggagaagtcctccagcgtaacacctggggcaatagcacctatcagatcaagataatccttttcaacccagaaccgcccgacagaacatttcgatacaccctcagccatttttgcgtttgggtgtttctcgtcttcgcgcttcttcttgtcctcaaggaacttattgaaccggatttcttcgagtcggttttcccgttctacccgcgcacgtacacgggaggggaacagagtatcaaggattttcccgatcatatcgttggctttccgtttggtagtttcagatcgaaaggaacattcacaggccggacggtttctaattggagatattgttccatccccacacgcttaccacctactttgttataacggatgttctttccgtcatagcctacagcctgtgaaatgtagtagtgtttagtttcgcgtaaacactccatccattcttgtgttccggttttgttgcgtacccgcgcctttaatggaaacatcattcaccccgtagaactttcagttcaccagacaaacgctgtagattggcggttgcagtatcgtaacgtttttcggtctctttcagggtagtttcccgcgccttacgcaagaatttttccagatcacctggtttcgtcaccagcttaccatctacgtaaattcgtcccagcaggtgagaacaatccagcagttgttgcgcgtcggctttttcaacagcaggtttaatcgcgacaaactttttaaagaatccgcgatcctcgttatcaaacagatatgaatcttcggaataccatgttgtgccattggcatcaacgatcccactaacacctttccggttgcagtgcgttaccttgataggaaacacgacagatgatagttgattaggcgacagaggactaccacgcaaagctaaattgcggtacacagtcccaaaactttcttcgtcacgaaattcaaaatagtcttttgtccagtacatcattttcaatacctcatagtttcggtatgtgcaatataacaaaagcccctcactttcgcaaggggctttttgattaattttgatgcttagttcggtgcatcatttctttgttcttaccttcgttgaaaccacgaacagcaggagcacccagataaccgcatgtacggcgcgtgacgctcattttagccggatcgtgattaccgcagtgcttacagtggaaaccttcttctgtaggcgtgaactcgtcatcagagccacatacaaagcacttatcgaccggaaggttagttccgaagtaatccagtttatccatcgcataatcccagactttttccagggcttgcaggttgtttttcatatcagggaattcaacataactgatatgaccagcagtagcgatgtaatgataatcggcttcatagtcgattttctcgaacggtgttaccttgcggtcaacgtccagatggaaactgtttgtgtaccagcctttatccgtgatccctttgatgcttccgaacttctcaaagtccagtttacagaagcgatgacagagagattccgctggggttgaatacaggctgaatccgaaaccagttttcttcttccatgcttcggttgcagcgcggagatattcaatgatcaatcggcctaatttctgggagccgatacgatcaaatgggtgttggcctgagccaaacatcaacagcgtttcgtgcagtccaatataacccagactgatagaactacgcccatttttgaacagttccagaatttcatcatcaggattcagacggacaccaaatgcaccttctgtgtacaggataggcgcaacgctggctttaacaccacgtagactatcaattcgagtcatcagggcttcaaagcacaaacccagacgatcatcaagaatacgccaaaaagcctcgtgtgcgtcgtctgcttcctgtgcttcaagagcaatacgcgggaggttgattgtcaccacacccaggttattacgtccatcaagaatttcattaccgttatcatcatgccacacgctaaggaaactgcgacaacccataggagatacaggaacgctagaaccagtaatagcacggttgttagctgaactaatgatatctgggtacatgcgtttagaagcacattccagggcaagttgtttgatgtcatagttgcgatcctctggatcaaggttgattcctttttccatgaacataaccagtttcgggaataccggagtgataccctctttacccaggccgcgaatacggtttttcagaatcgctttctggatcatgcgttcacatcgggattgaccagtaccgaacgtaattgtaacaaacggggtttgaccgttcgcagtatgcagggtgtttacttcgtattcatatgactgaaacgcgtcgaaaacatccttttcagttttatctattgcatactgaacatcacgagggatttgatactttttggcatctttaaagtgcttatcatatgtcatttgaacatatggagccagcactttatcaacgttagcaaaggttgtcccgccgtactggtgagaggcaatctgtgcggtgatctgtgccataagagcagtcgcaacaccgattgatttcgggggttcgatgtctgcgttacccatcttgaagccattagccagcatacctttcaaatccaccagacagcagtttgtgtatggcgtgaacgggctgtaatccagatcatgataatggatgtcaccggaatcatgcgcttctacgatgtgtttcggaaggatatgattacgggcgaaatgcttcgctacgataccagccagcagatcgcgctgtgtcgggaatacccttgcgtctttgttcgcgttctcgttggtgatctctttgttggacagattcaccataccggagatatctttgaacagcttacttttctgttcacgggcaatatcgcgatcgtggcgatattcgatgtatgcacgggcgaccgctgggttcgttttcatcagggattcttcaacgagttcctggatacgggcgatcttcattgaactaaaatcacggatctgattgtactgaaccagcatgattgcggcatcagcatccgtcatagtcccgccagctttatacacagcattgcgaattttttcttgatcgaaatcgacggttttgccgtcgcgtttttctactttcatttcgttgccttatggataatatctaaattgtgtccaatatcgttaagatatttgatcagttcaaccccgtcaacaggtatatcccgtcctacaatctcaaggagttcccacatatcaataacggtgataggagaaaaattagtcaatgtgcgaccgcgatcatcaaacatcgttcggtctttcggtttgacataacacaaatcagagtcaccccttccaagcatccaatcatgtagagatatgatctttttgtcagtggaggatatcaacatcatcagctttttcttctgttgcgttgataatcgagcgtttagatatttcatttcgttgccttcattaattgctttctatatttcgcggttaaggctttgcgttcgtctttgtcggcgtactcgaagcccatagaaaccatttcggcaatcatatcaggtttggtaagtcttgaaaaccattttaccttatctggtatgaatttgtcatgaatacggttttcggaatagtcttgtttcagatatgcaagcaagttctctaaccactggatgtaatcgacatcacgggacacaagaccggatctgttgaatttgtgcttcacaataccttctgtaccgttacacaggttacacaggaggccgcgcacacgtccggcgttttcgccgtctaaagcatggtcatggtcaaggtgatgtttctcgatctctccctcaagaggacgtttacatatagcacaatgcccaccttgtttttcaaagagggcttgcttgatagttgggtagtcttttttggtaattcgtttcgtcagcataataacaccattcagtaaggtgtcattatttattacagggtgcggacgtactcacgaagttggtcgaatccgcctacgtgtttcccgtcatggaaaatctgaggcatggtcatccggcgcgtaccaaccagggattcgagttcatcgatcaccgcttcgttcagtacaggtttaccgtcttccacggaatccgcaacagacacgaactcatacggatgttttttcgcgtccagcaagcgctttgagttcaggcacggagcgcagttatacacagaagggatatagccataaattttaaacatgttaacctacattaaatcgttcagtgttaaagggaatgtatttacgtcgcgtttctgatagttgcacacgtagacttcttgtgttttgttttgctcgtaagagtcggtatgctggcctaacagatactttttatccagattatgaacgcggtatttctgcatccattcaatcaggatatcattttgttttccggcatggtgagtcacgttggacagtccgaacatgattccttcgctgtgtagttcatccaggaaagcatataactcgcgttcgcgatcttcgttccagaacttgttatacactgcatcggtgatcaggtacggcggatcacagtacacgaaatcattttcacagatatcaatgtcacggaatgaaccactggaaaactcaatacctttcacattctttttgaaatgttcaaagcgttttactgttgcatcgttgagcgtccggcatccgaaattagcgttaaagtcgcctttgtcgtttgtccggttaacgttgctgaatgaatgcaggatcaggacatagagccataacggatctttgttctggttgtattcatcacggaatttcaaatactcttctttcttgtctttccccaacccctttgatgcaatcaattctcgcaccggagacaggtcaggaagcgttttaagacgctcatacatatcaataagcgtcttatcgtaatcgttgcttagaacgggtttagggacgtttaacgacacactaaggccaccgcaaaaacaatcaatgaaacgcatgtatgaacttctttcggggaacagcttgaagagttcaggcaatagcgattgcttgttacctgtatacgggataacacccaaataactcatagaaaagattccagattgttaacgtatggctgaacacgaagaatagaatcgtgataataattctccatcagttcgaagcctttgaaccgtctgttggttagtatcgacattttcataactgtaccagaaccagagaaaatatcaagaaccaagtccccttcaaccgtccacgttttaatgtgatcttctgccagttgttcaggaaatattgctgggtgtttgaatgcaatctcgtccttcgttgagtgattgcgccctacagcgtaataccagatattacccttaattttatccttgccaacaggtttacgtttcttaccggaacgggctgaacggttcttttcgttggtttcggaaaagtagctgttttgtcgtgcggtttccttttcagggaacttacacggaatgcggatcgggttgaatgtttttggtgcgccttttgtccacacgaacatgtattcaaagtcctgttcgtatcggttatggttcttcggtagagcggttttgtgatagatcatcgtatcatgcaaccgaaaaccttgttcgatcgcgtacaaggcttgacggaaagatgtacccgtttcactaccgttgatagtcgcgtcacccacaacccacacaaccacaccaccaggcgcggtaacgcggtacagttccgatatcaactctttccatacgtgttcaccccagacatcaccagagccgttataatggcgcaagttgtcatacggaggcgaagttatggtcaagtcaacagaaccagattcaagctgtttaatcagctttacggagtcgcctaaatggaggtcaaccccttctttgattgtggtaatcataattcaccaagtcctttctcaaataaggcgatcgtttcgtacttatacccacgattcaccacgaagcaataattttcacctaatttctcaagcattgcaatagcacggtgttcatcttttttatctttcaacagataagcaattcgaacaacctcttttagtgtcgcgttgtccacctgttccaacttgaacccgtagcccaccaacttacaaaaaagccccttgcgagcgacaaggggctgattgttgtagaagactaccgatccgttatcgttggcgcggatattaaatccttgctcgctcacggataacccctactgtatcggaggtgtttaatacaccgttgtcgtaatacgtaatcatcgcatcacgccacccgtcaggaatctcagtttccagagtatcgattgttttgaattccacaccgttagtgatggtcatcagcaaacctttcttactctgtttccattcggaacctttcgggcatttgtaaacgcctttccacacaccattcacgcggatagcgcacagtttttcagcatacttttgagtgtcgcgggtaacttcttgcagcaaaccgccgcccataccgaacgcgatgttctcactcgcccacttgttcgcttccatccaacttaacacacggttgattgtttcaggtccgtggatctcgtcgccctggatgattcgaactgaattatgcagaactttgtaacctttgctgtttacggtgtaaccgaagatttcgcccagtttacgcatggtgtacatgatgttatcaatcatatcaccggaatcaggacgaacaaccagagtaccacccgcagcaatgatttgctctttatattcagcgatgcgatctacagcgcctttgtagtcccaggaatcgtacacacaagcgtagaaccctgtaccgaacatttcgatgctgtttttgtatgcttcgtcttcattctctttaccgtaggaaatcgtagtcgaatgttcgcgagccggaattgaaacaccgattgcttcgacgttttcaacttcatcaaacagagtttgatagtccgcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcaccagtcaggtcagaagtcatatcaaggtaatgagccagaacctttttacactcacgcgatagcgttgctacagatgacggataccagataccgcgaatcgtcattgtctccagccacccagccaaccatgagaattcacgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcagcaagaacccgcgcaacgaagttaacgccagcggttactacttcatcaaacttaccaccgcgagattcaatatagaacatcgctgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactctttgcacgtaggacaggtgatcatggttcctactttagcggcttttgcaacatcgtacaattgtttgatgtccttctgccgctcggacgtaatgacacgcccgtttacttctttgacaaccgtttcagttcgaatcgaaccatcggaatatttaacaggagttttgacttgcttcggcgcatttgcttgttgcaaaagccttagagtttctcgacgtaaattatgaccacaaaaatcatcgtcgtcatcgtcatagccaccccagctatcaatatattctgcttcactcatgttcgatccttagttgctggtcagtaagaagacccggttgtcgctatagtcgatgtagcaatcccaccaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttgggttagtgtcttgtctacgggagctatattaccacactcataactcccgtcaacaagtttttcgaattattttcaccaggtgatgtaataagtcagatcgctatatccgtcacgcttaggatcgctaaagttggtaatacgacgcgaacccgcgaaggtattgagtaacgcagcttgtcggttgcgctgggtatcgaaagtaaacccttcttccgccagccattcacccagatccgcatatgctttttcggtacattcctgatccataaccttaccgataaaacgtttcatatcaaaggtatatgcttgtttagtcggatatttcaggacatactcggaaatgtctttacgggatgcttcgaccattttcgcgttgatttcatcaaccagtttacgcgcacgttccgccagtgtcgggctacgtccacagcggggatcatcttgtgtttcgcgtttgacccacgatgtcccgcttcccgcctgtgcgttcacaccgattccattgatttctaccattatgttttgccttttttaatgcctcttcaacagagaggcgttcgtaattacgtgattgttcgggagttatcaccagagaaaatccagagtaggaggtttagtgttaatccctaaagtatcgcagacttcatccagaacgttttgattccaaaggttgaacgttggaactttatacaatctggcaagccttgcagcgatcgcagtaccacctttaacacaaaaatctttctctaccgcccagaatagaacaaaatctgtaggtttgtccaggttttcggttaatacctgcattgaattgcgagcgtatcggcgttgtgtccattcgctttggttgtcgaagtgtccagctacctttctcgcttcgtcagcggctttgtacgtgtcgtattctgtatagtcgatgatatccttaccattagaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatgctcgcgatacgttcagggggttcacggctaccgatcagggtagccgtttttgcgttttcgagaacagttttaaaattcattgttcaggattgcgccccagttctcacgaaccagatttgacgcttcgttagtgaaggttttcttcgccagcgttggattttcgaactgttccaggaaaggcccgtagttacgttcgatttcttctagcgcgtcctgtaccgtaagccccatcacgcgaccgaaatctttagcggtgagattcgcgctgtcaattttggacagaacgtttttcacacggttttcagtcaggtagcaggtgaattcgttcagcttcactttgtctgtttctgacagttcagaaggagcattgaagcggttcgcttgcttgttcttcttctctgtgaacttcgtcgttttgcatttgattgcaacgcgttcaccgttcggcatgaaagcgggttgaacaggcttcatcacgaaaccttctgcgatgttctcaccttcaccatctttcagcgtcatgaagtttttgaactcaggttcaacaccgttctttgcagggatcgcaccggagttcgccaggttaaccaccgaatcaaaggtgataggcagtgtgcggatctcgtcaaacgtaccgtatgccagcagtggagccattttcaggtcaacagcaacagcgtaatttgcaacaacgttatcagggaggaattcgccattaacacggatatcaaatacgtagaaatctttttcgccgtagtcaacatctttctggacaccacgccccgcgaattcgccgtatacctgaatcaccagttcatcgctatacacgccacttaactgacgggcagcagagagcatttcccacatcttacgaacaggttcagagtattttgcaactactggttcacaaccgtagaattgttcagcagggaggatttcaccgctacgttttgccggaatgactttgataccgtccgaagtaatcaggctaaagttagccccgtggatcttttcacgcgcaacccacacgccaccagtcaaaccattcatgatcacaccattgatgaatttaccttcataatggttagtcagagaagaatatttcacaaacataattaacccttgattttcagttgtttttcaatttgatacgcagctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaacggtctgccggagtaagaacatacgggttcactcattagcttcgcccagtcgcttaacgtcagagcaaattgaaggttgcggttacgcgcatcatcgtttttactgttgtatgaacgagcgacacgcagatcgaattcaatttgctttgcacggcggcggtgttctaactcagcaggatcgagtgataccatagtttgaactttttccggttctactggctttggttttgcttcaaccttcaccaaatcctttttgatagtcgaagttatcacgcccgaccagcgattcatcattgaagacatataaaccccttacgccaaacccgcttcctggaacgccagcgccatagcgccgttgattgctttacgtttgttatctggacgcggatcgcgtttagctttgagtttaggcttgcgctgttcttcacgatgtttattgatgtacacacgacgcagaacatgtttcacttttggattttctgcgcggaaagcacgaattcgctcaatttcctgaacaatcacgtaaatgtcgccgttatcgagcatgtgctcacgggcgatctgtgcatagcccagtttcagatcattgaatttgaaatgaatctgtactttttcctgctggctaacttcgctgatattacgctgaacgattttcatagttactttcctttagtagaatcaattttacgaataaactctaacacttcggcatttctgctgtcaacatttttaagaacaaaagttacaactacatgaacaccggatgcttcgttccaaccatcagcacacgggatcatcagatcatccagagtgttgacaaggttttccatatccgcagggtgatcgacaaacaaagtttgcgtttcggtgatactggctttgaatcgtttcccgatctgtgcttcgagttcgtccagcatcccagcagataacgcggcgatgtcgatgtttttcattccaccatatacaacatgaaatagtttcatatacaactaacctcattttcgtatttttcgcgttcgaaacagtcgggttcgttccagatctggtcaaactcacgtttcgtcatgatatagccacgggcgattttgcgagttagatctgaaccgatcggagcataccacaaaatcaatttacacaccattccctgaaccagacaatcatacagccctttttccagggtgcgtacatctgttacgctatcgactaaatcgggggcacttcgttcaggatggtctttccactgactttcgatgatgtcgtttagttcacgatggaaatagatccacgattggaacgacgcatcaggcggatttgatttgcaaccagcaggataaaattcaagcattttgatcagcctcattcgcaatacagatcgccataaaggtaaacataacccccaacgcaaccatccagatcgcggttaaatccccatacaaagaagaataaccacccatcacttcaacgcgatatcccagcaagaaaacgagatacgctaacaccttatctttcataattcctcacagaaagcccatgcagcatgataaacgcttgcgcctttgtcatcgttcatgcataccacatctaccggacacacaacccgataaagtaccggatcaccacctattgaacgtgcagcccttccagcatagatacgagccagcccgatatcagcagtaaagaaaacacgatccagatttttctttctgcctttttcagacagagtatcagaatcacaaggaggcaacaacatgctttcgattccggcagcagtacatgatccgtgatagaactcaacgaactctttgcggcagtgaatggtattcatggttatctccttgttttcagagattacagcttatcgctattcgcccgacaagtcaacaaattctttttcaacgtcttcttttgttctgaacaggtaatcagtaaggctacctgtcatcaattcgcgagttttagcaactgaacgaacacggcgttcacgttggctttcggcatcaccaattccatgacctggttcccacccttccatatccaacataatgcgcgggtgcatcatcacacgaatatcgtttccatatgaatagctgttatattgcccgaatacaaatcttttgaatttttcgtggtgaacatcatcaacttcgacctgttctccgtagtaaacaatttcatcacagaacgcagcaagaacaagcccaccagagttttgaattttcaggattgcatggatcatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgagcactccatttgaagtaatcccattttggatcacaatctggacgcatagacggggtatgccagcgcttgaaccccaagagattacagaaatcgtcaatcagggtatcgcgacgggatttatattttgactggtcgccaagagcagcggcgttgatgaattcatgcagttcatttttcataattgttaccttatggttaaagttcttccggcctatccgtcgaacaattgcactataaacacactcataaaccgtgtcaataaatacttttaaataaacacctggagttctaagatgaaatcattcaaagactttacgagccttgatgaagcgctgatcaccttcggcggtaaggcttatcctaaatttggtcaggtagtcatcctggctggcggcgcgggttctggtaaagggttcaccctcgaaaagctgttaggtatcgaagggatcaccctggacgttgacgcactcaaaaaattggtcatgggtagtaccaaactggcagcagagatcaaagcgaaaactggtcacgatgtcaaaacaatgaacctgaaaaacccggacaacgtagcaacactgcatcatgtgatcgcagacgtgttcaacgtatccaacaaaaaccaggcgcgtgtgtacgctggtatcacagcagcaccggaagaccgtaaaccaaacctgatctttgacgtaaccctgaaaagcatgagcaagctggcaagtatcgcccgtgatgttgaagcgctgggttatcagaaagaaaacatccatatcgtttgggttatgaacgatgttcatattgctatgcagcagaaccttaaacgcgatcgtgtagtgcctaaagaaatcctcatggatacccacgaaggggcagcgctcactatggctaagatcctgaacatgggcgactctctgaaacagtacatggacggtgatatctggatcagcttcaacaaagtaggcattgacagcgaaatcaagaaatctgacaaaggcggtatgtttgtcgttaagtctaactacatcaaagttaaggcaaaaggcaagccgcagaaatccattgatcagcttgataaagagttagtggcgaaagttgcagcatacgcaccgaaaactgacacatggggttgacaacaggaacttatatgaatatgatgcacacacaaaccgaggaattgatatgaaaaagtttttgttcgatatggatggtgtactgtttaactgggaaggttcttttgttccgatgtacggtgacccggcgagaatgccggaagaagaattgaaaaaagcgaaacaggctatatctaaaactgacttctacgaaaatctggaaccacttcaagagggcatcgacctgttctgtcatttgagaactttaggtcaggttgcgatcttaaccagcgtagggaaatacaattccgatgcggtagcagaacaaaaaagaaaagcgttggtgaaagtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttccctttttttgtttatggtgtgtaatccgcaaaggagcggttcacatcctgaatagtgatgttcatatcgtcgttcaggaaaacactacgatatttccctgcgctatcccatgcttgacgatgcttatcattgcgggagatcagagggcaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcgatcgccagtttttcatagaaatctgtacgaaccagggacgatacagcagcttcatattctgcatctgtcatgttttgtgggcgtttgccaaatttggcttcgattgcgtcgctgaattttgcgaatacatcattgaattcaaatagtagcatttttaccttcttagttgttattatggtgcaggtttaacgtttaccgtcagagttgcagtaacagatccagaggttgctgttacgacaacatcaccttcactaaccgcatgaagtttaccaccaacgatagaaccatgaccggaagagtcaacactcagagtcatttctgtaccagaaggatcgatggtaaacagatcagttgcagccagatccgcatcacctactttgaaatcagcaggagcggtttttggtgtaattgttacgacaggatcagcaggagtaaaatcactcagcttatacagataaccgttgcgggattcgatgaaatcaacatcggtgtaatcaatatacgcctgtttcagtgtgtcgaattctttcgcgtatttttcttcggcataatcacgccagtcttcgcttgcagcattcgcagccacgatgatatcaaagatccaccacggcaaataggtaaagctggtgttacgccacgggatcgggtgtaccgtagtccatttttctgtagccattttcaaaacctcttagtttttctctatttagagaagtaaaattttgccgtcacaagacggacatttatcatattggttcacgcgcccatagccgttgcattcaggacagaacgggtttgttacaccgaacacattacggatcgcgtaagtggattgttcttctgtcagccctacgaacccatcggtattgatgaaatgttcactctgttccggtagcatatcggtatcgtcatcaaggataaggtaattcttacatccgaaggtgtcgatccatgctttgatttcatcaccgcgtcctgcttgtcggtctgttagattcgtacaggttttcccaatgatgcgatacaatccccacgggtagaagatttcccgtagagtatgggttgtgttgccgatcctccatgtagaggaaatgacaatatcacagttcgcatgatttacgatccggcgcaggtgtcgagcacattcaatgtccatatgctcaccaaatttcatgcaccgcatattatttagaacgccgtcgatatcaaggaagatgacgtttccgatctctttaccttctgataagtctttcaggcattcgtgatttaattcagtcatattttacctacaaaaaagggggcgtagccccctttgaattttaatagaaaccgcgagcttcgttatccaggcgacggtctgcaatcatgtgcgcttccatttggcgagaaacataatcaggatcgcattccatttttgcttcttcgtagttgtcccaggtatcagcaacccattttgaaccgttccaacgagcataaccaggttcagcagggacaggataatcagcttcgtaagcgtgacgcagtgcttcttcaacagtatagtaaggagcatttgaattgactactttcttcactttaccatcagcccaaacaaacagaactgggtagtaagcatttttcatcatttcgtttttcattttgctttccttcttcactgcgagagccattcccccgccttcgagtacaaatatactttaaacgagggtatgcgtcaacaagttttttagcaaaaagtgctaaaacttaaatgtttcgaatcggctatttctggtttcgcgaacacgaacttcgccatcgcgcacgatatagaacgcaagtgatttgattgtgtcgattgcgcttgcatgtggacagctatcaggatctttgtaccagtctggggtttgtttaatccagtcatagatccaccacggacaggtataatacccgttagaactcgcagagcgccccatcatgaagattgtcgggctaaacccttccaaccataccagttcgcctttggactcgtcagaagcgcttacaggagcttctacgacatcaggtactaattggatttgatcggctacttccggcgcgacctctttaacgtactccataaaatccgcagaagcatcaataaccacatcgggaacgttcggggcttcgatgacaggttcacccatagtcacctcacctttatatgcgacgatttccggttctggtgaatcgatcagcagttccggcttttcttcatcttccggtaaagcagcaaccagatccgccagcatgttatcgaaggatttttgtttgttcagcttaaccgcaaacacagtcatagcgtaatcggctaaagcgcctttctgttcttttgcgtcgagggtacggaacccatcaactttttcgtaatcaatgttcattggtatctccaagtgtttatccaatatttatgacataaatacgtatatactttgtacatagggtaatcatagtggatattgaagtcaaatttttaaacacaagccacgtacagattcaggcagaaccaaacattgtctatgaactgcgtgactatttcagcttccagcccccaggctatcagtatcaggccaaatacaaatatggtggatggaacggttacatttacttgatggactacaacgggaaactcccgtatgggttagcctatctggtatccaaattcgcagaatcacgcgggtattcaatctgggttgatccaaagatccacgaaactgaggatatcacgcaagaagattttgataagtgggttagcgaacatccggtttatgacggcgacaaacagatcgacccgtactggtatcaacgcgaatcagtgttccacggtatcaaaaaccgtcgcggtgttctgaacctgccaacatcagcaggtaaatctctgattcaggggcttatctctcgttggtgtctggaacattacagcgggaaggtgttgatcatcgttccgactaccgcacttgttgaccaaatgatcgaggacatcgcaaactatcgtttgttcccgaaatcggcaatgctgggtatccgttccggtacagcgaaaaacagtaatgcactgatttacgtttctacctggcaatcagcggttaaaatgcctgccgaatggttccaacagttcatgtgcttgatggttgatgaatgccacctatcaacaggcatgagcatcaaaaagattatcgacacgatggatcaatgtatcttcaaactgggtttatccggttccctgaaagaagggaaaacgaacatgatgcaatacatcggtgcgttcggtaaagtctttaaaccagttgatacgcgtcgtttgatggatgatggacaagtcaccaacctgaaaattaacacgatcttccttcgatacaaagaagaagaggtcaaaaaattgaagggtgcggactaccagacggaaatcaagtacgtaaccagccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagacattgacgatcgtaacgaaatgaagaaaatcgcggaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgtaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaagatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacggcgagaagaactgaaagccgaacttgaaaccggagaagaagagaagttttaaaaaagaagccccaaccgaaaggaaggggctttgttgttttcggctttattcagacaaccgttgtcttaaaaaggatgtgttcgttttatgtcatggacaaccttacaatcaggcaacgaggcgaatctttcgaccacataaccgcctaaatgactgaacccatcttgtcagtcccgtacatttattttatttcagtgctgtactattctgaattacaattaactggcctttactcgaaggtatcttaccaatcaccccaccgaaagtaaattctatcggacggcgcaaatgggtacgccacacggtaagcccaagccccacaaggggtacacatctatttactgctataaatctgggcgttcgtcttcgatacaaccgctttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcgggccagcttcattgacaaacgccgtattacgggagttcatcggttgtttgcacacaacgcatttgcaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatggtatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacggaaatgtactgttttctctatatataaaatataaatattataaacagtacatcgtacttacccatcactcacttcgttcgtgaaaactcgcttcgctcgtttgaccttatagatctttattactataatggtcttctcaaaacaaaacttgttaacccagtttaggtaacttaatacctacgatctgactcagcttagatttacctgcaagagcagaccaatcatcacctttgatcaggtgatcggattcgctttctgctgtgtatgggttcacggaaagaccgtaacgcatcagaatagcaactttcggttgcagggatgccggatctacggatactttgattgaacctgcttcatcagcttcggtatacggagcgaagaacagagagcctacgtgatccatatcacccagatcatatttgcaaccagtcagcatataatcgaacgggctgttggtgtctgtatagacataataaccgttgttcagcttacctgttgccagtgggtgttgttcgtcggtttcgtgcatccaaccagacgcagccagaatgcctacaacacgcgctgttgcgaggacgtaggtagcatcaaatgaagtcgttctattcatttcctgccccatttcacacgctaattggtacaggatacgacccaatgctggagcatccttcgcggtgtatgcggtagtaccgtcaaaaataccatccgtaacgagtccatcaacgttgtaacgtttggaaacggtgatcagtgtttgaataatgtctttgttgacttcttcacttgccacggttcccaggatgtcttcgatcaccccatcagcttcgaactggttcgcttccaaatcctgcatcagttcaaccgtcatttcggttttaaacttacgcgagcgtaccggaatattccagcgatccatctggaaggaggttgacgcgatatcttcactggtttcatacttagaagtatcagcggcttcgctaaccagtcgaattttgctttggaacacagctttcatgatcgcggtgtctttgtcagtatccagagtgttcagggtaatcggtgcgataacctcataaacaacgtcagtaccatcatgcttgaacaaatcacctttaacgtaggctttagtcagatcgatttcgtcgatgtctgtacgtccagagattcggcctgaataggttgcagcactggagaaagtcatatcaccattagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtgcctgttgcttcgttgataactttttctcgtttaccagacggaagcgaagactgacgcatcaacttgtgaattgtgtagtgtttatcactcatttctttggttcctgaattatagggagtatattgtttatttatgcaacgaatttccattcaggaaatttgtcactctttaaacggtaatcaaggccagatcgagaaagccccaacgctttagaagcatcggaaccgcttgcgtaaacaactccatctatcgacacagaacggcttattttggccttgtgcgcgtctgtgagcttagatccggttctgtcgaatgcagaacccttgtacatagctttgatagtctctgaacgcttcctgttggattcttctgattgcttcttccctgtttttatttttgaaaggcgttcttttacttctggtgtcattctttcacgagttcttttggagatttcatgtttcttttcttctgaatgaaacattcccagcatagggccaccagaaccacccacgcccatattgtacacatctggacgattgacgaaatctaggtttacaatctccctttccttttcatacatctcttcgcttgtatcaaacacgaacaagatctcttttacgaagttctcaattccatatttccgttgagccgctttgattgctttaccagaacccatgtatgaatcgttaatatcatctgtcgaatgtgcgccgatatagattctatcgtttatcttgtttgttattttataaattatatgtttcataatatagcctcaatagttttcattatttatataaacaaaaagggaacccgaaggttccctttaaaagtcgttgtttttcaacaacttataagcccttaacccacacgcggcggaagtatgcgtttttaccgcacatttctttgctgatcataccagaggtgatacgatctgccggagcctgagagcgagagttcgcaaacgggttgataccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgggaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagcctacggtctgggtgaaaccagttttaccaatctgcgcggtgtagttgatcaggtcaacgatttcgcggttgatttccagcatgatttcagttgccaggattgcagacagttcggcgtcagcgtccataccgtgtacagcacgaagatcctgtgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacgttgccggaggttacgttctggaagtacgcgacaccagtttcctggaatacgtgcttaacgatagcgccggaagcgatagcaacaccagttgcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtaggaccagtcataggctgaacaccgcaaatgtcgaatgcgatcaggttaggaatcgcacggcgaaccataccgattacagcagggccgatgttggtgattgcaccgctggatttaccagaggcaatgttggttgcgtcgtaaccgtggtcacccgcgatctctgcttccgccaggaaaccgccgaaggattcaatgattttttcgtcgcgatatactggatcagtatcagcatccttttcctgagtttccagaattgctgcaaccagttgttttttggatttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgcgattcagtcagatcttttgttttttctgaaacgatggtatcgcgtttcatgttggcgatctctttagcctgagcctgattagcttcgaacaggcgtttaacttcctgctgattctcggtcagttcatcttcgagttctgcaacaacatcaacctgcgcttctgggataactacgttgtgttcaacgaacagttctttcattcccattaccagagattcgaacagatcggccttgatatcacgggatacagcttctttgttttcagagagccattcctgcgcgatgtggtcgaagtatttattcgcatcttcgtacagtttattttcgatttcgccagctttttcggcaacctgggcttcaaccagttcatcggagcgttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcgttttgcttgactgagattcggtaatcggcttaacgtaagcatctggagcgcttggcccccaaacaacatcaacgcctaccgccaatttaaacccttcttgtacgataccgtaacctttaccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccataatttttcaattaggatgcaagcattacgcggatcgacattcggtcgcggcgggtgattcatttcacccagagcttgacgggtattaacctgagttctgatataatcgtttactgcttcttctaatacttttttcggatacagtcgcttattgcggttaactttttcggcctggaggaaaataccttcaatccgaagtttaccgtcttttttcgactcaccgaccgattctaaaattgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgcacgttttgtttttagcgcacgacgcgcaatttggcgacgttgagatttagttaaaccagttgtttgatacgcattacgttcacgggttttacggtcttttttacgttccacattaccgcgcgaatctacgtgtttaacaatgacttcatctaaactcaaaccctcgacaatggacatcatagccagggctaaatgaggttcattgaccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgctgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttcttcgatcagcttcgcttgttcgtcaatgtcttcatcagacattcgaagaatctctttcatgatgtatttatgggagacatatttcccaactacaccttcaacctgtgacatcaacgttaggcgacgttccataatctcaatatctttcacttccgcgtaatatgaatcctgctggaaaatgaaggaaattttactaacgttttcttcccattcttcctctgtgatgatttttttcgcgatcaggttagtttttaacggatcggaaagcacagggctgaactgaatttgcagtgtgcggataaacttactgaatttcagttcatcacgggtgatttcaccacccccaccaatttgcatacccccatcatcgcgaggcatacggcttaatggcacacgcagtgcttcatagagcttacggttaaaccatttgatatcatccatatcagagaagttcgcaccgcctggaagcgtgtctacttcggtgatagctttaccgtcacgacgcattaaccagtaatcttctgtcattgacaggttgttttgctggttcttaacagtacccgttttagcatcgtacacaacgcggtttttaagcccctgtgcgatgttatttacgtactgtgtcgctttgttgccacccatctgacctacatcgatgtagaacacacggcgttcaggtgcgcgggtgatacggtagatgaccatcgcatcttccagtaaacgcaattggtttgctggcttgactgcgcggtgcagatatccgataatgttgttactgcaatcttccagaccagaatgcgcatacacgatagcggagcgcgggattttaaccttctggttatgctggtagatctgcccgttgtatgtatagccatttttaggagcgctatacacgaaaaattcgcgataaccacggaatactttcacgccaccatcgagggtttcagtgatagattcgcggatcagttccatcgaacgcggatcaagttgacgcagttcgcggatacctttgctttcgtctttatgcatgattttatggaagtatatacgggaatccacataccaatcacggaacagacgcgcacccatgttatcaaaatcatagatatttagaacgttatcaaattcttctacgattttgtcctggattgccttactaaaatctgttttggcaagatccaaagtaatgatatctttgccctgttcattcacgatcgcatcgtcaataatttcagaaacagcgttttctacttctgggtaagacatgatgccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatctaattcgtcctcacgggcgaaattcttgaaaaagctaagtacattgccaaagcccaaaaagttcatagtaactccgaaaaataatgataggggtattgctacccctgtatttatagcctttattcccaccagtccagcgcgaaagtaacctcaaaggttgacacttcgttgttgctgtcccagtccagggtaacttcgcctacgttagtagggaaaagaccgtggatggtatgttcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgcgcgtcatcgttatagatcgtgattgtccagtcatcataggtacggtcaccagcaacgttgattttgcggttttggtatcctaccggaactttttcaactgtagccgctggcatggttgccgctttacacttgaatttaaagtttttgcccagatacgggatctctacttcgaacaggttcggacgtgcgaaatcaccggattcaaaggcgcgtaaaatgtcagtaagcatttttaacctcggattatttatgggggcttttcagcccccttgacgttatacggcttgcggccctaccagttcatcgaaatctgcgcccgtagacgttgctacgaagttcagagtgatgtagttgatagaacgaggcggtttcacgtagatcgttgctacaaactcgttacggtcgattacgtccggcgtgttgttcgtggtgtcgcagattacacggtaatcgtagcaaccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagcaacgctatcagtgtaaacacacaggccagcgatatcacctgccagcggaacccaacggttcacgtcattgtatttatcatactgatatttatagttaccatccaggaagccataacttgaacttacgttcaggttattgtcaaccggagtaccaccactgagtttatatccagtacgccattcaatgatgttatcaaccgctgttgccagtggaatattcaccatcagagagcgcggaggcgacacaaacacagtacaatcctgacgttcatcaccgatagagataacgtgtttctggacggtagacatgatctctacagtttcaccagcacacgcaccagcaatcagcagaggtacatgcagcgcttcacgatcagcgaacatatcccaaccagtcatcagttcatcagcgcctacagtgtcgtttgaggacaaaccaccgccgaactcaaggataccggagaagcctttaggccagttcagggaagtaccgtaaacgtactgagagccaccgttagcgaaaaagtcatccatgaagatgtttacgccgtagatatctttatcggtcttctcagttgacacgatgaaggattcctgtacaataccaccacgacgcacaacaaaagcgtactggttatcggtctgtggcccgtaggtcattacagaacgaccgctgttcttaacggaaaccccagaagggtagcctgaaatcatagctccagaatcgtaagcagctttggagataatctccacctgaacagttgaacccagttcaccaggatacagagccacgacagacgggatctgatatttctgggtaagagtctggaatgcggttccctgaattgtttcttttgcaatatccaggttcaacagagtgatccctgaatcgctttcgatgccgtcaatcgtaatagacgcggaaacaccggaagactgagaaacaatttcggtagtccagccagtagaaatatctgggtaagtaccaatctgtttagtacgggcaacgattttttcgcttgggatgattaccgcgaggatcttgccgttactgtcaactttggacactttaccgttttcttctacaacaacgttgttgtattttactttaatcacatcgtttacagtgtagttagaaccctgtgatgcaatagttgttttgatctggttaaaaattgcgcttgcgtttttagcggcatctttatcgacaacgcgaaccacacggagatcattaccgtactgcaagaagttaacagcactcatgaaatagtcagcggtcaagttgtctggggaaccaaaatagtttaccatttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtctttctcgcagaattcggcaaatttcatttgagttgtaagccaaccgaaacaagcaagcgacataacgaggtcatcgtgatatccttcttccgcagcccacgaaacgcctttttctgagaaagtacgaaattcgagtattgtctttttgttatttatgatcaatttatctttctcgatcaggtctttcagcgtcgaacatcccatagcttttgatcgcttagtctgtttcatacccagatcgttgtagctgtcacaaataacattctcatattccagttcggaaaacagagatttggcaactgaatgccctgtgctatttagctcaatgtaaatccatgcctcgttatacatattcagataacgtaacaggatatccggcaaaataagatgcgacgttttgtttgagtgatacaccgcaacctgttcaaatggcatcgtcgtaatgtcgatgatatgcattgcatggtaatcctgtccgcgaccttccgctggatcaagtaccgcaacatatttatgcccctctactggacgtttatactgatagaagttcgtttccgtttcatcaatatcaatccatgtgagttttgacaacttccatccagcgatcagggttccactggttcccatgaattccgcgcagtgttcctgcaaaaatgcctctttgctggagccagcgatcatcttcgcagaccacgaataaccgtcatcaaatgtaccgttgtcgccgtctgtatacaatcgctctttaaccgatgtccagatcgccgtgtaaggcacgaaaccggattttccttctatagcagcgttccagatatcatagaagtggttaagcccgttaggtgtcgttgtgataaggattttcgatttacgaccagaagagattactggttgaatcgctaaccacgcatcaacaaagttcgggataaacgcgcattcgtcgatgtagatcatcgcgaaggagttaccacgcactgcatcgggagaagatgcaaacgcaccaattttacatttgttgtcaagttcaatagaacctttgttccattcaacaataccaggctgcaagaagtcgggtagtagttcgatcgcctgtttggtacgatccagaacttccgcagacatcgaggctttgtgagccagcacaccaacatatttatcttcgttgaaacacacgaagtgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacgacatttcacccactccatcaacatttgttgcgtccatttagtctggatatacgcacgtttcaggtttgggttgccgttatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcatcagttccgtaggggaaccaacaaatacggttgcattctcgatattcatttcactaccaccaccgcccttttcagcacctggttttgtagtctcttccgtaatctcacgcatttctttgtgaatcttcatcaggccaatgtttgaaacgtttaactgattcatcaggcttgtgaatacctcgacgtggcgaggcgattcggagttcttcgcgttgtgtaatgcgatctgcgccatatccatgatcatctgattcatatggtgcgcagtcttacgcgcgagcgtataatcctcttccagatccggtttccggtctgctggatgtgattgaacgtcaaccagttcaagtttttcgtaaacaaccacatcctccccagactcaacgccgccagggagggaatcaatattcagcaattgctgcaaatctaatttttcatccattctcattccctcggcttaggaggttcatcaccagacgggatcggcttatcgtgcgagtacgtctgaatatattcttcgcccgtgtagtcctgcataggcaaatctaccggatcggcttgactatccacggattcgaagttatctttatctaacgggttcatgttagagaagaaatccgtgtaaacggttctgatttcgcccttgacatcagttacaggcgggtacagataaccctgtaattcaaacataaatgaccactcaacatgacggcgttgatttgcatcgccctcgaatgtggtatccggcgcaaccgactggagactgattttgatgtctcggtcaactgtgatttcgttcttatgcagttcggtaatcttgcagttgaaatgcggttgaaaatatggcaaaatctgttctgcgatctggaacatatcatcttcatatcgcgtatacacacccagttcgaaaatcagacgatatggcacagggttaaactgtgtgatcgtttttcgtggggttgctaactgtgtcattttttggttgaccgcgatactggttttacggattgcgttatattgcagatccaccagtgataagttcatgcgcggtaaaatcgtttccgttttagcaacgttttcctgactcaacgtgtagttaagtttgttcatggaagcgagaaacttctctttcgatgcataggtgatcggaacctttatgtatttttcttgatcgccgcgtactcttttaacctgaacgtgattaaaaagcgcccccatcaggacgatataattacgcagcgaactattataccagtatccaaaaattttctaatccccctgctggacgcgtccagacttacagttatcaaagtgccagcgcttcgctgtattagcggcgcacattatcccacaatgggggcattgtaccttttctcgttttttgcctttgtgagcagcaacgagacttgctatatgttctggtgatagcttctttcctttatgaacagcaccaattctttttctgaattcttcggtatggtttttcccgtaaaatgggttgtttttaccgtcatgtttacctttcatctgttcttttttaacaatgcgcattgcttttcgcgcctttgtcttttcttcaagaatgaactgctgttcttgttcagataatgatgaataacgtttgtgttcataggtgaacatcatgaagaacgcaagaatcattttaggatcattggtttttgctaatgtcctatgggccatcaaatgcttcattatatcaagttctactaaattttccggttcgtgttcgaattcaggaaataaagaacgtggtaatatgtgatgtttttctgtgtgttcagtttttggagaagcctttatgatatcaacatactcaacgtatagatcatgaggcaaccattctttaagttttgcgtatatcataaaatcctcttcgaagagggtatagactttcgcctatacccatataacgtatttatggcagacttgcaaacggtgaaccgcgtccgttgacaacatcaaaagattcgatgaattcatcaccttctctttcaaattctttgtcttcttcgtactgttcaatgttgatatcagccagcccgtcaagatttcgaatcggttcgagatccagttctgcatcaggttcgatatggattccttcatttcgctgcaattcaggagccagttcttcaccagtgtagatgaatttagccaggttgattttacgctgaggacgatcaccgaactgatagaacggatcggcttctacccacgtaatttcaaacaggctattgtccatagggaaataaaccagatcccccagaacaggaataccaccatcagtttgatgtgcgaacaaacgagggttaattaccagcgtcatttcatcgtttgaactcagaccaaatttactaaagaaatctcgttgtccttcatagttggcatacgattcaatatatgcagcaattttccatgacttcgtaaatttggattctcggtcttcgcccaggatcttatcaatattcacgaagtcacgccggacgtaatacatatcaggcgatttcatctggattgattctgctgtcagtgaatcatgtagctgttgtgtcgggttgtatttgtaccagtttacatacgggttagtgacctgatcctttaagttgcgatcaaccccttcccccgtagacaactgagcgaataaactttcatcccagttttgcattattccccctacaccataatgatcggtactgcgtcagacatcgaaattagttcatcgcgcagactttgcagtttggtttccgcttcctggatcagtcgcgtaccatcaggagcaacaccgccaggcaattgcattccctggaacttagccagaatttgtccgttgatctctttcaccagtgcggtagagtagtcttttacccagcggttgttatatgcagacgttccgcccgtaacagttgaaccctgtcccgctcgtacaccgcctacaacgctgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcacctttgttcacctgcccccatgcgcagaactgaccagtatcatcgttgaaccagtaatcaggcagtggagccagcaggtcttgcattgagcgttgataggacatcatctgggtaaagtagcccatatccgcgccgtatgcgttcataccgtacacactcgatgcacagcgcccacccagagagccaccagtcaaccccatcaggaaatcggtaaaccacggataaaccgctgtaccgtccattgtggtcaatgaacccatgtttgtacgcaataccttcgtgatcgcgaagatgtgttctttgctcaagtcgaacacgttgcgcgggttatcatcacccagtgtcaaaatcagatacgttttgtttgtgccgttataatgatattctgcatacaggtctaaagcgcgttgaatgcagtcataaatctgatcttgtgtgatttcgattttgatgattggtgcgcccagacgacgaagaatttcatcctttaactgttctggattattcgtaatcatatgatcctcaaaaggggcttgcgccccttgttaaaattatgctaccgttacagtcacagtcgcggttgctgaatcgttggtactgttcatcgcgtcagttacggttacatagtaatcacccgcatctgcgctggttgcagcagacttgacgatagaagaaccagtttcaccactcaatacagatccgtctttatgccatacgtaagtgtacggagttttaccaccgctaaacactacttccagagtcaatggatcaccatcaacaacagaaatatcactcaagtttgtatcgaactgaggaaccgtatgtaccgcaatgtcaagttcatcagaagtaatcacggtattttcagcgtcggttacgacaactttatatacgccggaatcactcgttgtgatgttctggataattacactcggtgaatcagtcccgatatttgcggttcctttcttccactggtacacataaggcagtttaccacctgtaacggtaacagataaagaaatagcatcaccctcgatataatcgttacgaccgaccagattttgagtaaatgacagtggaactttcttcgcttcgtatttgttatccgcttcaacttctgtgatatacggaaccagagcatcagtaacatcctggtgagaggctttattctgttccagttcgtccagacgttgttcaacgttaccaccaccgccagcttcgagagcagcaacacgcgcagtcagatcggaaatcagtttataaatccctgtttctgatcctgtagtattaacgccgatcgcagttttgttatcgcgagccgttttctgaataccatctttgaggaatggatcagaactggttgcgtcaccataaacagctttacccatcgcgatattagccgcaacgagtccagttgacgtattacccacaattgcggtaatatcaaccagtacctggtggtcgtcgcgctgtgtgttttccaggttcagaatacggcctttcatgctcgttggctgtgaatctgtaccgatatcggtcataacctgtgccatttcaccgcgcagaccatcatcacttgtttcaccaacgatcatattcagatcgctaatgctacgtttcattgtgctgatatcgtaacggatactacctggaacctgtgagttaccaacagcgctttccagaaggattacgcgaggcagaaccccaacaaccggatcattcatctgggtttgcagagtagtaatgttcgtttccgcagtttccatgcgggaatcaatactaccagaaccacctgagcctgtacgcccgatataagtgttgatgtttgacagttcggtattaataccagtgatatcgccaccgataccattcagacgaacatacacagattcgaaagtggctaaatgcttcggccccatttcgttacgcagatcggtaacttcatcggttaaattacctacatctgagtttacccagtcatcttccagcttagtaatacgtgcttcatggatagataccgcctgagcgttagccattaccttgtatttcacgccggagccagtagaggacggatcaacatcaccatcttcgttaaagccaggatatgcacccagttcatctttcaggaaaataatatcttttcgaatggtacgatgtttaggatcggttgacgcatcccatacaccaatttccttttcgatatcctgaattttcagggtgttgcttgctgtagttgcctgtacagcagacatatctactttcagcacgtcaacatcagcgacaactttatccagtttgtcgatcacactatcatcagagatcgccgcgaggttttcagtaatgaggttaacctgatcgataacttcgttgatttttgatgtctgggtagttgtatttgcttctaattgtaccgcgttcttttgaaccagaacaccgcatctgtttaaagaaccctcgttagtggttttggtttttgcaccatcgagagtttcgccgttaacaatccaattgatctgggtttgtgtggtgtccgcagggacaccatcaacaaacgggatctttggtaacgggttaagttttgaaatcatggattaacccctttatcgtactcgaattacgtagttgaccgcaaggtttttcattcgcgtttcatttccgccagtacctaatgctttgctgtaatcgttattcaggtgcataacacgttggtcatttttttccgcgcctttcagttcataaactgcttgactcttaggaagattaccgccgttctggtaaatcatctggagatcatgttcgtgatacgcaaacatatcagcctgatatgtaccaaaaccgcgacctgcatctacaccacgtccaccatcaaagccgcgagctacaagaccgcgcatatcaggcaagttgaaaatatcaccagaaccgccgtatgtataaccaattcgggcaaacagttctgggtttgaattgcggttcattgctcgcccgttacagataaacaagttaccaacatcggcgttaaacgctgcaagcatcatacatccgatcgggatatttgcgtcaacatctgtctttgtctggtatttattgtcagcactaatcgaaccctgatacaatgcaccaccagtaattgcactgtttttgttgctcggtactacgttagcaccagcagacaaagcagtattcgctaatccggtattgatatctgttgttaatttaaccataccgaaagtagagccggaacccttcacagcagcgagtttttgcggggtgatcgctttggtgttatcagtacccgcgtttacttctgcctgggtagcgatacggagtaaacctaaatcactttcacttgcagtcagacgaataaacgtgtatggtgaaatcgcaaacccatcgcgaatagtacctgcgcgaacttctgcaacagttgctaactgaacaagaccaaacgaactttctgttgcgtttgcctgtaccggaaccagagcagagatcgcttgcttcactttaagcggagtcattgcggtagtgtcatcagtaccggatgttgcctgagcagttgttgacagtttcacagaaccccaaacgttttcttttgcatggcgggtgttaaacacatagttcaacgagcgcggagtaagagaaaccagatcgtttgttactgttactgattctgcatcagttgcgtaacgggtgtaaccccatacggtttgtgatgcatgggggttttgcagacggtattccagcaaagcaggagttacgatcgtctgggtatcagtacccgcatcaatcattgcctgtgtcgcaatagcagcaataccgcgcacaccaggcgcggcattaggcaaaccaacatcagtacgcgcccacggcccaatagcggctaatgcctgttgtacgttcttaaacgtgctaggccattgcgtaccagcaggatcaaatgtcacgtaaacggatttatcgcttacgtggttaattgtattgttcatttgttatcctcatgcaatacgcttgaaataataaatcggaactgctggagtaacagcaaggtcaatttcacctaactttgtccatgtaccgtaaccagatttagcctgtacgtcgattgttcctaccatcgaaattccatattcagttttattagtaaccggatgcggaactgaatcaataaaacgaacttccagaatttccccgttgagacctttacgagtaaccaaatcgaaatatttttcatcgttgacgaattcaacgaatttgttatagactgtctcacatacggtagaggcgttcgttgtattgtcgaaaacgaacgggaaaccataaacgtgaatagtcgcctgtgtttgatctggatctgggtttgaaaccgtcccatcaaacgtaattgattctacctgttgcaccgcagaaggggggctatcttccgtcatcatgattaccccattgatcgggatctgctgagacaaagaatacaggtcatcaattgctgattgtacgttagggtaatctaccccttttcgaagctgatcgacgtttgcaccaccaatagtacgtttaccaccaatcagcggttctttcgtacccatttcatattgcaaaaagtctgcttcgcgggaagggactttcgccccctcccttgttttggaaataaactgagtcatttatgctacccttatccagcggtgaacagtaatataaggcgggagcgtttttagtttatctggagtagtgttcccccgatttacttttaatacatcctcgcggtatttagtgtaacctggccctgttgcatctgggtcaacctgacagccaccaataataatgatcccgttgtcatctttaatcaacaccttatcggttgactgaatttgtggaacgttgatcggtttaatttcataaccacgttcgccaccagtaccaccagaagtgtgagttggttgaccggaaccatccagatcgttattgttcagaccaaaatcgctatccgatgcatcggttgtccaacctgcaaggaacataccttccgcgtaacgtgaccagataccaaagcccatataatcgcctgggtttgaatcgttgtgcgcgttttcgtagactgtcccgattggatgaataacatcaaagaacgcttgcagatccaacagacgaccgctaaatgtatccgctactttacgagcggttttctgcgttgggttgttataatcggtatattcgatccgattaaccagcgtcacttcttcttcgttgttcaggtaaatcttatcggtgtgttctttaataccgcctacaccgtcccattccattacagtaccgatatcattgttgaaccatcgaatagttaccacatcacgggattccagaggttgagcaaatttaatgcccgtaaccacggagtcaacaaaaatcagactgtaatcctgtccagaaggaacccacgcgccggagttcgcaatacagctatcttcatcataaccttctgcgccctcacaaacaaatgtcgggagatccgcatcacctgctttaacaagctggcgaccgttcagcagcagttcgaacgagttcgggttaatcaaaattcgcggactgataccaaattcagcattagtgaacgtgcgtttgtttggtagatcaccaacccagatttcaccagggatactaacctgttctgtgtctcccgtgttatatacgcgcatggtatgcgcttcatacgtcgctcgccatgcggcaataccatccagataggtaacgaattgaagcgtgtcaccagcgttacacgggtttttaagacggatatttacaccatccagatctaccagttgtccggcgctcgcaccaggtgaaccgtaatcgctgtttgatgaattaaacccgttcttgtcgtcgatgtacagcaagttaccgcgatagtaaacttccagtgcgcggacgttgtacgagttaccagggccgaacacgttcaggaagtcagtttgtccctgagtcgcgatatacgtttctttcgcaacggttgccagatccgaagttgtgattttgtcaacctgtttgttttcaacatattcccaacgtccaggagaacaataaacaagttcaacgtccatcaggtctttgtacagttctttgtaagtcggtgagcctttgatggtatcaccgcttgcagggacgatacggacgttgtttaccgcccacttaccccatacgtcacgtaagcgaataaccttgttataatcacttacactgcctttagggaggtttaccgtaatacggttgttgctggtattcagcgcccatgattcaccgaaaataggggtcagcgtaggcgctgtgtgcgttttccacgcacccgctgggtgcgggatactcccgtcacccagtttattatataactcggtaaagttggcgttagtcttttgaccaccacgacgcagataatcacctgcgccgtcatcaaccacgttaccgataagaatttcttgtttcatgctgcgatccctgatttaatggtgtcaaccgctttaatcgagaatttaatgcgattctcggttttggattgtacgtttgcgtaaacaatatcactcgcaccaacagtgaacgtaagcgtgtacatttcatcttcgctatttttgagaactgcgtattcagttgaatacacgcccttagcgacacggtcaacagacaaaagaatttcagccattttattgactgtgcctgtcatattctccgcgtacacgagaattttcgccccactgaattcactataaccaaataaaggaattgcggtcggtgatgctttcagaatgagtttagtagtatctacaggcattgtttttgaaccaaacattgattcaacagaataatcccatgtagtaacggaaccttctttcttcacacaccagattttaatctgagtatatggagaggtcacgtaaagttgatcctgaacccctttgataccatcaccaacttgcggacggaatacaacaggacgatcaacagaaatactaccgttactatttatgaaatagaacccttcgccgggtttacccgatggaagcacaaccgtaattggccctgtagaggtatccatatcatgcagtgaacccagttcaatcgggtttcctgaataataggttcgcggtaatttctggaaatatccggtcgcgtggagtaacattgtacccacaccatcattcgcagtcagtaaacgcacatcaccaaacgcgttgtatacgttggtgatgatttcgttaagtttaacaccgccgtcatacagcgggtcgccagttgacgggttgccgatttgccccacgtcaattaattttttaccagtttgatatgccattatggtttccttagaattcgaaaataatactgacttcttcggtctgatcaggagaacgaataatcggttgacggttttccatgtagatcatttgtcctgagtcaagttcaagctgtcctttcgtgtaatactgcctcgttgcttttacttctgggtcggatggttgcgcctttttcaacagcgggtttacaataacgctgatttgacggaacccacggttgccaggtaaagaggcttgcgggaagaacagggaatccatatacgcgcggaatcgcattgagtgaaccttcattcggtacaccaaatcgtacatatcaggataccatttgatcacgttatcataaccccaacgaaccgggtcttcttcaagttcatcagggaacggaacaacgatatgttcatttgtacagcggttgataacaacatctggtggaattgtatacagatattcccagatatagccgtcgcccatgtcgataccgttcgcttctccgcgtggaggttcgatcgattcgtgggtcggtgtccaaatgccaccaatacgcacacattcaactttacccgtgatactggagattgaacaagagccaatatcaggaacgtctacaacgcggtataccatccatcctttaccgtagtcagtacggttatacggcgcggagtttacaaccacgatgtcattaatgtaaaagattttggggtttggatatcgagtatcgccccagtctttacgcggaacgattgcatcaatcatttcgcctggtactttcgtcatcccgatcatatgcgtccacatatcaacgataccatctgtatcatcgttcggataagggggagcgaattcagggtcggattcgttatccgcccattgttcggtacgcccgattgacatataaatcgagttacgatcggggctgtccccgatcatttcgcgaaagttcatcatgttttccgtgcggaacttaccagttacgaccgcacggtagatgttttgttgagccattatgctacctttctctgagtcggtggattcggatcgcgaggattacccgcatcgtctttcaatcgtttttccactaagttacggaactgagagtatttaaccgctgaactatcgaacagaggactttgatcaaatcgacgcgcggacggcagtacaccattcagcggtttttcatcaatgtcatattgtggtggaacatcaaacggttgtcccgctttcgggtgcgggtcgtacaatgcttcaccagttacaaggtcaaatgtctggtttccgttaccgtccagacgggctacgcgatcaggccaatacttcggataaccgctatcgaagcgataatttcgaagaatgtcaatgatcgtttcactatgcgtcatagacaaaccggagttgatgaacaccgttagcatggtgatcccgataaagccaaagcctaccggatgcacgaatcgtaaaacgtcatccttataacgggacgctggcagattcgaacgaattttcatcacgtagtaagaacgcccacggttgaagtagtcgatcgagttgttcgccatttgcttaccacgcacaccacgcagaatagttcccgtgaagttagtcttttcagacttgacaacctgcccttcaaggaagttcccgatcacgttgtgcagcgttactgaccaacgtaattgaccgtcatcatactggcgttcgatatacgtcacgtttgctctcgctgttggtgtgtaaatcgtccggcctacaatatcctggttgatatttgttgaatgaaccagaatatcatattccagagtgttcgaactttcgatttctacacttacatcttcgttatacaacagtttgaacaggaatttatagcttgcttcgatgcctttcgttgagtagaaatcactacaacgagattcaaagaaacgaaccacctgatcacgcttcgttttatccaggtagatattacggcggtttacttccgaccacagatattctacgctgttcttctcacgcggatatttgttcctgatcaggttcagcagcttgttatagtaggtgttttcacccagcgaaacgaactgcaaatagtattccccgaacttctcgaaatactgctgatccagatagctttgaggcgcaaagcgcgtaatcatatggcttaaatctggggcaatcaaaccaggtgacagatccggttgatacggtttttcgcgttcctgctgaatcagatcggcaatcaataacgtattgtctggtttccagaaaatcgttaagttgtcgcgagcgcggtaactcagttcaaagaacccgatgatttctcctgaactcttatacagcaacacgccgttcgtatacttcgtgaatccggtaaacttaatgttgttaatgtaaatcgtaacatgtccgcgatcccatacctctttgttcacacgaagcgatgacgaagggccagcactatcggttacaaggctgtaggtgattttcggatacaccaccagaggacggttatcattagtgatccatgtgcgcacagagtcgcggaagaaccagctataattcgcctcgttgtagtattcctgagcaccaaatttccaaacagtcgggtcgtcgatatgagcgcgaatcgtcgcaaagttaatcgcaaggctggcagtatagccaggacgcaaatcatattttacagcaccaaccagtgcagggttctcgatcaacaattcaggatcgggaagtgtgcctggatatttgtagttcgctacggaaataaaaatctccgtgccgttcgttgacatattggtgtattcatgctggatataaaaacgttcttcctcggtgttcccgtacaggcgcacaaaggttttcgtgtcttcttgccattgatacacaccagcagcagcggacggaaccacgttagcgggttttgtaggatcttgcagagcggttttcacttcacccgtaacgagtgcataaagaatcccgttcatcacatccattttcttgacaacgatcttatcatttccagggacaactgtatagcttgctgtatcgaaaatcttttctccgaacgttggagaactcggatcggtgtcgatcggtgtctgtttcagcgcgatacgacgcacaacgtttttcgcaaccacataaagccagtcatcggaacatgccattgcttctgcatatttcgacacgttaccaggcagtttagcaaacgtgttgtatgagtctacgtcgaaatcaaggccagtctggttccccagtttggcaaacgtaacatcatcagcagagaatcgcacatcgtccgcagaccagcgaatatccgttgaggtgcgcccgtagaagatacgatcgtaacccagtacataggttgtgtttcggctttggtacgcaacagagcgcgatacagggtttcctacgcggtcgttaaacgccttgtagtaatgccatgtttgtcctttgtcgtttgacaccttcgccatgttctgaaaacgttcaaacaggtacaataaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattgaagttaacgtagttctgattgtcctttgcgaatttttcgtttatgaatgcatcacttggcgtaaattcacgcattgttgaatatgcgtaggcgttaaggctgaacgtccataattcatctgtataaacccaatcagacggttcaaagcccttgtgcgtaaccatgacgcggaatttataaaaattgtttggctggacatcggaagaaaaccattcattcaaaaaagcgtaacccaactggaaccaggttaaatcttcatctggaatagtaacaccacctgccccgcgagtttctgccatttccacgacatagtaaaaatccatgccgacgctatcccacttcaaataaacgaagttagcagccagtttatcaacgcgcaaactggtaattgacggcgctttaatcattatgtttctccaaatttgcgttacttatatcccatatttagcaaacaaaaaacccctgccggatgacaggggttaaaattattgactgattggattcattgtcaatgttgtatattgaggacggagatcgttttcaaacacaatcagagaaccatcacgggtgaaaatgttctcttccaatggtgtaccagtcagttcgatataagcagcgctgaatcgctcggatggaacgttcaggacacccagatcgaaactaatgaaatcagtgtagtgttccacatagccgacttcgtaatatttattacgatcggtcactccaggatatttatcaaaatcggttcctgtataggctgcgatactgatatcaccgtttttgaatggcccgataacaatttttgcacgtccggttgtggtgttcatatcggttgatgcataacgcacatcatacgaatcaccagcagcgtttgtgtatttgaacccgttcgaaacaacagaacgtgatttcacctggtttaagaagtgaataccagacatcggagcgctgtaatagttatcaagttcacgcaatagctgaatagtcgcagaagaaccaatgatcgacacgtccgcgttatcaacataggttaacattttggacttactgaatgatttgttgaaaatttcaacgttatcagtataatatctgtcaacctcgttgattacttgaccacgcaaccattcctctgattcaaccaacttactgatatcatacgttactttgatgctttgtacgatgtacagatagttcgggtcaaggatcgacggcgtaatagtcgcaaggttatacttcgccagatagttttgcatatcctctttttgaacagaggtcaagcgcaaccctgatttcggtttaaccgcgatgaacgcatagccaggtttttctttatcagtaaagcactgaaccgcctgaataacagaaccgaaacggtgagacaagaacgattcataatccgatgcagtaacacaacggcgttgtgtctcacgcatgataggcgcgagttcgcgaatacgttcgatatcttccggttcaccaccaccatcagcgcctacatagtccgctgaattagtcgggttctcaacaatactcgtaatgctaatgtttgtcaacgtatccacgtaaacaaagttttcagcaccgtttgcttcttcgccgttggttgaaatatattcaataacaacggttgaaccgtttgcaggtttcaagcccccgatgtaatcagcagtcagagcaccacccgcgacctgttggctggtttcaccttcaccaaagtaaacttcggtatgtccatcaacagtttcacgcatataaaaaacagttgatgcacccgttgcgtttacgatactttcgtttgtccagtcatcccattgtgcgccgttgacggtaacgcgaacctggctacggtcgatgtttggatcgcggatcaggatagtcgaaccatcaaagatgacttcggtacgtactaaacgcccctgaacgatgttcaacatcgaaacatagttattgtttttgtcacgaacgatcaccacgtcatcggatacgacgaacgggaaactgtttgtttctttcactgtaccgatgaatttcgtaccgcgtggaatacggatcgatgttgggttcagtgggtttttcgcagtgatcaggatcgaagtatttgcagcggtgcgggagtccggcatatagcccaaatcctgagcctgttgaacaacagaactacgcaatgcagcggtacgaataaacgattcgaacagtgcggtgttactcatttgctgaatgtacagtgtacagtatgataacagatccacaagtacgttcatgcgcgagccggagaaatcataatccttgaattcgtcctgacctcggagccagtttattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacagtaatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaactggttaatctgagccattacaggcagtttcttgagttcagccattgccatgctgtaggtgtctttcataccatcttgcaaagtagcaatctgtgctttgattccctcatatgcggccttagtcgcattcacagcagcgttagcggcatcaagtgcagcctgataagcagcggttgttgctttcgttacaggttcccacatccagtttaggtactgatcgaacttgcgtttaatcgaatccctttcctgtgtctgtgctttcagggtgttgaatagttcttgtccctgatcatacaatgcggagatctgcgcataggatgcatcaatgaacgctttcaccttcgcttgcgcttgctgatacagatccattgctgtaaaccctgggaagttaccgcccagaatcacatcaagcggtttaatctgccgcatgatgtttcggatagccagaaccgcagaccaaagcgggtttggtgtttcaggaggcattgaccagatctgcatcatacgcccgtacaaatccaccagagcaacgcaaccattttggaacatagtcaaacaccagtcaaataacgcactacacgcgtctacaaggtcgcgagcgccagccttgacgtattcaacggcatagttgtaagaactgcctatagccccgtagattgcgtttatgacgctttcatacgtttgtgcgccggaatcaatcagagcctggaaagaatctttcagggattgaaccgaactatcaccaaacaccagatcgtaaatgttgatcgcaacacccatgatcgcaacagtagggaggaaattcttgatcaaatcccacgccccgcccacgatgttaaacgcagagctaatgatctgtcggaatactttcattgcggtttgccatgcttgctgtgacaatgccagagcacccgctgtgatttcttccatcccgatcgaaagcccgtcaaacatcgtcgcaatgcccgtaccgttcttaatcgtaccagtcagcatatcaaaagccagcttgaacgttttacgagtctcgttccacgcggaaagcatagcatcgctgatattcgtatacgggaaccctacggtcgccggaatacagcccaatccagaacgagcagaaaacaatctggcttcactcggtagcgccccatacgttgatggtaacgccggaggaaccggaggaatgcttgtatctgcgttcgtgtttactgacatccctgtatacttgcactggtgcgcgggggattcgtcgtgtttcatgtacgcaatacgattaccattccagtagtaatcaatgctggtaaacgcgcctgtagtctgattgtatacctgtcggattcgctgatcgcaacgggggccggaagttagcaagtaaccaccggagttttccaccttgtacattgcgagttcgccagggttcttgaacagattcgcttttgatagatccgccccgtaccagtcattacccgcgagcttagtagccccgatagatgcgatataggcatcaatatccgcttgactggcgaaataataaccaatcttcgtaaccagaatgtcagtagaaacccctggggttccgtctggattcgtgggtacgtttggagagttcaccaccggaagcggatcgcttttctgtccgaaaggggaactcgtatacaggtgagttccgatcgggatgatttcggtcgcccattctaccccaacagcagggtaattttctgtgtgtccctgccagataacgcgtctgtaatatccagcggggatctcagcatcgcaaggatgctgaaagttttgcataatcccatcaatgatggtttcataatccatgatcatgtttagcctacctgtacagtaccgccagtgatcttagtcagtgcgccggaatcaatgaaagtattattcgatgctcgcatgttgatattacgtgcgccaatatccaaatcttgctcaatatcaatcagagcattttttgcggtaattgttgcatcttctgttacggcaacggttgcattctgtttaacgttagccattaaattctgattcacgtttacggttgcatctttttcaacggttaattctgcgttgcctttaatcagccccaaatattcaccttcaacggtttgatttacattaccgcgaacgaactcggtcacgttaccatcaacggtctgttgaacgttacccatattgtaaatgaacgcatcaccctcgataacaacctgtaaattacccttaacgtttaatttacggccttgcatgacgatttgataatcatcaccaacgattttaacaacacgggttccatcagggcgaatttcttcgtatgatcctgctgggtgaacacggttgtaacgttcaaagcctggtgtatcgtcgaattcctgaatgtgtccagaacgggattcgaataccatgttgtatggatattcagcagcgtatgcggatttaggttcctcgaacattacgcgagtatcaccaggaacaaaaggatcttctggatttgatgcagccaacacaacagcattgtatgcagcactcaatgaacgcccttctggatctggaacctgaacaccgtatgattcgaggttgcccgtcagcacgattttagatacgcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttcgattgccatttgacgaggacggtttaacgtcacgtatacttctcgaacgtttgaagtgttgctgatcccctgccggacttttgccaaatcctgagcaaacagcgttgaaacttcttctgctgtgatcgttccattggttacttctcgaccaactgctttactgatcgcggcgttaatcttcgcagtatcacgggttttttccatgataagcaaatgcccgatcccgatagtcggataaccttcactatcaatataccattttgtgcggataccttcatcctgtttaagcatggtttcgatagtgaacccgccagtatcaggacggttatcttctgggatctcgtcaagtgggcgatcatctggattgacagctaacgaactgttagcatcgcgaataataacgctcgaagaaccgcgcccctctgcgccaccacgagccagtacgttgacatcgttacctacataacgaggatactcgccaaacgggtcacagaagcctttctgggtgtccggcttctctcggtactcacccgcaaaggttcccagtataacgccgtcctggtgccatttatcgcgccagtaaccgataacaaaactaccgcgcgtgataccagtcggggaaaaaccaacaccagaaatagcggcgctgcgaatatcctgaataggcatcatccacggcaattcctcaaccggaataccgatagtttcagatttttgtttctgtgccggatgctcaccgaatacacgcacctgaacacgccccaatagacgaggatcatcgacttcttcgaccaccccctcaaagaaaggggagtatttatttccaccgtatttcataggtttgccttttccatttccttgatataatcacttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccgggattgttcgggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaactggtggaaagaacgaaaataacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgatagaaacccgcatgtgaaacgctggaacagtgaagaggttgtgatcccttatttcagcaacgcagacggaaagcgacggcgctacttcatggatttctatgttgaaatggataacggcgtgacctacctttgggaagtcaagccgatgaaagaaacgttgcccccaccgaagccagcgaacaacaacgttcacaacaaaaagaaatttgttgatgcactgtatacttatgcggtaaacattgacaaatggaaagccgcgaatgcagcagcaaaacaaaagggctgggagttcaagatcatcacagaggacacattgaaacgtgtgttcggatggaaagggcaataaataccctaaacggagggaattatgagttttatttttgagttcgagatcatcgcagaagaagacaagccaaaaccaccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctataagcagcagattgatgatgaaatcgaacgccgtaaagcagaaaccgaagcccgacgcaaacgtaatgactatcgcaaaaaacacgcggttgatatcgtaaacgatttccgcaacagtttgaagaaaatgactgttggtgtaaccgctgcgaaacgtcagaaagattcgaccgattggtttggtgatttcatcaaaaccagcattaagacgcacagggttgcgaaaccagcaacgggtcgcttgtatacgttcatctacgatgcgaaatacaaagacacccttccatactgggatcggttcccgctgatcattttcctgggttcaggacgttcgaaagcgggtaacttggttctgtacgggctgaacttgcactatgcgccaccgcgagcacgtcaagagtttttagaagaactcctgaaacgtggctacggatcaacagatcgactttctaacaaaaccagactgaaaatcaattggaacaacgtgaagggaatgcgcggggctgatcaaatgatcaaagcatatctgccagcccatctacgttcaccacttgcagagatcgccccaaaagattgggcgaaagcagtttggttgcctacacaggctttccagtccaaaggaaaaccatacagcgcgaagaaagtttggaacagatattaacaaaaagccccaaccgaaaggaaggggctttatttttacagggtactcacgatttccgcgagtttgccaggggttgcgccaggtcgaaccttcatcgcatctttcaggtttttatcaaccatcttttctgcgtctttttcgttaaacccacgtttcaccaacaccgcaataactttttcgcgaatatctttagcggcttcgttcaaatcttctgattcagctagaaccagtttagacagaacatcacctttgtattcctgggtaaagcgtttacccgataccagacgaggtttaccagaggcatctacaaccgtaaacacggcgtattcacctgtttctttggttttggtacgtccggtatacagcaagcacatatcgttacttgggagcttgtacacctttcctttcaccaatgcttcatccagaggcagatcaatttcgaaatcttccgccaactgattatacagatccaggttttcttctgcttctttgtacagagaagcgcctttgaatttcagtggcttgtcgaatttcaggtcatcagcaggatcaccgctgtagaatgaaacagtacctttcgcccagtcaatatacgctgcctgagtcttgccagtggttttacctttcaggcggacaacacctttaccgaagtaagcgagatcgtgggagtccggcgcatacacatcgtaatcagcaccatgtgcgaaatgcaggaaaccgatctgaccttttgcagcgttaccacggtcaaccagatcaacggtcttagcaaattttttgttctgaacagattcagaaagtagttctttgaatgatttcatgttttcaatctcttttgaaagtataggtatagtatacctatttattgaatagatcaactaaaaattagatcgcgagcgaagcgagttccgtcaagcgaagcgaagacggatagttaacgattgtataaaaagtatacggaaatgtactgttttctctatatataaaatataaatattataaacagtacatcgtacataacactcacttcgttcgtgtgttcgcttcgctcacggtcttgatctaaatatctataaaatggagatcatcatgaatacaactgctatgatcctgaaccagatttcacctactaacttcatgttagatattcctgacaatgattatgtaaaagggttgaaactacaagttcagggtgttacactacctgctatcaacattccaattacggatgtcccactgaacccaatgattcgagggaagatcccaggatctgcaatggagttcgatccactgactattcgttttgctgttgatgaagaactgcgatcgtatcttggggtttacctttggatgctcggtactgtcgattttaacaccttcgattccgtgcgttggagtgaaccacaacaggcaatggctttgcatatcctggataactcgcagtcaaaaactgtagcgacatttcgcttctatggcgcttggccctccaacctcggagagcttgagcttatgtataccaatgattcggatgaagccgtatcctgtatgacgatgttcaacttcgctcacatggaaattgagatcgacggacgggtgatcgtgcctactccacggaaaacgcaaaaatgatttatggtatttgtggtaaaaagcgaacgggtaaagataccgttgctcaaatggttgtgcataacttccgtaatgttgaagttatcgcgttagccgacgaaatcaaagctatcctgaaacgttctatggaacatcacgataacacgcaattgcgagcgctggcagcgaagaacccattctatgagggtgatcgtgaagccccgctggtgatgtccaataacgatgcatacgcgctgttttctagcggtatcaaaaaattaagttctcgcgggttcttcatgagtaacgcagatgttatcgctcataaaatttgcgaagaaaacagccagccctggacgattcgccgtttgatgcaggtgttcgggactgatattgtttgtaaaatagatccgtctatctggacttcaattgcacttcaaaaaatgttgaaatcctacgcggatcactttatcattaccgatgtgcgtcaaccgcatgaatataaatacctgagcaagttcgggactcgctttgtgttccttgaacgtgaaactggtattgaagataatcattcaacagagcaaggtttgacacctggcttgagtgattatacaatcctaaataatggtacgttagacgatttgaaacgcaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccagatttgcggtcttctggaaatcgacggttcgcagggtgtatcccctgatgccctgatcggcgcgatcaaagcacttctgccagcaacagtagaaatcgctggtgataatgaagcgattgatgcatcaaaagcataattaacgcttaggcgtttaaccactgggggcgaaagcccctttttcatttggagtacacatgaaaagttttattgaagtagcgaaacccgtagttgatccggggatctatatgtgtgcgaagttcgatcaggcttcctgtgaagcgctcgcgaaggtgcaaaaacttctgggtgtagagaatcctgtttccgctgcaaagctgcatacaacgattgtgtatagccgtaagacggttgatctgttccctgcatccggtatctctgaacctgcccgactggttgacgtggagaagtgggaaacgaaatacggtaatacgatcgtgggcgttctggagtctgattatctccatagccgctttaaagatgcaatggatgctggagcaacatacgattatgacgattacaaaccacatgtaaccctcgcgtatgattcccgcatcgaagatatcagcggagttaaaagactgttgacattgcctgtagatttgactatcatccaggaagatgctgaaccgcttgatcttgataagaaagtcgaagacatcacggagcacatcgaacatcgcggcgataaatgggttatactgaaccatgatcgcacgaaagaacttggtgaatatgattcgaaagaggcagcggaaaaacgtctgcgtcaaatcgaatactttaaacataatgggtgatttatgaacagagcacgattgatgtatgttatcaataacttacgcagagaagttaaccaaaatttcagtaaagcgttaagtgattggtatgtgacaaaggtttcaatgactacagatcacatcgcagaccgattcctggatcgttccgcgtcagtcaaaaaagactttgcgatctacagtgaaattcttaatagtctcgctaaacattattcgtgtaacgttctgtattacgcggtgaaagcgaaaaacgaaggtatgcaggaagtcattgcatatcgccggattaatggcaaagtgtttgcctgtgcgttcaccgtccagatgttcgaaaacatggatgattcggttgctcacgaaaagccagtgattgctttacgattccgaaccgttatccctgagtacacgttgagcctgaacacgcgaaacgcgatccatgttaattacatcgcacctaaaatcaagttcgagtatgacggctacagacgcgttatgtcacgcctggatcgcctgattgcttcaaaagattgtccgcctcaactacacatgttgaaaaatatttgaaaaaagcccttgcattcgtgcaggggcttttgttatattaggggtgtcgaaacaaaggaggcaatcatgaaactttactggctggtgttctcaaacgggtttgtaatgaaaggcactgttcactgtgcgaaaacttattgcaaatggaatgaatgctctttccgtatcctgagcgttgcatcttctcaacctgtaggggattactaatgactggtgataagtgggttgataaaactttgttgttgacagtaatctactttctggtaaaatacctggtgtagacaaaggagggagttatgagaaacttactgaatatcgcggaaatcttttgctatggtgtcgctgtgtatgtcctgtttaacggtgacggcgcgggatactggatcatgttcggtggtggattgttcctctctttcatcaaaaaattttttaagtgagaaatatactatgcgctcaaatgtaccgaaaaacctgtataccgttattgatgctggttcgattcgtattgctgatgtaatggcactggtcgaacgcttcgatcgttcaacaacgctggggcaactgctgagtatggttaaatcccagtacccacacaaatgcccgaaatgcgagggtaaagggttcgaagtcaaacgtgttaacacgtatccttctggcttaccggattctggctgggttgatcagatggaagacttcaatgttacttgtgatatctgtaacgggcaaggcttcactaaagaacgccttatcgcaaaacctgtcaaagtggaatatgtacccgcatgaaaaacaaaatctatgctcatatgtctgagcacacaacggttcgtgttatcttggtagatgggccaatagctcaagtagaaaccaacgataaacctttctcgttgcctttacaaaccagtgtcggtactttcgatgaagttatcgaagaattgacaaaacatgctgttgtttatctgtgggaagcgcaaagctatccgtacccgactcctacaagtcaggcgtcagaagataacgtaaaaattcgttggggatatattgaatgaaaattaccgatctcgtaaaagcggctaatgcgctggtgacaagcgaacattacgccaactactgcgagcaataccctgttcccctggaacgcgcaattactcaatccggttatgacggtatcagtaccgtaaccgttgaaaacctgaaaacgttcatcgtgtttgctaacacgttctggatgtacttacccgataatatcggaattcgccagcctacattcttcacgctgtgtatgttctgcgaaacctatctcccagaatgcgaggattacgaagaacattatggaaaaagtgaataaagtatccctgatattcttcgatccgaaactcggtatcacgttctgtaacggattcgcgccgaacgccgaagaaatgttcaggattgcatttagcaatgaacctgataaactcgataaagaagtgttggcagagataaacaaaactggtacgctgtattatgcccgacgcaacgacattgtgaacggcattcagtaccaatcaaccctcgaaaaactcaaaactgaactgaaagaaataggtgaattatgacttctacagctattcaacaacaaaccattgatcatgatgctgaattcgcacaactgatcaaagaacataacgcttttgcggcttctcgcgtcaatgaagaaagcgaacagacccgccgatccctctgggttgccatttaccgcgaagtgttcagcgagaaatccgctaacaaacacactcaggcagttgatgcagcagataaagcgctggcagcatacgatcgtaagttcggagcacagtaatggaacggtctgctggtattctcttcctgaataacggcagcgttttaatgggccacgcaaccgaaacgcctcattgggacatcccaaaggggcatatcgaaaaaggcgaatccccgatcaatgctgctatccgtgaatgcttcgaggaaacgggcgttgtagttgaacaacacgaactgttgagcctgggtctgattgattatacgagtaaaaaagagcttgtgttattcgtatatgtgggtaataattaccccgaagcagaaaaatgtgtttgtgcttcaaccttcgttaaaaatggtcgaaccattactgaaatggatgacttcaaatatgttccgtatagccagatccgcgatcatgcgcgtaagactatggggaatttactgactaaacttgtgggatatacatcatgaaaccaaaagcaactactttccaaatctgccaaatgatccttctggctaccgcaacccgcgccgctgaacctatcgcgtataagtcatggggtgattcattcaccgtgaaaaatattcgcgatcttccaggacgcctttacgcttcccctgatttcgaaccagtcgatccaaatgacctgactctggaagaaatgaaaaacctgggcttccgtaagtgggatgacgattcaaaaatgatgctgatccctctgtatctgttgccgtacctgaaagatggtttccgtgctatcagtatcagcggtgaagaatttgaattcagcactggtgaatcagataacgatcatcgtatggggctgctgtcattcggtgcgatgcctaatgagtcacgttgatttcaacaccttatctcaattggggttgatctggaaaatcaataaagatatcctacatcccctggggctggcgttgacgcgtgatcctgaaactggcgtatcggttggtgcgctggtttccgatgatggtgtctggtcgttcagcgaaaaatcagactttgagaacatagcaaagctgaataaactttatgctttacaggccgaaggaaagctgttagagttcttacaacaaaacgtgaaagagtgattatattatgaatggtgaacgtgtaattgtcattggcaagtcgaagcataaagctaacgcgaagggtgatcacttgatcatcaacaccgatcgcggtgactggtacggtgcaacgcaagtaacgagtggttatgcaaccatcgttgaaaaagatgcagttcgtcccgcaaccgctgctgatcctggttactatggaacccgtgacgagttcgaaagtgaaaaggaccaggagatcgcagaactgaaaaccaacgtgcataacgcgcgggtgttggcggtgatctgctttaccgttgcggctatcaatactggtttgttgggatgggtgattaatcatgtctgatgaaattgtacataaccgacttcgggaactccgaacttttcgcagtcgcgatcatgcgatcatggttgggagctatctcaactggtggaagcataacgatctggatctgaatccatcctatcagcgcccctatgtgtggacgcagaaagagcaagatgcattcctgactacgttaatgactggtttcccttgcggtgtcatcgcgatcgcggttgatagtcagtttaatgaaactcactgggtagaagtcatcgacggcaaacaacgcctgacaacgattatcaaattttacgaaggtgaaattggtcttcctatgccggacggttcccgattgttctgggacgaattgccacgacacgaacagcgaacctttgaaaacatgtcattacctgccctggggctggatgaatgtaccaaaaaggatcgtctggaattcttcatcaaattgaacttcgcgggtgtgcctcaatcacaagagcatatgaaccgcgtcctggaaatgtataaggctgcaaaatgaacaaagacgaagaactgtatcaggaaacagcggattcagtagaaccgaaccagtttatcatcggtaaagaagatcatgacctgttgcaagcggttaaaaacttgctgacgtatgctcatatccgcgtaccgaatggcgataacgcaaaactggaaatcgcatgtgctggttatggttacaccgctaccgctgataaactcattagctattccgcatcaagaacccgtgaactggttcattaccgcgataaattgagtgaagaaatccatcaaactcaggtaattgtagatcagttgccaataaatttcgaataatatcaaaaaagcccttgcagcaatgcaggggctttgttatattacacacatcgaaacgaaacagagaaaggaaaatcatcatgaacatgaacaaaaacattgctgctgttgttggttgtgaagtttctaacgccgaacgttatgacaacggtttctctttctgtgttgcgaccgaactggaagcatacaaagccgcttacaaataccgcactatgccgatggtaaacgttacttacgcgcctaacatcgaaatgtggctggttcaggtttacaacaaagtatgaacttccacgaacgcaaggccgcacgaaccgattattacatgcggttcgtgtatggctggaaattacggaaatgtgttgcatgtaatggatcagggcgatatgatagcgaccgatctccgaaatgcagttcatgtaacggaaccggaaaagaacgctttaaacctttgaggaatatattatgcaacatgtgaatctcaacccaaaaatggaacagtatctgaatcgccgtcatgatagccaggcgcaaaaggatcaggaacgcgcgatcaacattgaaacggctaaactccttacccagatgttccgtaagttccctggcaaggttaagcattcaagcaactgtatcagcgtagaactggctgataagcgttgtatcagggttaacctggcttacgggttatccgaagacggatataacctggtgatgggctggacatcaatgattggcaacttcgttgaacagaacaatattgagttcaatatgatgcgctctgatttgttccagtgtccggtcgattcaatcaatatcggtagcctttacgctatccttcgcgcacaatatgatttgtggagtacaaaatgaaagtaacaagtgaaaaacttgaagaaattgaaaaatcagcccgttcgatttcttctatgatgggtagtaagtggactctcgttgaaaatatgagcatccagggaaatcaggaatatggtttcaggggcaaagagtataaacgagcgttctcatatggtgttccgtatggcgacagcccgacacagattaaaagctgggaagagggtctcggaaaatatctcgaaactgtagatccacaaacggttctggatctggttagcgatctgtcactcgcgcttcgagacaagcaaaaagcagaatcagaagccgcgcactggaaagcaaatcacgaatgcgaagtatcccgcgcccgtgtcctcaaagagcgccctgatatgcctctggagcgcgtcaacgcatacaaccgtatggttgagttagaagaggaaaacaaagccttaaaacagcgtatagcgagcctggaggatgtcaatcaaacccgcatgatgttgcagatgattcagggtatggtgattgatacccaaaacatgaaccgcgaacaactgcgctactggcaaacacatttccgcaatcctaacgggtggtaatatgttcggacgaaaacgagaatgtaaacatgttgctaccggatggatgcggggaactccttacgcctggatgcatcattccgtaaccgatgggatcgggcgtatacatggcgatatgtatgcaacatgcgacaagtgcggggagaagtttttgatgtgtaagatacacgttgaccacgcgatccgtgagctggcaaaacatccaatcacccgcgccgaaatccttcgaatcctcgaagaaacaaaataacactttttgtttaaaaagccccttgcaaccgccaggggcttttgttatattacacacatcgaaacgaaggaggaaatcatggaaatcatctacaaaagccggaactacaaaaaagaagatgttgtagcagtttacatcaagtaccggaacgtgaaatgtgagtacagtggggcatggggttatgaaatcgttgttgaagaagtcaatgcagacaacaaaaccatttgcagtttcaccactaataccgatagccctctgttcactactgaacagcttgaacaggcttatgaactgcgcaaccaggcttttaacgcggtacgtatcaaatgagattccgtccttatatcgaattccttcgcggtatcagcgagatcctgaaccgcgaaatcaaacccagtccattagccgttgagctttatcgactggacgcaacccccgaagatgcagcgaaagattacggagatcagttataatgttaacttttgaagagtacaaagcacagcgtgatcagttaagcaactggtacagagagatcggcgcggagttgagcgcataccctaaaaacgaaatggggatgacgatcgaatcaatccgtaatacgccggaatacaaagcgaaacgtgctttgtgcaacaaggttttccaacagcttcgcatccttaacgggaagtacatcaaaacctacaaaaaagaactggctgacgaacgtaaactgaaacggagtgtaaaatgatgcaacacgaactcaaaacagagattgacaaacgtactttcctggaaaagaataaaacggtaacgctgatgcattactccaccaaaaacggttcgagtgagttctggcgcgttaacattgacagcaaagagaaacaccagtcgataccgttcgacaatgaaagccttgctcgcgctgtcttccaatcccacgttaaattttgagaattatattatgaaatctgtcgatatcgttaccagcatcaaagcgccgtccctgttcatctatcaacacggcaatatgcgcttcgctcgctcgaagttctacaactataatttcaacgttgatactggtgaattcgctcgctggggtgcaacatattcccacgatccagaatacgcaccattccccgaaattctcgatatcgagatcactaccaaatgcaacgggccagcgggtaaactctgcgggttctgctacaagtccaataacccgaacgggttcaacatggatcttgccaacttcaaaaaaatcatcgacaaaatgccctggcttactcaatgcgcactcggtgctgatgcacaggggcaaacaaaccctgatatgttcgatatgatggcctatgcgcgttctaaaggcattgtgccgaaccttaccattgctgatgtatcaaaagatgttgcagcgcgtttagcggcggttgctggggctgttgcggtatcggtttataaacacgctggctttgatgtcgctttcgactcggtagcgaacctgacagaagccggacaacagcaaatcaacctgcatttcatggttagctcgaaaacctatgatgatgcgtttaacgtggttgatgccgtgaagaatgatccgcgccttaaagaagtcaacgcgatcgtgttcctgggactgaaacaaaaaggacgcggtaagaactgggacaccgttacccgcgaacaatataaaaaacttgttgaatattgcctcgattctggtgtaggatttggattcgatagctgttcagcccccgctttcgttgaagcgatggagggacacccgaacttcgaacagtacaagcaatacgccgaagactgtgaagcgacgatgtttagctcttacatcaacgaacgtggtcagttcttcccttgctcgtttaccgaacgctgggttgaaggtggctgggaagaaggtctggatgttctggaagccgaagattttgtgaaggatatctgggaacacccgaaaacaaaacagttccgtaaagaactgacgggcaacaaggatcataacggttgccgtaactgtccggcttatgcggtatgtggtaaagatatgcgcgtacacaaagcccctgaaaccgatgtatatgcagtggagttgaaataatgttaatcgtatctcgtattaaatcatacgttcgtgatcgtgatattctggacgtgtcgcctttggttggtgaaactgttaccgtaagaaactatccggtgaatctggatcacgtaacctggatcgaagatgatgcaactatcgttgttgaagggaagagacacccagcaatcacttttcacctgatctgttcaaccccgattacctgggctggatatgaaaacaaagaacagcgtgataacgctatccatgcgattgagcgtagaatgcagtttgcggagatcacattctgatgatttatcaatcccataatgattcaacgatgcgaatggttccggtatctattgacattccaacaaaaccgcgtacactggaatcgttgattgaaaaatactctggaatggttatttgtccttctaccgcacaggtggcaatggcagaacgcgatgaaattgtatttgaatgtgatacgaaaggttatcacaccgttgaagatatgcagatgattgaatatctctggggaatccgaaacgctgtagtacatcacatactgaccgctgaaaagaaagccgaagccgtgagagaagttgaacagcgcgaagagatccgctataatcggatgtctgcacaggaaaaggatgaagcatatgaagtgtaccgccgtagtcgatgaattaatgagcgcgtttaaaacgcgccgtacagatgggcgtattaaagatccgaagtcaatcgcgatcatcgaacggtacgcgatgaagttaagcgaacaggaattcacaccaaaggcactcaatagcctgatggttctgaaactgctgatcgcttcgggtgacgatatgccgcacgatgaaaacagtgctgaatcattccaaaaggcatatcgttcatggggagtgatttactcccgctcgctgggttcgtatgactcggttatgtggaacctgatgcacctggatcgcctgatctgggaagtgctcgaagaagagggtattgtatgattttcacacatacaggaatggttgattctaataaaacagggcgtagacgaattcctttgatgaagtccggcaaatactggaagagtgaagaacataagttcgaccataacggcaacgctttcgggccttacgatgctcggttaaaacttgattctattaaagagattaaatcatgaaactcgatcgtgaattaagcggagcaatccgcacccttgagaaagtgcttgatgatttgagcgcgggtgaagagatcaacgttagcgacatcgaagcaaagctgtatgaatggcgcggtgcgctttacgaagcgacaaagggcaacgatcctctgttcgatgaatatgatgtgtacaacgtcaaggtatggaacactgaataccgtttcaagtggcctagcgatgcttacgggcatattcaaaccatttacgtaactggtggtatggtgtttgcgaccagtgttggggctagtgaacttccgatcaatcccgatagtaaagtaacgacaccgaacccattcggacatactaccgtttgtttgggtgtagcggaggacttctccccgttctattcaggctggatcgaagccagcaaaactaaccttaaaagagtataaattatgtggaaaattgttgtgtgtattttgatggttgtcgttgttgtgttcttgcagtcaagctgtactgacgagaaagaggcacagcgtatcctggaagcacagggttatacgaacatccagttcacgggttacaagtggtttgcatgttctgaaaaagacacatactcaaccggattcgaagcaactggtgtgaacggcaagcagatcaaaggatctgtgtgctctggaatgtttttcaaaaatagcacaattcgtttcgaataactgttgacactaatccccgttgtgataatatctctctcgtagacaacgaaacagataaacaaggggattaaaatgaacttactgaacgaaatgctggaaatggttgaagcgaacaaagaagcaatgaaagcgaaagaaggttgggtagttgttactgactgcttcaaaccgcaaagctggcttcctgtgttcctcaataaagatggtaacgaagaacacggcttctatgatgcggcaatcttcgaaaccgctgaacaggcttgcgatttctggtcttacctgagcggcgacaagcctttcaccaaatacggtgtttgccagtgcaaagacatttaatcccagccccgaaaggggcttttttgtaggtgaaatatgaccaaagcagaaagaattatcaaccatcttcaaaccggattcccgtaccagggagatttacagcgcgatatcatcgaactgttatcccagcatgacgggatggaagcggagataaaggaattgactcaccctgacgtgaacgtgttcgcttcactgatggatgatgtgattgctatcgactcggacgaactgatctgcatcgagacaacgaacccagaagataagacgatcctgaaacaagcgtatgaacggatcgaagcattacacgatcgccttttcacgttaactttcccaaataaaaacgatagaccttgttgacatcaaaacagattgtggtaatctgtatatgaaaactaattgtgaggaatacattatgaacgcttttgaaaaacgtgctgtcctgaaagatatcaaacctggcgcaatcctgtacgaagtaatcagtatcactggtgaaaaggcacagatgggtcgaaaacatatcatcactggcttcccgcgtgaacatcgtgggctggggctgtttgttaacggaatcactgtgtatgatgattgggaaaataaaggtcaattctctctggatgatcgtaacgtaactgggcgcaaccattataatttccatgcgttgttccgtagcgaagcagatgcgcaagcatatattgaacaaatcaataatgataaacttcctcctgatgacaaacaggagagtgttgaaatgacgattcgctggaaacgcgatcgcgcggaagatgcaatttggggttacatgtaaaacgttgcgcctcttaaaccgtaaataccctgtgtagcccatagggtattttcataaagaggtatgtatgtttaaatttagtcagaaaagcctgaacaacctgcaaggcgtgaagccggaactggttaatgtggtaaaacgtgctttggaactctcgcctgttgattttggtgtacgcgaaggtctgcgcaccgtagagcaacagcgcgagaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctgatgaacagggcgtaaaactgcgttacggtatcaactggaagaacgatccaaaccttccgattgaaacgaaatttatcgacgcaccacacgttgaacttgcataaggcgacaacatgatttcacaattctatgttgacgctgtaaagcagtcacgtaacctgcaccttgcgcgaatcattgatgggcgttgggggcaagaatgcggcggtgtgtctatcttcgaaactgcgctggatatgggccggatgtcgggtaaaaccaaagcggctttcgatatcatcaagcagtcgaaagggacactgaatatctacgttgcaccgacaaagcagatgggtatttgtgctgcggtagaacatggactggataagggcgctgattcgtctttcattctgtcgaaacgtcaagatctgacttccattttccgtggacaaaccatcaagtatcaggcaatcaacctgattttcgatgaatgcgacatgacgatcgacgaacggtttgaactggcaaaaacgctgaccttgtgtatgcgttcaagtcatcttcatccgttcccatatatccatattatccgtttgggtatgtaatgaaaagtcatggttattcatcaagaaccatacaggaagagattcaagggattgagtctcttctgagttatgtagatgttgatacatctacgggaaaagtgtattggaaaattcagcgcggccctatgtctcctggaagtgaagccggaagcaagaacgagtattcccaaattcattttaaaggttctatgtatttgcgacaccgaatagtgttttacgttgagaatggttatcttcctcctatcgtagatcatgtgtatggtgttgaaaatggagatacagcaagaaatctacagaaagcgacgaaccaacaaaacgcgatgaaaaagaaatgtaattcaaacagcagtacggggttgaaaggtgtttcttatcacaaagcaaatgggaagtacaaagcgcagataaacatagatggaaaaagaaaatttttggggtattataccactccagaagaagcaaaagccgtttatgaccggaaagcgaaagaggttttcggtacattttttaacgaaaccacataaggttaatgtatgtcaaaatacgtattagacaccaatgttttgattagtaacccatattcaatctattcttacatcgaacctgatagcgaaatcattatcaccgctgcaacgatggaagaactggatcacctgaaaagcaaagagcgaaccgctcatgaagcacgattggcgatccggcttttgtccaaagcaatcctgggacaaaattatgaagcaattacccaaacaggggtttcgttaaacttatcgaacccagcagtaccggaaagcgtaacactaaaaatcgtcgattatgacggcaccgaagaattccctctggataaacaggatgcgcggatcattgcaacctgtattcaacagggcgcaacgctggtgactcgcgatattaacatgctgttgattgcgatgtctaaaggttgtccggttcttcaatacactggcgatgactcgctgaaagatagtgatgtgttgtattcaggttatatcgacctgccgctgttctgggaaactgtcgaagtcctggagtatgtcgggcctgttgccgttataacgtattcatcgcttcctgacgcagatttctaccctaaccaatacattctatcggatggtgagattgtggggcgtgtggttgctgctggagagtttcagcttgaagtattgcctattaagcacgaacaagcgttaaagcgtaagctgatgaaaacaattcagccccgcgatgctctgcaagcgtcattcgttgatgcgatcctggataagaacaatgacgttgtgaccatcatgggtgcggctggttccggtaaaacaatgctggcggttgctggtgcgatgcacatggtaaacgcgggacacttcgcaaatctgatgtatgtcaaggctgatagtccgctgtctggtgaaatcggtttcttgcctggcactctgggcgaaaaactccgaccgtctgttgagccttgtatcacgagcctgaacattctgtttaaggatcaaccggaagttgacaagtacgttgaaggacttctggaaaaaggtgtggtgcagttccctagcctgtattacttccgtgggcgctcaatcgggcatcctgatccgggtaaaggttcggttctgattgttgatgaatgtcaaaacttgagcaatcacgaaatcaaatccattatttcccgttgcggtgagaacacccttctgatactatgcgggaacattaaacagattgacaacccgcgaaacactgctgttaacaacggctttgtgtatgcggttgaaaaacttaaagagtacggtcattcaagtcatgtgattctggataccgtatatcgtgggcgacttgcagcttttgttgaagacaatttttgatcaagggggcttcggccccccttttttcgtgaggtatacatgatcaacgttattatcagtccaaagctaattaccgtttgcgctaattgcaaaagtgggttagagtatgaactgtctgatgtacagaagaaaaacgaagtgttctacaacggtttcttccgtgctgctgattacatcgtgaaaaaacatatcgtctgcccgaaatgcggtagcgaagtgaaactatttttgtgaggttattatggttcaagttgtaagcattaccccaaaacaaactgcctgtcgttgtggtgctgttctgtcatacactgcgcaggatgtcaaagaaaaggtatctactgattacactggcggtcgtgatgtgtatcgtgtgatccggtgtccagtctgtgataaggatgtagtagtatgaaacgcgaagaacgttatgcagtatttaaatatgctgatattgatgccgcgttaagtgatagcgacaaactgcttctctctgcggtagtgaataaaattgatcgctatcgtaaagagcaaggcaaagaacccataaaaggggttgtcgtcgaacatgactggcctgaatacgaacaggtctggaagatgatcgaagaacgtgttgatcgcgaagataacaaccgcaaattcgaaacgatgctggacaacaaagaacgtctgggttatttcttcgtggttgagactcaccaggggaaattcctgatcaccagcaacgcgcacagcactaatcgcttaaccaaatacagcgggtacacataccgcgctatgttcagccctgattgcgggttcgacaacagcgaaatctttactactagctggagcgtctactttaaacgggctattatggtatctttcgatgaaatcgttgcactatacgatccgaacgtatcaatttcgaactataatcttgctgaattcatcgagaacaaactgagcgatgcgaaaaccatttaaaatggttgcataaataataagacgagggtatcatagccctctcttgttacaaataggtattacaatgaagaaaattatctttgctgccagcattttcttatgctctttttctggcaacgcggcgactgatccgttaggagagtttatccaaacactccccgctgtgaagtcaactttaccgctacaacaagcaacagtaatgaagaaagcgccagccaatgcccccagttatgttaaggaattggacgatattacaccaaagcagaaaaaggttttggagtacgctttcaggatcggaaatgagtacgatcgcaaaactgcaaagccagttgaatcggaaacatcgaaacgtttgggatatcatttagcggctattgcctggatcgagtctcgcgcatgtgagaacgtagggaaaggcaaaaagaatcatcatgcttatggttgttttcaagtaacagcccgtagcgcgtccgcacgaatggataaatcatattccaaacgcgtagtaatcaataagctcgaaacccttcggggtggttccaagtacgcacttcacgaactggaatactggcttgattaccacaaaggcgacttgaaaaaggcgctggctagttacaacgcggggttcaagtatggaaagaaagaagcccgtgattatgctcgcatggttaaccataccgcgaagctgttagaagaaaaacgcattatctgataaaaagcccttgcaatttcgcaggggcttttttattatgtgtgtaccgacaattgaggattaaattatgagcacatcacatcgagttattaccagtcacccgactatcatcaagccgaacatgctgcacatcattcagggtgtgctggacgaactgaacaaagatccaaaggttaaagtagacaccatcacggtcgatcgtcatcgcatggaatctttcagcatttacttcgcatatggtgaagaaaaacgcaaactgtttatctgtgaaagtcaagatacgtatcttgatgttggcaacaacacaattcatagcggcggtgtttacttcaacctgaacgtatggggtagcaacaaagagatcatggatatcgtgaaagtgggtattcgtaagcacgtcccgaatgacgttagcatttacgaatgtgttaatgatgcaattgaagatcgctttgtgcgcgtgggggcgtaatggaaactaaactgacaccagaacagcagttagcaattattgatgaacgtattgcagaaatcagggcggtaatgaagccgtatcaggaaaagctgagtaaactgctggatgccaaaaaagagatcaaagaagagattgatcacaaaaccgcttcccgtgtccgtgcgatgactccaaaacaacgtatggagttttacatcaattccccgaatactggacatgaaattttccgtgatgcgactaagttcttccaggatatggggctggctatcgacggatacaacccagaaacaaatcaacatattcttcgtatcgcgatgaacgaagatcgcagtaacctcgaaacagtcctgaaatcgcttcaacgtgtgaaaccatatgtgaagccgattggtggtaaattgctgttcgatatcttcgaacatacatgttcacagttcaacacgtactggttagcctttgacgttgcagaagaacgctggatgtgtttcacgggctggagtctgaaacgcaatcaaaagccggaatttgaaagcgatagtttgcgatcagtgcttgcgtatatctgcgaaacccattattatatccctatcgaagacgattcatactaaggtaaaacgatgaaaaaacttgcgctgttcctcgctctgtttgctggctttgctcatgccgatgaccgactggctgaactctgtaaccatcgcgacatcaaagacgttgcggtatgtgaacaggtaatcgctgaacaattggacgcggcttatgtgtggggtgaagaaaacgcacacctttacaaacgtcaaaagctggttaaacagcgtgagttcttgcagtctgaaccaatgatgaacctttgcaccaatgcgccaaataaggaacgttgtgaaaaactccgtacttacctggttgaagaatataacgctggtataggattatactgatgatgggattagtgatcttttatgggtgtgtgattgctgctgcaatcattatctggtattacgttaaacagccaaacgaaagctcgttccctgtatatgatgacgagttggaagcgtggcaaagatgggacgacgaatttaaatgaacacaggttatatcttaatgtgtgttgtggttgtgatcgcggggctggctgtgctggcttaccgccattatacaggcgatgaaaatgattattaaagaaatcaaagggaacgctgtagagttgttcctgaaacgaaaagtacacctgatccacgggtgtaactgttactgcaacatgggcgcgggtattgctaaagaagtgaagcacaaaatccctggtgcgttcaaaattgatgcattgactatgaaaggcgatcagcggaagttaggcactaactccatctacatgacggaagaaggtcagattgtcttcaatgcctacactcagtttaaattctggggtactggcccacaagtggattatgatgcaatccggtcatgctttgtgagcgccgtagaacgcgccagtgcgtttcctgaaaaattgcctatcattacccctcttatcggtgcggggcttgctgggggcgattggctgcgtattagcgctattattgacgagtgtacgggagattacccgatcattgtcgttcacttcgatccatcgattgatccacgtaaggcggatttatcatgattgatcctatcaaagcaggtcgggcgatcaagaaagcgaacaagcggatcgctgcaatcaaaggacaacgcgccgcactggtgaaaacctgtgaagcgctggcgcagtccatgaaagcgaacaaaataaacatcacacagcgtaaaacggcggttgacattctttgtcttgttgatgaaggactggataaagaaatgggcgaactgaaaagcaaaatcaacatgtggtatcttgatatccataaagcacaagatagcgaaatgggcggttataatcatgactgacaaaatcaaagctaaagcaatgaaggtgattgcgacatacggaacactccgttggtgtaacgcgcaggtgtgcgggtgtatgggttgcgcaaatcatactatgacgaaagaagagtatgatattgcgatccagatgccagaaatcaaagagcatcttgcgcgacgtaacaaaaaactcatgggtaacggatggtttacaattggctaaactgtattatcactatgcatcaatgaacgctggaaagagtgcgcgactgttgacggacgcgcacaattacaaagaacgcggtatgcgtgttgtaatctataagccagcaatcgacacccgcacatcaaacacagtgagttcgcgtatcgggctgaacgaaaagtgtgaattgattgcgcctgatatggatctgttctgggacattcagcgccggaataaaattgcttgcatcttcgttgacgaggcgcaattcctttcgaagaaaaacgttttcgatctatgtcgcgttgttgatgaactcgaaatccctgtaatggcttacggtctgcgtactgatttccagttgaatctgttcgagggttcttactggttgctggcctgggcagacgagatccgagaactgcggggaatgtgtcactgtgggcgtaaagcaactacggttgcacgtatcgacgcacaaggcaacttcgtaaccgaaggggcgcaggttgagatcggagccgaagacaaatacgtttcgctctgtcgcaaacattatcacgaaaaacttattgataatgttggtctgaactgttaaggtgtattcagacaaacaaaggagaacactatgagccgtacttaccgtaagaaatatgttccagtccgtgataagtcctctatcgaacaaatcgaagagacaaaagcattttcacagtattatgcacagcacggagaaagccctgatggtattcgttggtactcaaccaactggaaacacaaatcaggttgcgcatatatccgattcgataaaaacctgaatcgtgacggtaacaaagctcatggtgatatctccgcgatgctttcgatcgcagtcaaaaagattgattcgaaagtacgcgctaaaatgcgtcaggagttacgccggatgaaagctggcgtgattggatgggatgaaaatatcgagaacgcaaataagatccgcgcttttgagcgtagcttatgctggtatgagataacttgatgtatttttagactaattttacataaggggcgattcgccccttttttgctataaatatatacaggaacggatctattgttgatccgtgtgtacgtagagaaatgtttatgaacattaaacgcatatcacaagcgatgatgtttggattgttaatcttgtctcctgcatcacatgctgatcgaaatactgtcgtcccgaaagagttcgactattacatcaatgcagcgctacaggtctatcttgacacaatccctcccagtgtaaataccagtgaattgttctataactatatggaacgaaaatggcagcaaaaacaatgccgcactgaaccagaatgtaaacacctgggctatagggtggcaaacgaatttgctactattcatcgttcgtaagggatgaaagatgcaaacatttaacgaagtaacagatcgtgataactcaagcaaagtagatgcctttatcggtatgtgtctgatgtctgtaacatacatgcatagcgcacactttgcgaccggatcgtattctcaacataaagcgtttgagagtttttacgaagatatgcaggatttggttgataaattcaccgaaattcatattggtatcactggtcgatataaacccgtattaaaaacagaaaatgtgcttgacacggtggtgtatctccgtaaaatagcaaccgaagccgacacaatctatgattcagtagatagttcattgaagaacattctggacgagatcaaaggcttgtgctatcaaacgatttacaagctgacaaaactttcttaaaaagagtttgacacgcgaaaaagtgatgatagaataactatcgaattgaaacataaacccaatggaaataatgatgaacttaaacactatagtaaacaacccaaagaaaaccactctgatcgctctgggcgtaatcgctgcactgtggctggttccgaactcgtacactatcgttcaggatggtacggtaaaaactcaaaccttcatgggtaaagtttcaccgaagcctgttctgcctggcttccacctggtaaacccactggctgatttcgaggtgttcaacaccaaagacatcgcaatgaagtttgacaaattgcaggttccgtcccaggataaattcaaatccactgtggatatgaccgtgatgttgcagttcgatggtaacaaagccccgatcaaccgtatcaacgcgggtaatcaggatcaggcgcttgataagtacgtgaccgaaaaacttctgtcaactgtccgtgagttcggtaaatctgtaccgaaagcacaggatctgtataacgcagaagttcaaagccagctacagatcgcaattcagcaggaagttgaagagtatgcccgtccttacggttacaccgttaaacaggtattcttgcaggacatcgacctgccggaagcgattaagaaacaggttgaaaacacaaaaattcgtgaagaacaggtgaacgcagaaaaagcagaactggcacgtaaagagcaaatcgctcaacaggcagttgttcaggcaattgccgataaagaagcccgtagcaatgctgcacaggctaacgagcgtgatgctgatgcccgtctgtatgcggctaagaaagaagccgaagcgaacgccgtgttgcagcgtaccattacaccagaaatgattcgctggaaagaacttgacgttcagatgaaacgcgcagagaaataccagggcggtgttccacataccgtaatgggtgcgggttacgatggacaagtgattttcgattctcgtaaataaggttttaaagcccccgctctgggggcttgactcctaaaacgagaatactataatgaacataaaacagatcatccttactatcttcatttcgctattcttcggctttattggcggttttcttggtgtattggtgattgcgtctgttttatgattaacctttaaacgtggagcacgttatgaaacaatttgataaagctgtcgtaattggcagattccaacccttccataatggtcatgcagcaatggtgcgtaaagcactcgaagaagcaaaaaccgtttacatccttctgggttcagcatatgcttaccctaacgttttaaaccctctgacagcgcgtgagcgtcaaacaatgatcttctcatggttaaacgctaacttcccgatcgcagatgttatccgtgttcagtttgagcacatcccagattatctttacaacgaagagaaatggaaaacttctgttcgtaccgcgatcagagaaaccaaaggcgacaaaatcgctatctatggttacgaaaaagatgcgggttcatactggcttaaagcgtttggatggacacacgtacctgttgatcctgttcaggttgacggcaaggatctatcagcaaccgatctgcgtccgattatcttcaaccacaaaaacggatgggataagaaactgttacgctttgttcctcaaacaaccgtcgattatatcgacaaatggatgatggaagacacgttctggcgtttattctacgaatacgagaaatgggaaagcgaattggagaaattcaaaaactacccataccccgacgcgctgaactgctgcacgggtgatagtgtggttgtgtgtaataatcacctgctggtaattcgtcgtaagttcgcaccaggtaaagacgcgttagcccttcctggtggacacaaaaacgcaaatgaaacgttcctggattgtgcaatccgcgaactgctcgaagaggtgcggatcaaggttcctgaaaaggttatccgtggttcaatccgtaattcgatgctgttcgatcatccgaaacgttccgtatacttctcaaaaccgactgtggcgcagtacatcaagttagaacctaacaatgatggaagtctgccccgtattatgggcggttctgacgatgcgttagacgcgttctggatgcctatgcacgaagtcaaacaaaatcgtggtgagttcttcgatgaccactatcagattatcgtagcgtttacgggactctgataaaagatgaaaaaagcccttgcgttcgcgtgagggcttttgtattatatacacataccgcatgaataatgaaaaggaagaaaaatgaatacgatcaacgtttctaaagctgatgttatgaaagcaacgattattgctaccgaagccatttcattcatggctaagaaagcaggagttgatggtgctgttatcctgatggagattacaaacaacccagaaggcaacaccgcaaggtatttcaaagatcttacttcctatgcaatggaagaatttaaatgattaaacgtccttactgtctcgtaaaccgtccgatctgtgcgggtggtttacccgtcaactgctggcagttggttgaaacaggtgaagcgttcctgaataaacgcggtgataaagtattcgtctatggtgtggactcgatcgagaatgaaacgatggtgatcaccgacgagaaaacaaaagaaaaatatacgttgacttccgaccacgattgccgtaacttcaacgtgtactggaaatctaatgaagactttgaaggaattaaatcatgaaagtagcaacccttagcggtatatctgatgtaaaatgtcgtatgtcgctggaacccggtaatcgtgtaggaatcaaacacacgggttcagtaggtacgaagaattttactttgcaatctgttgcgcgtgataaaaacgatatggtttatgtgtttgttacagaaccgatgtcaaataatatccgtcaaacactggtgatgaaactgggaaccaaagatcctgcaatgctgatcggtggaactgtagagcctgttactgttgcgagcgtcacacataagggcattgaatgcgccgtagacggcaacggcaaactgtcctatgaagggactaaacgccaacccgtcgatcgtccggttgttgttggagacatcttcacgtcagaacgccgtgaataccatgttgaatacatcgcacaagatggttctctggtttgtcgcatgtactcccgtaagagcgcagacgataacaaatacatgggattaaccgtcattgatggacgtgacgcgatcctgctggattccctgaatgttaaaattaagtttgcatactcatgattcacacaattagcgttattatgggtgatgtcgtaaacatcaacgggcacgattactacgtagcggaaatcaatacaaagggtaatcgtgagatcctggaactggacattgtaaggccgtccgaagggcaatcccttacgatcgaagtggttcataacacgaacacaggggaagacgtagtgaagccagttctggcacgtcttccggtgttctactgtgaaaagtcaaaacgttggaaaatgaaatgatagatttaactgatgtgaaagtgggtgataccctgtttgatcctggtattcgtcgatacagtcatcacaaaaccccacgacctcgcaccttgtatgtgatcaaggttgcccgtcaatacctgtatgcgtcggaagatccaaatatcaccgatattaaagatttccgtgttgagcgacttgatcgaaaaacaggtagcgctaatgactggaataatcatacacagggttatcatagcgaagacgaatacaaagaacatttgtaccgtatcgaacttactgataaaatcaaagacgcgttcggtcgtggacatgtaacgcgtgtaccaaatatcactaccgctgaactgcgcggtatcgcaaaaaccctgggggttgaattttgaaaactgtaatggaaaccgtgttcggttctcacctgtacggactgaacacaccgacaagcgacaaagactataaagggatctttctcccgcacccgcgcgatattctcctggggaaagccccgaagactattgacaccagcacaggcgataaaagctctaaaaacaccgtagacgacgttgaccgtcagttgtatagtctgactaagttcattagtcttgcgtgtgatggtgataccgtagcgctcgatatgcttcacgcttcggatgacaagctgatcgctaactctcaaatctggcagtatatccgcgctaaccgctggcgtttttacaccactgaactaactggcctgttcggttatgttcgtaagcaagccgcgaaatatggtgtgaagggttctcgactggctgcactgcgcgaagttgtcgatgtactgaaagaaaccgaaacgatcggtggtattcaggaattcacaccagatatgaaacgctatacgcgtgaagtgaaagtgtctgacatcaaggatcgtttccctacaaacgagttctgtcgattcgttaccgacacaacaatgaaatctggttgtcaggacttctatgaagtgctggggcgtaaattccagttcacgatcaaagccgatgaaatgcgcaagtcagtgtataaactctgggatgaatacggagaacgcgcacgacaagcagaagccaacaacgggatcgactggaaagcgttaagtcacgcgttgcgtggtggtatgcagttgatccagatttacaaagatggtgatatcgtttatcctctgcctgatagcgcattcctgaaactggttaaagctggcggtgtaccgttcgcaaccgtacaggaaaagctggaagaagtcatgggtgaagtcgaacgccttgcagcgatttcaacatatccgaaagaagttgatcgcgaattctggaacgatttcatcgaacgcgtatacagcgatcatgttgtggggtattacaaatgatgtatcctaaattgtccggcgctgaaattgatgttctgtataaactttacggatacgcaactaaagtgctagacttagatttcaatgacgtacccagcaaatcagggcgtgattccctgattcaaaaaggttacgctcgaagagtaacgggttatcacgataattcgaaagcatggttgctgattaccccactggggattgacgcataccgacacggtattaaaacggagtggtactaatgactgatgttattttgaacgttaaagatgttgtactgggcgataccaaaaacccagacgcagttacactggaacaggctgttgttcagattatgcgcgatagcctccgactggaagttactgaacgcaccgaaagcaattacacgggcgggattgatggtcgccagttgtacgaagatagcaaacacgttaatgtaaccctatgggcggacattgacgaaaactcatacaaaatcgacgagattgattttgacgtatgaaaataattgacctctgcgctggtgtgggcggggttcgattaggatttgataaggcgttcggcggtgtcgaatgccttttaacgtctgaaatcgacaagttcgcacagcaaacatatatcgaaaactggggcgatgataacctacagggtgatctattcgccattgatgaaaacaaagtgccggatcatgatatcctgctggcggggttcccgtgtcaggcgttcagtaaagccggattgaaactgggcttcgatgatgtacgcggtacggtgttctttgaaatcctccgcattatacgcgctaaaaagccccgtgtgttgttctttgagaacgtgcctgaactgctaacccatgacaaggggaagacgttcagaacgatttacgggcttctggaggccgaaggatacaacgtattctatcaacgcctgaacacaaaggatttcggactaccacaaagacgggaacgcgtgtttattgtctgcttcctggatgatgtattcttttcatttcctgttcccccgcgtacacctacacgcgtaggcgacatcctcgaagatgctgatgattcattcaccctctcagataacgcatggaaaggctttagagagcgtaaggaacgaaataaggcaaacggtaagggtttcggttatcaggccgtcacaagcgattctgcgcacactgggacgataacagcgcagtattacaaagacggtgttcaatgtctggtattgcaggacgggaagaaccccagacgattaaccccgcgtgaatgtttccgcttgcaagggttcccagattcatttatcataccggatagtaaaaaacaggcatatcgtcaagcgggaaattcagtttcaatacccgtgattgaagccatagcgaaacaaattaggaaagtattatgagaaatcaaccagaaatcccgatcgataccgttgttgaatggcattacaaccactgggataatgatgaatggtctgccagccagggcgtattgaagtatcataaaggaaacttcatcctgatcgaactcgaaggtaagccaaccgtgctggacggtaaagatttggtaatgcgtccgtacaaagaaagaccggaaacaaaattcttcaaaaaagtgtttgcatccagtagttgatagtggtatcttagctttaacgaaacgaaactgaaaaggaacataccatgacttttaatgacctgtttaacggatgtactggcgctggtgcgaaattcaatctactgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgcgttcgcagagtctattcgtggtgtgttcggacactgattaatcaagccccgaaaggggctttttcgtgaggaaattattatgatttacactgttgaatgtttggttgattatgaacctggtaatctgatctgcgcgtctgataccgttatggactgcatcgacgcggtgaacaatcacgaaaccttcccgtatgttgcggataatctgcatttcactgcgtggaaagacggtaagaaagttgcggttgcttctttagtaggaaacagagtaggcgatacaataggcgctaacggctatgaacctaaccctgtgacatacgaagaagtcattggtaaaatggaggcggtatgaaggttaaaaacgccgaacgctgggagaataccaacgaaatgttcttcattcgttgcaaccgtaagcctctcaaatgcgggtatgacgacatagacgaagccctgagcaagtttaacgaaatcatccgttcatccgtctaccgtagcggggaacatcctggcgacctgtgggaactggtagcaaaagatccttacagtaacatcgtcctgaaatccgaaacaaaaggtaaagtatcatgaaaatttatactgttgaaagtttaagcgaagattactatacatttagtgatttggtcggttctaccgtatcgctggaacgtgcgattgaaatggctaaaccttttgactgggtgagtatcactgaatgcgacggctttactggcgaacgtctgcgcatagtaacactgagcaacgaaaaagccattgcgaacgcaaccaaagaaaacttacaatttgaggatgtaaaatgaaaatccgttctggttttgtgagcaacagttcatcaagtagtttcatcgtccggttcccgaaagatccgactaatatcgacaacctgcgcgaaatgatgggcgattgcgtccctgattgtggttactacgatccgccgttgacagcggaagaagtggtcaatcacgttcatcgtgacttaggtggtcatctgggtaatagctttgaatcgttctacgacgataagcgctatgactgggaaaccgaagaaagcgcagaaacccgctaccgttcaaaccctcaaatcgcgcttgcgtatgacgggcgagactggtacgatctggacacagaagagaaagacgctctgatcaaaatgtggttgtacgaagagtacaacacgaagttcggtaatcaggacggcgtgtttatctatgaattcacgtactccgatgaatgcggcccgatcggaactcaactggaacatggaaacatcttccgtaaccttgaacacacatcaaagagtcatcactgatggataataaactgaaaacagaagtttgtgttgttatgcctcgctatgcattaggggagtcgatcccctttagccaggatcgtcccgcaccgtttgatgtattttctttgcgaaaatatcttgaacgatttgaactgaacgagtatactctccaaatcgttcgggtatggaatccggtaatgtatgcgcttgcgtttgacgttgctgaatccaaactcactacgatggatgaatacgttgaactcctggcgcgtaagttcgggtgtgatcgtacagtcgaagcagtaagcaataaagttaacgaaattttagaaaaattcaaatacgagaaaatttaaatgtcaatcacaaatatcgaattcaaaaacgctgtatcgaagccaaccccgacaaaccacgttttcgtgtgtgacgtatccggttcaatgtacaacgaactgcctaagatccgtaaacacctgaaagcaaacctggcgagtctggttaaacaggatgacacagtttcgatcctgtacttctccagcaaaggcgattacggcacggtgttccgtggtgagaaggttagcaatgtctctgacctgtctaacatctgcgcggctatcgaccgttacctgaaacctacgggttgtactggctttgttgagccgttgaatctggctgcggaaatcgctaccgatctgcaatccgaaaacggcaacctgaacagcctgatcttcctgacagacggttatgataactgctggcgtaccgatgatattctgaaagcgtgtgcggttctgccactgactttcaacagtatcgcgttcctggaatacggttattatgtaaaccgtcctctgctggaaaaaatggcagaagcaaccaacgcattgcacaaattcgttgaaggtttcgacgcatacgaaccagcatttaacgaaatcatcaccgcgcagacttccgcacgtatcgaagtcaaagttgctgatgctacccatgcgatctacctggacgaagggcgcgtgtatgtcctgaacgctgcaaacggtgttgtgctggttccagaacacatcaaaaacatctgggcgctgggtgaaaacgcgattaatgatgttgacggattcgatccgaacatcgccagcgaacagcaagttctgtatgtcgtgctttatcatgcactgcacacaatgaaccctgatctggcatggaaagtgcttcaaaagctgggtgatgtccgtctgatcaaagcgtatgacaactgctttaccaaacaggactactccaacgcgaaagacctgattgcacaggctgttgtagatccatcacagcgtttcgttgatggtattgattacaacatggttccagacgaaaacgcgtttactctggttgatgcgctcgaactgctggcacaaactgacacagtgatcgacctgtcttctgagcactgggcgtataaccgcacaggccgtcagactgtacagaaagaagatgatacactggatcaactgaccgaacagatcgcaaacgctgcaaccccagaagaacgtaaagcactggcggcgcaaatggtagcgcatgaagtctggacaccgaaatttacccaaaccacaaccaaagtatcggttaaacatctggtgggtaacagttcccgtccgaacatttccatcaacacggatctggaagggtatgtgactatcccagaaagcaaacagaaagaattcggtctgccggaaaaagtcgaaactaagcaggtgcgtaacttcaccatcgttaaagatggtatcgtgaacgttaaagttctgccactggaaaccgatattccgacactgaaaaaccttcgtgcttctggcctgactatcaagccgctggaaaaaatcggtgatgatcgtatgtcggttctggtagactttacctctctgcctctggttaaccgtggcatgactcgcgggttaagcggtaaagagttcgtgactgataacgtgcgtctggaaatcctgaaaggccgtcagaaggttatgaagttcttccgtgacaacgcgatcggactgcgcaacgcagaagggctgaaacagcgctttggtgaagctgcgggtgaatggctgtctgaacagggtattcgtgattacgggttctctccgaaggttgagcgcacagaatcgactgatgtttacatgtcgaaagaactgaacgtgaaaatcaagggtgtttcctcccttcctgctgtagcggctaccgtcgcgaagcgtgaagaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgcccgtttaagtcgcgtaatgtacggtgttgtagtagcccatgcatggttcgcggatctggacttcgaagaaaccaaagtttctatcgctgcaaaagatattcttccgaaagaagataatattccatccgatttctggaaagtctgggaaaccacatcattcgaatgtgaaatcgtcctggaagaaaaagaagtcaaaatctaacaatgaccgcccccgaaagggggcatattgaggaaaataatatgtcacgtaacgtattctggggtgaagttgtaaaaggcgatatcctgtacctgtccgaaccacaagcctatcgtgaaaacaacgaaaagaaccacgcatacgcgcctatgctgccagatttcgtggttgtcgatgatgtctttgtcggtgaaaatggctggcagatcgatttagtcggattcccatacaaaaagggtgcaatccttctcgaacttgaagatcatcatttcttcgcccatgttggcaatatcgaagatcatggtgatttcgatatcgaagatatccgcgaaaagccgtatgtgttcagcaactactacaaggtcggtggacacctgcgcagtgataacaaaactgttctgtatctggatggtattctgtctgggatgcataatttcagcattgagaagccaggaaacagcgcagaactctaccgcttgtttggaaagtacgatcgccagaatggtaaactgttaccgtcagaaatggcttatatcatcaatcgtctgatcatgggacttcacaaaacattcctgattcactatgatggtgatgtagaacaggcgatgactactgtgattgacatcctgaaagcaaaatctcgtgaaatggataccctgccaaaatgacattattcttcatcattgcgttaggtgtgtttattctgggcgctacgattacattcatggcgttcgataaacgcgaatatcaactggctatcatcgggcttatagtagcttgtatcccgctggtgttgtcatacaacctgtatcatgagaaaatcgcagataacgcgaaatacgaggcaaggcgatgaagatccgttctgggttcgtgagcaatagctcaagcagtagtttcattatcgggataggacttgtccgccctggtaaagaacaggaagttgcaaagatttacggtgagtcaaacgttgaatcgctgatggatatgatcaccgaaattcatcatcgtccgcgctggggtgttcctcaagtacatgatgacggtacaatcacactggaagcgttcggatgtaatagcgtcgaaataacccgcatctgggacaagctgaaagaactgaatctggatgatgttaaaatcgttcacttcaatgagtgcggcgacgaaccggaatacgacgaggaaaccggaagttataactatgactggtatgacgacgcggacgcattcgggccggaactcgaaaagaaatacaatctcctgagagataaccgcgaactgttcattgaaggtgatgttcgttgcggtggtggttatgacggctaaacgattggtgatctgttatcgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaattggaaagcgaattcagtgatgaagctggggaaatggctgctgtagcgggtgaatctgaaatgcttacagctaccgaaagcatggatgatgcatttaatcgcatcaagaaacaccagaaagaaaacgaaggtcgggatattcagtacatgctatcgttctggctggatggtgaaatcttctgtcatgctgctattgctgaggatactccggtcgatatgtgtcgtgaagaaatcgtgaagtacgtcaaatcttttatgcattaattaaatgagaattgaaaaatggcttatgtatctaaaaaaattgaaataatttcgtcgatgatgggtaaaactctggaagagatcgaccggattgggaagaactttaaagatgaagttttccgtttgcctgaacgtgaaataaatttaatcccgtatttcaacacggttaaaattctgatcgatcctagttttggtctaacggcaactcattacattgtcggtaatgctccatatatgttcgtgttcagaaaatctaagttgattgcgtatttcgatcgcgcgaatcttggacatattcgggcaatcatcgaccggatcgaccgttatgaagtagggaattacacggaacaaaccagacgcactacatacggaaagattacgagtatgctggaacaaaccaaacaattcgacggagccaacatcgaattgattgatgatctgctaaaaagggtcaacaagttcaaagaagcgtttgacgtaaagaaaaccgcgcttgctgaaccagaaacggtgaaagcgccaaccctggcatctttcgaagaaccagaaaccattccagtaaacacagcgttgaaatacatcatcgaaatcgaaccaacagatcttgatgcaacatgtaaagcattgaattctatagggattaatttcactctctataataaattcagttaacccaaaaagcccttgcgttcgcgtgagggctttgttatattacacatatcgaaacggaacagccaaaaggaacgagaacatgaaagctaaaatgatgaagttcgtaaaagactggagaaaaggcgcgacaatcggtgagagctacgtaatcgtagacatcgaaagcaacctgctcgaaggtgcgaacgttttagaagttcctcgttacggtatggttgaagccgctgataaagcaaaagaactgaacggttacgttctccacatcatcgaagcaatcgagaaggaattagcatgaacagcgtttatctgattgaagaaaccattatccagccaaacggcggagtgtatgaaaagaatatcgtgtgtgctgccctgaatgaacaagaggcagatcacaaagtgaaatatttaaatgaaaatgctgttgtatgtcagacgtattccggttatagtgttgcatatgcttggaaagcggttagtttagaaacccaaccatcttggttaatcaacctgaaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcgggggtcgtgaagtcgaatgtggtaatttcatgcaagcacttgcgcagttcattgatactgcgatcactcagattgaaaaacagggctgcatcgaacgccgttacgcaaacaagatcggaatgattgaatattccaacttctgcttcgaagtcgaagaagtgcgttacgacactatggacgaagtatacgaatatgtgcttcgtggtgaggaagtgattaagtcctataacgggacgaaggttatcaataaccgctctttcatcaccccgttcgaattgcgatatcaacagctaatgggctggatcgtgatggaataagaaaagcccctttcggggcttttttgttatgaggatgatagctggagtttgattctttctacttcttccggttcatcaatgatgctgtagtaaatcgtcacggtgattgcgttttcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggctacgtcattgttccagtcttttgttaagttgggatcgatatcgctatacagtaagcgaaggttaacacccattttatccaaccacctttagaaacgcctctaagcctctcagtgcaacgatatgctcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcgggtaactcttcctttccggtgcggtgtggttcgactgaaatcttgatctcattgccgtacagcttttcttcgtattcatccaccatgatatgatgacgattgagcacaaacttaatcagttccccgcattcagggcatttgatttggagatctacagtctctttgttgatactgtcgaacagagccataatgtaaacataatcgcgctgatgcttgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagcagtgcaacgtaaattgaacgttccatcgggcttccattcattataggttcaatctgtacggtattcttatttaacaaatagttggttttgaagaactcattcagttctgatttgttgaacaggattttgtacagtgtcaataagtcgctgaactcaatatcacgcacggtaacatgacaggacttgcgtaacagtttaacgatattttccatatcttcaatagacaccagatccaggatcgcgttctttgtatcctcgtctaatgcattccattcgtatctttcgccgtcctgcttgacatactggacacattcaaggaataattgttcactgttgttacgatgtttcgggaatttgaatcccagagtaagcgagtcatcaagggcatattcattctgcaaaacgtaatcagttacatgcatgaatgcttctgattgtccgctgcttcctttgattcggatctttattgcgttcttaccgaacgatacacaatacaccttagtgaaaatgttttcctgttcggtgcgggaataacccggatacagaatatctaaaatttcatccagcatttcttgctgttctgtgagcgtcttcccttccatgtccgcgcttgtgagtaagaaactcaactgatcgcgcacggtaaacatagggaatcgcttcactccaccagggagttttacgcggattatatcaatcattttaacctcaaaaggggctttcgccccttattgtcctgtaaccacaccacgaacggcaattgctgcaccttcgataagtgattgtttgaatccgtcccaaccttctttatctgcttcaacaagccagcctgttttataagcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgagacatcatcacgaatagctgataaccattcgttgaatactttcaggttacgcgcttctgaatccacacggaacgttagcgataattcaccattctccggtcgggtgaatcggatctggggtacaccgccattatacacgtattcataacccagtgttttaccaggcaactgaacaccaacgatgctcaaccccatattatacatcattttgtcacggaattctgttagcatctgtccgtaaacactatcaccaaacagggaagtaattaaacgagggcttaacgcccccatgattttactgaaacctgttttgttcagggacataatagctttatcaaccgtatagctgaatagcttgcttacgccccctgtaatagcgttcatgaactcgttcgggttattcgcgttaatggaactcatactaccatctattaaagtatcgcggatactcccgatcgtgctgtcgagaatgcgtgatgctggactggttgcgaatacaacactaaacaggttgcttcgctgaaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccaaatgtagaatgagggaaccgtaaactgtcgcccgtctggaaatcacgtataaaccatacaggaggtgatttaataacttcaatgttagttacaaaatcaaccatctgatcgcttataatcgaaccattagacacagtaggtgtaggaccatttcccgcaactgcattattaataagttttgccccggctgttgatgatgtattaattgtttgtttagctaattctgctatttcggcggcagttcctcctgatgtcgtaccataacccagcaccgtgaatagataatagattttgataagttctagcagatcataacgactttctataacgaaagtattgtaatacatctttgtgcgcttatcagagccttgaaacgctgctttcgtaccaacatcaactgcttctctacggtctgccaaaataccaccactagcagactcaatagcgccccagataacgtttgataccgcacgggataagcctttagcaacaatactatcggttgcatcttggtaacggtggctgttaacctcgttatcgttcaggcttcgcggtaaaagtatttgacaaatagggttgagcgtaccaatagtacggttattcaaaacttgtttatatcgaacgtttcctgtattcgcgcttaggatctgttgtgcgttctgtgctgcttgacgtagtgaacggtagttatctttactgcctggtgcaaatccaccagtgaattcatatgcagtgaacagcaagccgttattatacaggcttgatgcattataagcgttatcaatacctgctgcacgttgggaaggaaattccgctgttacgatcggttgagtcaacgcgtttttagttgttgcagcacccccagaggggatgccagcatttttgatttctgcaaatgattgtacagtgtcttgcaatactgtaattttcatttaaatttcctttaagctaatgcaatcaatggtttacggtcagttcgttgtactgaatgctgaaccgtgttgtttactgttttgttgttgacctgaacactgttaggcgttgtaggctgaacaggggctttcactgcttccggttgcttgtcaatacttgcactcgtttccggtactgcggtgatcttttcctgccagcgggagatcatatcacgatagcggtctttgtcgtcctcattcagcttgttcgaattatttttctcttcaagcgattctatgagtttttccattacctttttatcgttgcccgtcagattgtctttgttcaggatttcatcgccctgatcgaattcattatccgctttaggtttcgctttctcttgcgcggcttcgatctgtttggtttcgtccacgcgcttacggttagcggcattctctttatcaacctcagcctgtaacagtttggggttttcctgcaatgctttcagttctttcttcttctcttcggtgatcttttcttcaatagccacacgatcgcgcatctgttccaattgcttagatagcgctttctgtgcgtccgtctgttgcccgaaaccatatgagaatgtaccttgagtagccttaacctgttcgacaaccttagaacgtgcctcaaccactttatcattctgatcctggatctcctgctgtttcagcagaatcaggtcatcgggatcaatttcaagaccgtatttttgtttgtcgcgcagtgctgatactttcattccgcgtccggcgttggtaatcgtttcagatccggtatattcacccagagcgtaaatcagattaccgataccttccgtgattgcggttttaatggtattacccagaatcttaaatggttctactaacagagcttttaatttttctgctaatgttgcatctttatcacctaatttatctaatccgtcatctatactttttgccaacgcctttatattgttgaaatatgatccaaaaagttgtttggatgcttctccatcattaagcaaatcattaaaccatgaagcgatgactttacctaaaacttcaatagcaaacacgatactaccgataatcagagtccattttgcaaacttcgccagcgcttcgagagaataaccgataaagcgagccagaagaccggatgtattatccttgattgcacccagcaaagacaatattttcttgctgaatttcttctcttctttatccttatcgcggatcttcttattgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgatggtccaacaaaatctggcaactgttcagcaagtggttgctgatcctgttcgtattgttcctggaagccagcgaatttctctttgaaacgttcctcaaaggatttcacactgtctttgatgtccagtgtattcagcgcggtttcaagggtgttatcattgatatcctttaactcgcgcatcgaatctttatctaacgttgcctggatcttacgaacagtcggttgcgcctgtggttttggtggattctgcatccggcgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttgttgaagaccaatcgaaggttatcaaaagtatgttcatacttagcttcgctgattttcatatcatccagattaataccgatctctttcaatacagccattgctttatcgtcattatgataatgcaggtgaatcaaaaggaattcggtttctgctgcggttaattcgcgcggttgaatctctttgatgatatactcaagcaactgcattgggtctttcattgctttaatctgggtgaaatgacgataacccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcatcgtgtcggttaaattatatccaacatatgaaaagttcgctgataacgtctatcttgaattgttacctgcccttgtctcaatgagcgagaagaccatcatcaacggtacttctgaaacgttgatgcagatctacgataaccagttaatttatcagttgacagagaaaccgattatccaggtgtcgttccagtataaccagacgttagaacagcattactacggtgttctgtattcaaacgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataacgatatgaagttgatcacgccgcatatcgacgcatcaaacgtgcgtattcctccggcttgcctgagcgggacgtatgaaaccgtgtttgattacatccgtgacaacgggcagagcgtagattcgtctgacttctgttatctgtgggaagatggttccggtatctttatgaaaagcaatacggagatcctcgcacaaaccccgataaaggcttacaagttcaacgttagtaacccgtttttaggtgacactttggtattcactaaagcggaatacattacgcataaggataacactaccctgttagtggatgcaagtttctttagtttctcaatgacggataaaaagctgtatagtgatatcctggcgagtaccgatattgaaaacgcatggatcaccatgaaccggaacgcggtatatgagaacaacttccagaacccagacaaacaggggcaaccgttccaggcagtgaagtgtcaactgttatccagctatgagaaaaggattaagtttgatatcaatcagggtcgaatggatgttaaagtgggggcattgattgaggtgttaggggatgaatattcagggaagtatctgatcgttgaatgtgtccgcgacgtatcaaaagatttccacctgcaaacattggaatgtgtacaggtggcagcggctactaacgacaccagcaaaacaagtgaggcttaggccgtagtttcttcatgatagcccatgaacaggtcgaacacgttgttcttgttctgtttacgggctttcttgatattctcgtagttctcgcgaggcatatcaatcatgaagcacttctgacgcgctgtagcgttctctgtgagcgcaaacagttcatcttcggtgtaatccttgtttttgtccagatcgagaatgacgcattgccaggtgtcttcatcactggtttgctgcatcatcaccagtgcggcgtttttgaatcccagattatgcgcaagcatttcatggacgaattcacgatcctgatcttcataacggatttcttgtccttcccaacggataaggcgcacagtcttacttggttcatttttcataacgtggttttcctgctcataagttcgcgtaaacgtttcgtcggttcaggtgggtttttgatgatctcttgaatctgatcccacacttccggtgaaacttctttcctgtccatgataacaatattcgggttatcacagcattttccaaccataacacaacgcccacaattaaggcatattgtatccggtatcgttggagcgttatcaaggaagcgaccgaaatcaatatctttcagcgcttccgcaacccgtgcttcaacttctattgggtcatattctttatttttcatgctaacaattgactcccctcataattggtaggaacccgacaggcaaaaaacaattgttggtgttcccagtttttacgcgcctgttctggagtatcaccccatgcagcatcaaacccagttttcgcacagcaccagcgaagattcgggtcttcgctgatagtttcgaatatttcgagtttcttactcatttcaggtcaccgataatttccatcgctgcttcgatgttttcaacaccataaaaggtattcccacttacttcaaggagtttgataccaggaagataaaccccaaccagcgcaccgatagcatcgtggatagcgtagttgccgttttgaagttgatttgcagtgtgcataactttcatgatgtttctcctttcgtttcgatgtaggtaatgtaccattacattacccagaacacaagcattatttttcgatttcgtagcactcttcaacttcgatgtttaccagaggtacttcgatatcccatgaatccgcttgtgcatcgtatacggctttgtcttcgtcgttcagaggcagacaagtaacccaaccgtcagtaacgcgcatcacgcgcattttagaaaggctttcgagtgcgtccgctggcagtttttcaccaccgttacccagttgtgccaaacggtcttcatttaccagaacgattactttgccttcgagttctttagtgatttgcatgggatgttccttttgtctgtttcgtttcgatgtgtgtaatatacaaaaagcccctcacatatgcaaggggcttctttagcaaaaagtgctatttaaaacagatcagcgaagataacgtgaatgtcatccggttcggtcttatcgcgtcgaatcttcttgatgattggcaggaagaaactgaactcaggttcgcccttcttacgcgttttcgatttctggagtccgtcaacttccatttcgacgatagcgccgatatagtcatctttgttcgccataatgtattcgcgatccagttcaccacgttcttctaacgggatgtacacgcggttaataccgtcttcatcgtatcggtaatccgtatcagtcagaccggaacctgtgtttgttctggcttctcctgataagtcctcaaccacgaacccgccaaccttatgaggttctttggtgtgttcgtacacgtcaatgattcgcagttcgatcggtgttttgttcttcaacttcacctgatccgcaacgcgtgaatccttccatttgaaatcaacgtttttcaggattgaaccctctttaccgtcattgcggtaattgttgtaatcctttttcgcttccgcgtagttctgcaccaggatagaagggatcaacttaaccgatgttacaccagagccagccagcgcaccttccaggatagagaaacgatcgcaatatggttgaacactcggagcatcgccatagtatacttcatacggtacgatatcccagacaacataaacgatattgcgctgttcttcgtcgctgatagtacctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaacgctgtttgaaggaacgacagcagttttttcagcagggacataaatcagttctccatcaagtacaacatcataacccagatattcacgaatctttttcagatccttgtccagattcaccaaaccttcatactcattccccgcgcgggttgctttgcggatctggttctctaacagatcggacatacaacgcgcaccatcggctttaagctgcgagtaagcagggaagcgaatacgttttaaggctttctcgctaaacggcgtagcgaggcactgaggctgttctggaatgagtttcttccatacgcggttcggtaacgttgtacccgcaccacattccagatcgcggttaatgatacggcgaagaacttcgcgatcattctcgttcactgatgatacgatatccagcaaacgatcacgggctgcgttgcccgtatattttcgcgttgccaaatcagacatcaaatccgcgatagcattcgatagcggggttgtgcctggcttaccgtccacctgcgggaacttcttaatgtgaaacataatctgtttcgtgtacgtaatgcggaaaatctctttcagcagatcattacctgcattacgtttcaggatcgcttccttctctgaaattttcagagtcgaagcgagttcatttagaatctgtaagatcatgtaatttctcttcgatttcaaaccatgatttaactgactggtgaggcgaccacggggtttcacgttcaccacgcaacatatggaataacggcaactgactgatgacgttatggcattcgtttaagtttaccgcaagatcatcaacgaagcaaaccagacgattgccatatttggctttcgcttccaggtagcggtgtactttggtttcaccatgcccgacaaccatcacttctttgaatgcagaagggaacagcgtgttcaggtttgcaatacggttaaggcttgctgtaggagtggttcccagcgccgtgacagccacgaaatcatatttggctttcagacggttgataacaattaacgcatcgtcatacgcgcttagatagcgaataaacgaactgttattgtattcttccatgagaattttcgccagttggtgatcgcacccgaagatttcggtcatatcacggaatttttcatctgtaaccatatccagcgcgatatcggtcggcatgttgtgtttagacaaaaagaacgggaggccgctttgccattttacggcgatcccgtcaatgtcggtaagaataactggtttcaagatttaacctcataagaatcaaaaaagaataaacgtttgtttgcttcgattacttcaagaaaacggtctttctcgaattcgcggtgagattcgaaggtcgcgcataaaaaatcacccctgcggtgttgatatgtctcaacctcaacaatattctgattcagatcacgcgcccattcgaatacgtcactgtgaatatacgcagattcaaaatatactgagtatttcatcatttatccttgtacatataaacagcgtcgaagccaggaacatccagttcgactttatcgaaaacgatatctctcagcttacatttttcaacatagctgttgatcacgttaatgttgtttgcgccgatggtaacgtaatacacacccgctttgtagataacacccataatcagggtagaactcaaagcgccctgcgcgtggagtaatgccagcgggttaatcgcgcctttgaacaggaacgcgcattctactctttcatcataatctttcataataactctcagtcgaaaaatattgcgaatatgaaccatataccgaagaaaggccagaataacacaatcagcgggaaaatggtatgttttaaaagcaaagtttttggtgtgtgatatccgttatggcttacaccaaagcaccaggaaaaacgtgcggcgcagtatacaccaacaacgaggtatagaatgataccgacgataatcaaggctatcataacagatctctcaatcgggttaaatttcggacaaactcacgttcagtgagcaccgtttcattcatcttattctttcccattgaatgagtcaaggtactttttccggttgcagccagcgcacggcggaacccgtcattcaggaaaagagcattgtacgcgttttcaatcaggatttgatacgcttcggattcacggtgaatcggcatacccttccagtatagggtctgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtaaacggatgtggagcgaagttgctcaatgcgcatgatggatactgactacctgatccgatatccattatcgaataacctcatacactttattatttttgtcgatcaacttagcacccagcttacgaaggaaataatcagtaagtcccttgctttcgctttcaaagtgagcactgatgtaatcaaatccgccaccgtcatcggtagaaacggaaacatttttgattttctgtttgtgtgtttcgatcatttcaaaaacactactggatatataaccatgaggaaatcggatgtaataacccataatcaccccgcgaagttaacgagtaatgcagaaaccatacaacccagagcaaaaccaaaagcaatcaaagccagttcactattctgtttcattttcagcttccttcttcccttcctggcgagcgcgtttgcgtccagcacgtaccagagaatcatagtacggacgtttgcgatcgatgttgtcagtgcggtatgctttaccgtaatgactcgttttgaatccgtaatacttcacgctttaacctcgtaaggcttatggagtccacgcgccggatcataacggtcatatgttgtcccgttggttgatgccatgatagagacattctggcgacggttccagttcaacagagcaagaacgatacgatctgccgcttcaataaaatactttttcattagaaacctaccttccatactttttcgaatttgtcgaatattgcaccgatacttttcagatacgcggttgcgtcgtcttcagaatttgtgtacatcgcgaaggagtatcccccgaattcacgacacactgatagcggtttaatgctggtaatgttttggttatatacccgcatcttatcgatcattgcttcggtaatttgatgctcatgatattcgagaatatatttcatttgattgtatacccgtatttgttggtttctgcattcaatgcaatagccagcttattcagatccccgatatcaccctcaaggtctaaatcaatgctgtcaaccttcgcatcattataaagatcagtacccgcgtatgcatcaatttctacgattttcgcgttgtgttctcgaatgagattcattgatgcttctgggatacgacgcatttcgaactgaaacgttcttacttcaataccttcacgcatcacgctctctccagacgggttgttacttcacggttatagatccgcgcatactggcgaatgtcttcgttatcgctggtgttcttcgcgatatatgcatcatcttcggtttcgaatgatgcggggttgcgatcgtcgttcgacaggtacagtttaccgaagatatctttctttacagtctgtaccccaacaaacatcacaaaatctttttctatgttaatggaactcatgcttatttcccgaaaaggtggcggtcttgggggtttgcatcccattctttttcccagctactacgctcgcgatctttatagacaacctgaaccgatgcgtttttgagttcttcgatctctttgtcgcggcgacgtaacgcggtgatcagttcgacaatgaggtgttttgcatagcgatcttcgctgttactcatgaaccccattactttctgttctaattctttggtactcatgttaagccctcaaaccaaagctacgttttttgatgacggtgacattatgaacacctctgttattgcaagtgctggttttcagagtttcggctttacgcgcacccagaaacagagttttaacaggagtcacaggagcagcgataactacaacagcagcccaacgagcgccaacagctttatcagtacccaggtcgattacagcagaggtatttttaccagcagccagaacatacgcacgggcttcacgacgagtgttgaagcaaaccagttctttcatgttgtaagttttcataatgtcatcctcaaagttaagttgtcttgcctacgtggttaaagatacaagaaagtcggattcagtgcaagcattattttgcataaaaacgaaaaaagccgctacctttcggcaacggcttgatttttaatacttttcttcgggctggaacaccgcacgacacgcccacatagaggcttctttcagtcggtctttcgccttttggatttgatggatacgttcaagcatcgcatcgagttcttctgtagtgaatgaatcggtatctgataccgcgtaatcacttgaatactcttcatccagttctttgaagatttcgcccagggcaacttctgcggccttgatgcggtttactttgtcgatcttttctttcgagtggggcttatagccctgtacgtcttcaatcgccattatatactctctgtaaaggttcgggcgataacgtcgcgctgttgttcaggagtcagtgaattgaaacgcactgcatagccggacacacggatcgttaactgcgggtatttttctggatgcttcacagcatcttccagagtttcgcggcgcaacacgtttacgtttaaatgttgtccaccttccactttaacagtgggttgaaattcaatatcgacttcacgttttgcgaatggagcaacgcgagctttaccgatcactgaatccatttcgagggttttggataccaacacacgaacatcattaccttcttccaggtagattgtaccagtgtgtaaaccttctaaaatctgatatgctttcattgtattacctttctacgacataataacgtaacgggttgatatggaacgccagcattgcacgatccagcccgttagggtcagttacttcctgtttcagtttccacccgcaatacacgcgtaagcagaactgaacctttccgactttaagccacggcttgaagacataaagcccccatgccgaatcattccacatcaacagataaccgtgacgcgaaggatcggaaccaccttctgttttcgggttgcccttccaggcgaagtctgattgtgcttcacgccctaagacgtgataagcgaagttgtacgccttgttacgccacaaccagcctacacgttgcgcatacacacccagatcgcctaagtgataccggatgttagcccaacgccggatatgtccaccatcaccatcgatcgggttatcgaatgtttccatccaacggaaccctttaggtaagtgtccggtttcttcactgtagaacggaaccacaaaaggagccagcagaatagccagaacaccagaaagaatatcaaggggaaccagtacaaaccagcttgcgtattttaaaaagcgcatgtgcttctccagaaaaaaggctatccgaagatagcctgttgattaacgaactgctttgatgtacttatgggcttctgcaaactcttccataagagcttcatttgtgaacggaatatcgttcgatttgaaaccgccgctgataagatactggatgataaacacagcagaatcaacagatatcaactggtgatttgttggttcgatgtcagtacggcgaaccacgtttacgatcgaccagtcgaagaatcgacgatggcattgtttcttgctgttcacctgtggtgatgcaaagaacccgttcacggaatacgcttctaacgcgtgacggaacagagtttcaaaatcatcaatttcttcggtgaaaaacttcatcaatgcattattgatttcatcgccagaagtagtgatttcgcgaatttttggggttaactcaaacagcttttggagacctttcatatttttctcttttaaatttgtgggctggaagtttctttacttcaccccgcattccggggaacctattaccggataccaacagagcctatcgcatacgataaggttgcatattccgaaccatttaacggcattgcgctacgcacccgaattggagcaggtgaagggactcgaaccctcaacaatctggatggaaaccagatattctaccaattgaactacacctgcgtatttggtggcccctgctggattcgaaccaacaaccgcgcgattatgagtcacccgctctaaccaattaagctaaagggccggaatttttagaactgtttgcgatagatttcgcgaaccagcggatcaacatctttcgcgtacttacatacgtcttcgaactggacgatgtacgccatgacttcatcggcacgggatttaagtttaccctgatgcgcatcaatgatcattgctgtcattacgtcaatacgcgctggggcttccagaatttcgcctttgtcgaacagctttttggatttgctgacggtatcagcgataattgcttgaatagatttagccatttttagatctcgtagattgcctggattgctttgtaatgtgcggaaacgtattttgtttccttctcttttgcttctttttcggaaatgtaacccgcaaccagatcagggtcaggaacattcgccatgtgagcgcttggcagtgggatatatttacccaggattcgttctgccgcttctgctggaacgtctacgcctacagaaacaactttaccataaaaaggttgttccccgtgctggcgtacaccaaccacgataccagattcagatttgatttcggaaccctgcggacgcgcagtagcttcgatgatcacatattcgccggatgcttttactttcagttcagacatttctttactcattgttgttaaacactaatctggaaaagttaacatgaggttctaactcttcccgtttaatttgttccacgatacagccatatttctgtaagcgtgaaatccattcatcattaccacgatcgtatttatcgaggtaatacaccgctttgatagcgcctattgcagcataccattcgatatgttttgcgcagtttggacacggcgaagcggttgtgtacaattctgcgttgttaagcatgataccattagtatgcgcacttagcaacgctttcatttcagcgtggatctcgttatcgtttgaccatgctgaatgctcaggacggtgaaccgatttcagtttaccttcgtcattcagcatatgctcgttatgatcagcacaacggcaatcagaatcaaccgtattattcgaaccctgcgaaaccacacgcccgttcattactataaccgcaccaacacgggtcgatatgcatcgagaagcctggctgtgttgaatagcacggatcatgtgaagtagtttcatcggtcatccatatatttcagaatgtctttgatgaaatcgttatcagggttaacgatgtgatacgtagtacctgaacgtgtcactacttcaacaaacgatttgttcgccggaatcgcgtattcaacaaccggacttgttgcaatgtcctgttgaggatcgttatcaaccaacccaaacacacaaccataacgaagcatcgttggttcagtacataaccatgcctgatgaatctttctgattttgtcgctcataatactcccgcccatgttacgaatttagttaccggattccactgaatcccgaactgctgttcaacgatgttacgttgactcaaaatacccagaaggaaggagaactgaccatcgcggacaatcttcactgtataaccagcaggaattttatcagcaatgcgctggcctaactggttgagtttcagttgaagttcaacaggattctcaactttaacacgattacccagttcaaccatcacattttcattttcacgaataaccataatattctcctttgtttgtgcgggtatcttatcacacccgcactcactgtcaactgttttttagaagtcgccgtaatcaacctggaaacatgggataccgttcattcgccacatcccgactggtgtatccctgtcgtccactgcaagaacaggataatacttatcgagaatcttttcaacaagtatttgctcttttacgtgaatatcgtgacgatgatcaccttcttcgcgcatgtagataccatcgctcaggtcaacaccatacccaatcaggcttgcagcggtatcatgtgcgcactgtacagtaccctcacgcccagacacaacaacacaggcatagccagcggccttatacatcctgaacagttcttgaacaggagggttaggcggatcgttgatcaccttcgtaaagtcatacgggctacgttgtccgactttggttaatgtcccgtcaacgtcgaagataacacatttcggtttgcttggatctgcatagctcatagccggaacccagccacggagtttacggtactgttcgaacatcgcccagacacgggaaacaggtagagcattcacaccgcgtttatggttgcgtttcaggagttctacgatatcggcatcaatccattcgatatggaaatcagcattgaactctttcgcgatctctcgccaaccatcatgatctttttggtgcaaatgggtgttgtgaacgataacattcttcccgcttgccagtgcattacgaactgtatcttcttgcactcggcaaacaaacagttctttctcttcggtgaagcggtagccagtgagatcaccgccagcacaataaagggttttgcggatatcgtcgcgggaaacagtcaaagtgtttcccagttgacgtgctttttctttcgcccatgtagttttcccgctacctggtacgcctacagtaataaacagattcatttcacaatctcatattcaatcagttctttgttatgctcattcgttagattgagccacatatcacggttccagtcattttcgatccagagaccttctttgtccttcttcgcatcataaacctttccttcggttatgtcacggaaaaatgacttgattattttgacttgcatttctcagggtatcccacggtacacagaatgttatccgtctggtctttctgacgcttaacgtcattcatccagctacggaagattaacgaatcgggatatgaaagggcaacgtatgggtttccgtcataaggcatgacaaggtattttttaccgtcaatctctcggacttctgcaaccactttccatttcacattcaccggattcaccttagcggggagtgtaggcaaaatcttttctgggggcttctccgcacacccaaccaacagaacgcccagaacaagggctaacgttgcaattttcatttgtcgtactccgccatatactcttcgaaggacttattgatcttgatttcgatcagtcctggtttcttgaacagcaggtctttacgtccggcatccttgaccaactgctgatccttcgctttctgttcgacatagatcaccgtattggtgttgtttgtctctttgacttttttgatatcagcctgcaactctttgatatctttagccaattgatcattttcactctttagcgtgattgtcatgtacaaaagccctgccaaagacagggctacaatgacaggccacaccaaagaagttaactttggaaaggctggtaatgtcatttatattcttccggtataaactgttcgtagttcttcgccattaatgcaacgatgttatcgaccagcttttgcttatcggtatcatcgaaataacgcatcataggcccgaagataatacgaccgtcaggggttaagtcagcgctcagggcgatcgcgtagtctttgcgtgatttgcctttcgtgtcttcgattgcctgaaatgcttttgcagtcagacgattcagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcggtgaaggtttacataccagttggttttcgctttcacaaaacctttatcagttttgatcacgtaaccctcgaaaccttctttcgtgtaggcttcggtaatgaacgcatccagatcggtgatttcgattttctcgcgctcaaccaggaacggacgtaatacaccatctgcgaagatatcctgataatcgacatattcgcccgtgtcgttattacggatgttcaggatcaccactgctggttcctgatagccaattacaatacggtttgtcggtgcgacgtattccatgttgactgtgaaaccatcgttaaccagttcggtcaggcgatcgaacaatgcgcggttagtctggatcacgctcatagcgtccatagcctgttcagattgaacggatgctttagacttaacacccagatagccggaatcgcagaaggtagagatcagggaaccatcttccttaatcatcacatccactacggtttcaccaatcgtcacaggagaggctttcagtgcttcccatgcctttacctcggcatagttgaaaaacttctccatagggcgactgacgagttttacgggggtttccccatccatcgcaaacatgataccgcgacattccagcgcaccaggttttaaccagtcggaatagctcgccatgcgatagttaaagatgcgaacaccggtttgcatcacagttttttgatcaatgaagtagaagcattcgctttcgttacacagcgtcattagctggttgaatagggttttctgatttttggttagctttgtcatagtgctgtttgttccattcaggattgatttttcggatcatgtttatttcaaaatcatgatatgtgtcttcatcgtgtgttgtcacgataagatttacacgcttactttttttgattgccatttccagacgtgcggttttcaaaatattactggggtttgcttcccgccagtatttcgaattgcggtatgtgtctaaccgcttccacaaatcacgacattttccaacatacactatccgaccgtcgatttcaataaaatacacacaatgccggaattcgccacatttaacgaaactccggtctatcctcttgtctgaacccagacgcaaaggaaatattacaccaaatgttacatcgtccattatatatccaacttattcacctttccggtcaacacattgacgcagtgagcaatataatcaccgtggcacggtagaggtttgcatgtacatcctaaccgcttcccgtccaatgctttcagttcgtcgattgtgatcacgccagttcgaatcaagttttggaaatacgggatgaagttcatgatgttttcagcccgtgttcccttgtagaagggattaccgaatttcgtacctctctgaatatcgacatcccaactacctttatacttgtttacgacgcgacaatcaagcgtatttttgtcgccattttgcataggcttcgtcgctgatctcggtgttgaggttgccaaccaggtaagaactcacttctacttcttgtggggctacctgtacgttgtcagacttcaaccatttgttcatccacggatacgggttcggcgttggtttaaatggagactgcaagccaaccgcgcgcatacgctgatctgtcaggtgttcgatataggcaatcgtacttttcagggatacgccgtctacatcaccgatagagaacaggtgttcagcccattctttttcctgttcgtacacttccaggaaaatctttgtcgcttcttcttcgtactggtaagcgatttccgccatttctgggtcatctttacccatctgccagagtcggatcttgctttgagtgcctttctggtgaagtgcttcatcacgggcaatcagacgcatgatcttcgcgttaccttccatcttgccttgttcggcaaagttgaacgtgaaggtaaacgacacgtagaagcggatcgcttccagagcattgacagcgtgcatacacagatacagagcaaccttgcatttacgcatttgctctttgcgtttcttttcgtactctgcgatcgattcgtctgggtatccgtgggacgttaacatttcgattttgagcacaatgtttttcagttcatgacattctgcgatcagatcatcgtagtattttgtcatggaagccgaacgtttcatgatcgcttcgttgcgcagaattttatcgaactctttcgacgggtcgatgtgtaggttgcgctgaatgtgcgtataactgcggctatggattgtttcactgaacgcccatgtttcgatccacgtttccatcgagacatcggaagcgatagggaggaaagccaggttagggccgcgcccctgaatggtatccaacagggtttgatattgcaggttcgaatcgaaaatgattttttcgtgttccggcattttcgcgtactgcatacggtcgatcgacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttataaaaagcccccgaaggggcattgaatcaaattttgcaaccttcgcaatcttccgcttcttcctcacctgcaccgtcacgggtgttgtggtagtacagcgttttgatgccgaaatagtttgcatacagcagatcttcaaggatgatttcagatttcactttaccatctgggaagttagccggatcatagtttgtgtttgcagagatagcctgatcaacaaacttctgcataaccgctacgtgcgacagataacctttgtttccacgttttgccattgtccagagataatcatagaagtcaatctgattattttggtttggtactacctgattgaatgaaccttctttcgaagatttcacactcacagggccgcgcggaggttcaatcccgttggttgagttacttacctgcgagctactttcacaaggcattaaagcagaaagcgttgagttacgcaagccatgttttttgatttcaccgcgtaaccattcccaatcgcagttatacacaggtgatgccagttcatcaacgtttttgcagtaccagtcaataggcaacagcccttgtgcatatttcgtttcgtggaacagtccacatgcaccgcgttcctgtgcgagttccatagaggcaaccagcaggttaaattgaaacgcttccatcaactcatgaacgtttccggcgtatgcttcggagtagtcgcaatagttgcttgccagccaggatgcatagttggtgatacccacacccagagaacgacgctgtttggctttcagagccgctgcaacagggtagttctggtaatcaagcaagttatccagtgcgcgtactgcgatgcgtgtaagggctgggaattcgcttatatcggcattatcgagaacgatcgccataagcgtacacagtccaatttcgccagccagtttatcatcgtcatccagtggtgaagttgggatcgcgatttcacagcacaggttcgacatacgaacaggaacagagaaactaccctgctggtttacgtgatgactgttgaaaatgtagttgcgtccggtctgtgcgcgttcctgaacaagcaactggaacagatctaccgctttgatgcgtttcttgcgtaccgttgggtctttttccagactggtatacagttcttcaaactcagtctgatccgcttgatagaacgcgtcatacaggcgatcgttcgcaacgtcagggctgaacagagtgatgtaatcgttattgattaagcgcttatacatcaaatcgttaagctgtacgccataatccaggtgacgaatacggttttcttcaacgccacggttatttttcagaaccagcaggttttcaacttcaagatgccagatcggataatacagggttgcagcaccaccacgaacaccaccctgggaacaggatttaaccgccgtctgaatgtgtttccagaacgggataacgcctgtatgcactgcttcaccaccacggatttttgaacccatagcgcgaatgtgtccggcgttgacaccaatacccgcacgttgagagatatacttcacgatcgcggacgtaacagcgttcagagaacccagagaatcacccgattcgattacaacacaactggagaactgacgcgtaggagtacgcacacccgccataataggcgtaggcaatgacagtttacgatccgaaatcgcgttatagaagtcaacaacatgactgattttatcagcgtgtttttcgtcctgatgcagacacatcgcgatcagcatgaatgcatactgtggtgtttcgtagatgtcgccggacgtgcgatcctgcaacagatatttcccgatcaactgctgaacgccagcatacgaaaattcaaaatctttatcgtgattgattttcgattccagataatcaatctccgctggagtccattttgtcaggatttctttatcgtattttccagcctcaaccagcttagtgatgtgttcgtagaacggaatcgggtcaaactgcccgtaaactgttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgccccctttgtttatactgccatagctgcttttagcgagccgtggtgattatagtctttcaaatggatggagtcaaagaattcttgatccaaatcaagtaagctatttaccttcggcatataaagggtcggaagtggaagcggtgcgcgttccggcttcaacaactctttcgcttgttctactgcgtttttgtagatatggacatcaccgccagtccaaaccagatcgcccacttcatacccgcaaatatcagcgataatatgcgtcaggagagcgtaggaggcgatattgaacggcaaccctaagaagacatcaactgaacgctgataccattgtagagacagtttaccgttgattacgacgaactggaagaaacagtgacacggacgcaaagccatatcatccagatccatcgggttccaggcagaaacgatgatcccgcgatcgtctggtgtggttttcagttgttcgatgatttttgcaatctggtcaacaccataaaaagaaccttcctcaccgaacgagcgccattgatgcccgtagatcggtccaagataaccatgcgtataacccagcgctttagcctgattttcgtagttatcgtcccagatcgtccgcttatcgctatcttcaccccacgtcattttacgcagtgtttccacgttggtagaaccttcgaggaaccattgtaattcatgcttacacggtttgaagaatagctgtttgctggtagtagctgggaaaccttctgcgaggttccaacgtgcttgcatcccgaagatgcgcagtgtaccaacaccagtacgatcggttgatgcagtaccgtgtgttagaacggtgttgacgatatcaagatattgtttcattttatgcctttttcgtatgtcgatcgacgataatttttctgacgcgttcgtttgactcgatctgctgaattttgaaatcagtcagttcatatttcagaaccgcttcacagaattcaggaaccgtgaatgaaacatcacgtttaaaagctggcgcattgaaagtgtgatgtccgtaaatgtgcgtcacaaccacttcatcaaccagtgtattattgattgcttccagaagcaaccccttaccgccaatgagacacacatcacgatctggatgcgttgctttcatcacgtcgattgcagcagacaacccgccgccgtggatgacgtaatcagcaacatcgccttttttggttttgaggaaactaccagaaccagacagaacgcagtgaattcgtcctggcaatttaccaggaagagaagtaaaagtgttcgcacccatgatcaggacgctatctgcggtttctgctttgaagttctgtaaatcctctttgcagtgtccccacggtaaaccctgttcataaccgaaagcatagtccatttcgtacatatcatgaccaacggcgaaaactgcttttactttgctcatagcgcgatccacattttgttgtcttcaatagtcacgatgtagcccatagcttcaaccatgacacgcaatttgtctttacaggcttcattgtacccgcgaatcttttcaaattcaacagaaaagatactcaaaccgttaacatgcgcgttgatgattttggattccagatcgaacaccatcacatctaacggactccattcaaccgaatgcagtttttcgcgggttaacagggttgtgtgttttggtagtttcattggggtacagtttgccatagccattgttccattttacgtaaatcttcctctaacggagtgaacccaaaggattcttcgatcacaccgtcttcccatacatcaatttccagaatttccgttaccggagggtttgacatcacatgatcacgacatgcagccatagcggtcataatggaatttgttactgtcagggtattgccctgaaccgatacctgaataatcatactcacctcataaaaaaagggaactgcttttcaacagttcccattatagcataatcagttagtgtttcaagcgccaaagagcgattgcttcatcaactgcttttttaatttcttccggcgtgtctttgcgtccggctttaaccagggcagagagcatagaacgaatggttgcattcatctgtgacttctcacgatccatctgtgcctgatgcgccttatcaaccgctggggcttctttcttcgctgcctgtggtttcgtaggctgtgcgcctaactcgtccttagcttgcgtttcagtgcgtttctgttcggcttctttcttcacatgaggtgctgagaatttaccagccttgaagttatcacgcataccttccaggatcttacgggctgtgtaccagtcagcaacaccacgaagttgtttcagggtatcaaccagcaaaccgatacttgcgcctttgctatcctcgtcaatgtcgatatctttcaaccattcaacatgtttctgaccggagtgcatgaaatcaaagctgctgaaactccagaaacctttacggttgctgatctcgcgtttgaagtggaaagtcaaacccgcgccgttatcaaactcaccgtagttactgcggaatgttgcccccgcctgtttcagtgcgttgaaatagtcatctttattgatgcggttaacggtgcgttttggtttctcttccggcgctggcgctgctgcttgctgtgcggtacgtttaacaaaagatgctgaacgatgccccgctgcaaactctgcgttcatccggtcgattaccgctgcgatgccgcttgcgtctggtttcactttctgcatttctttgaaagtgtcgatgatcatatccagacatgcaccgtcttcatcttccagcatagtacctttcagacgttcagcaggtttgaatttgttcaccgttgggtcaacaacatactggaacacatacgcgcctttacgcatgaatacgtgacggtagaagtgaactttatagtgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcacggcttgccattttgtgtttcttcgtaccaaccagaaccagagtattaactgatacgctacccagtgcggacgcgtccggcgctgctaaaccttgaccgttcggcggttgacaagagaaagagaagtcaaagaacgcatcaccagaggtgaaacgatatgtcgcgtgaacagtatgaccgcgaacttcgctgattgactgagtataggttgttggttgtccggtgaatttcgtgaagtattccgcgaactcttgcgcgttgaatttcgtgctgaaatagtttttcgcaaccacgaaatacgctgcaaatttttcttcccatgcttttttgtttgctgcgtgttctgcgcgaacatcactgtaagttttaccagcgctgtttgttttggttacaacgtcatacgcctggttgattttctgcatgagttcagtgctaccaccacggtcggggtgattgcgcagagaagcacgtttaaagagctttgacagttcagctttagattcgtcgccagtagcgcccaaaatcttcaatgcttcgctgtgtgacatttgttcgttaatcattttccgttcctcaaaataaaagcccatgtaactcagtacacgggcaactttaaggtatttatgttttgctgtcaatagattttttcgaggaaccacaccgaagatttattattcttgatgcgtgtcaattcaatggggttatctttgaatgcttcctcaacatctgccattgtaactacatgtttttcttccaatagttcattatggagataaaacctctccacttcgggagaggttttcaaatcaaattcacgttctaacatgttattaccatatctttgattgttggttttgtgaaccgtccagccttagacatgatgatgtggcggtcgaagtcctgcggatcaagatcctgatgactaattacaataacgttaccctcaatatcatcaagcaatgcccgaactgcaaatccgccgtctttgtccattgcaccatcaaatatttcatccagtaccagaagcgataaatcaacacccgatactttgctggttacatcacgccaggtcataagcaacgctaggttaatccttgcgcgttcgccttgactgaatgacgcataactgaaatcatcgcgccccagtgatttgatcgattcgttgaactcgtcatctaaagtgaactgataatcagcacccaacagatccagataatatgctatctgtttgttgaagtacggaatataacgcttaacgatgctcgctttaacgccggaatctttcaacatatccgtaacaataccacgaatatatttttccttgacgtagccttgtcgtttttcgttcagttctgcttcctgctgttgcaactgcttcacgggttcttcatcaatgactacttccgcgcttgcctgttccatgatcgcctgtgcgcgtttagcgttggcaacttcgttttgcagagtacctttcagggcttcatatttggttttcagggcattgagtgcgcgttgctgttgtagcaagtcattcatgatcccttgtaactcgtcctgtttggttttgatcagggttaaacgctgtgtacccgctttgatgttctctgcgatctccgccatacgctcaggagtgggtttaatcgcttgcttacatgccggacactcaccgcctttctgatacatcacctccagctttttaaactgttctacagtcattgagagccgcgaataaccatcacgaagtttgttgatatcttccgtccggtcttctccagtgatcaccgattccgcaatctccgcttgcaactgcataagctgtgctttgatgttctttgcggtttctacgtggctatcgtagatctctttgtatcgggcgttgttctggtttgctttcgctcgctgttcgtcaatgaagcgctggtgtgttgcgatctgctgctggatgtgattaccctgcattgagagtgtatccaactgctgattaacaccgcgaatgtatgacttgtttaacttgtccatttcactgatgacggacagagacagcaaatcttcaaccagtttccggcgttctggggttttcagttccatgaatggggtgtaacccgctgtacccagaacgataacctgtttgaagcccacaaggttgatgttcagcatagattcaagctgtgcctgataatcacctgctgcggagtcttccggcaacttctcgccgttcttccagatctcgaataccttcggcttttgtccgcgcaccactttgtacgagtctttgccgtattcgatttccagttcaaccaggcatttctttttgttgacgctgttcaccaactgcccgactttcagatcgcggaatgatttaccaaacagggcataggttaacgcctcgatcagtgtcgatttaccgccaccgtttttccccgtgatcagggttttctttgccgtatcaaattccagttcgatcggggtattcccgaccgacagaatattttgatacttaatttttttgaagtttagtttcatttaaaatccgttcacataattcagtgatcaattgaacaaccgatgaatcaatagtatatgatagcgtatcgtcgtccagtgtatcaagcatgaagattgaccatgttcgtgatgaatgccatgcacccttcatgatggtcaaacaaactgcgctgggttcccctgcttcgtcagaagtggcaatgatatgtttcattcccagcatacgcaacaggtgagaatatcgggggttcgccccgaaatattcatcataacggctatgcacttgacacctccgcgtatagttcgctaatcagcttattcacttcctctttttcatcgtcggtgatctgcatgttggcgatatactcagtgataaggccacgaacggttttgatttcaaagtcggtatcgacatccgaatcagtttgaactttgtctatgatgttgatttcataggcaatttcttcaatttttgtttggaactttgcaagcccctgatcaatttcactgacaatcagacgtaccgcacagttacggaactgttcaagatcaacatctttctgtgctggatacatgatccggcgatggtgacacacagggttagcgatgaaagtcaattcaggcttgcccgtgaacacatagaaaccgcgtgtttcgtcttcgtcgttagcgctcatagtcagaggcgtaccgatgtaaaacacgttgtcaccttcgttagcgtggtgatagtgtccagagtaaacgcgatcgtacttcttcaagaaatcaggttccagcccatgatcggctttgctgttcttgtagaaatagtaaccagacagttcgaagtgtcccaaacaaaagttagctttcgattgtttgatgtagtcaaaaatacgctggctgttttcctgacaaatccacgggatcaggtcaatcgaatttccgccacctaaatcaaccgtggtcggttcgtcgatgacattaaagcattcgtattgacttagtatctcgcgtggcgcgttggggcgtattttgtccttaaattggcaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactctacgatctgtttgaataccgcatacaggttttcttcgttccatgggttatcctggcgaagtccggcatgggtatccccaattaaaacatagttcatataaacctcaaaacccccgaaggggtttatttgccgtatttttcagaagccatgatgaacaggtctttcaactgttggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgctttgttcttccgcatgaacttttgcgctttgcgtagggcttcctgttcaatgcgtgtacccttgatggagtccagttcttcttcacgaagatccagcgctgatttttggtgtacttcgtcgattacttcatgctgcacgttcatagtaagtgatctccatgatcattgtttcggcgtttattacatagtccagacgaccttctgttatctggaagtctggatctcgtacatctgtagggtcgatgataatcggaatccctaagctctgcaactctaatttcacaaggtaaggaagcagatcaatttcgtcgttagcatctgctaaaattttgttcaggtcaattttaattttcatagaaacatttccaatgttggcgattcgtccacaacctcgattttatcttttggttttttcgcggactcttcatactgattaagtttgtcatggatatcctgaatgaaagtttcatcggctatcgtggtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcgtcaaagttatgaaggccggaaatcgttgctgaaattccatcatcgatcatatccattttccagtcttcggaataacggttgaagttgtatcgacgtgccaaaccgtgagcaatattcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatagttaaaactggttaaaaagtatacggaaatgtactgttttctctatatataaaatataaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggtgagtaccctgaaattgttctagcctttgatgataacaagtattggcgcagaagtaaagcctggtactacaaaaagaaacgaaaaatggaacaagaagcatcggattgggactgggatcgcctgaatggtttccttcacccgacatacgatgaaatccgtgctaatttaccgtacaaaggtatccgtgttgacttcgcagaagccgatgacgtgatcggtgtggtgacgcgtaaagcggtatccgaaggtaaacgtgtcctgatcgtttctgctgatggtgactttgcagcccttcaaaaatatcagggtgtgcgtcagtggtcgccaacccaaaagaaatgggttacgccgaaatatggttcacctcgtaacgatttgcgcatgaagatcataaagggcgataaaaaagatagtatcgcttgcattaaaatgcgaaatgactatattgttacgaaggttgaaggagaacgcgccccacaaatcagggctgctgaactcgaagcctggctggaagcggacgatccgactgtgggtatgcccgaagagtgggcgatccgctacagagaaaacgaagaacttcgcgactttgattttattccgaaagatgttgcaacggcaatcgaagaagcgtataatgctccaaaaatcgggaacaaagcaaaaatggagaaatacttcatggaatgcaaactcacccgtatgtatgaaaaactaagtgacttttgaggtaacaaaatgagtgtagaattactgcaagaaaacccagacatcgctaaagcggttaaagaactgatcaaagaagcgtcgaacgtgaaaactcagatcgaacatttccagggttctttcaaagacatcaaatccaaagcgaaaacggattatggtatcgacggtaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaacagtaccgaaagcgatcatcgacaagattagcgacgaagccattaaaaacaatctgctgcgtccttctgtggctaaagaccacgcgacgacgcaaacactggatgatttcatgtgaaatttaaaaccccgtttgacagttcagacgctaattcccgtttgaaaccgatcgcggtatacaaactgtatctggtgatgaaaaatcactttgctgggaagtatgacgcgatcaagtacaaatgggaaataaagatcactgaacaagcgttccaaaagagaaaggatagatattttttcgcaaagttagccgaaaggtttacattcaaagaaatatatcttatactactctgcaatatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggtattcccctctcaacggtgtttcagtatagcgtcaaatcatcaacctcgtatatcagcaaactcgtacagtctggggtgatttcttatgaatcattcttgatcctcgactcgtttttagacatcataaataaacacgatgaaatcgcaacggatttcgtctggaatgaatttagtaaaaaactaaacgcatacagaaaattagttgaaatcagtaacgaagaaatcgtaaaataccgaaacttaatgaaacaaactttaattaacttaaacgagaaataacatatgtcattctttaaacgtcaagatccaaccaaactgcaagaacaagtcgccgctctgaaaggttcctccggcttccagaaagatgaaaaagagtggaaactcactctggatgcacagaaaaacggttctgcgactattcgcttcctgcctaaccgctctgatgacgaactggcgtttgttcgcctggtgaatcactcgttcaaaaagaacaatcagtggttcattgaaaactgtccgtctacccacggcgattatgatggttgtcctgtatgtcagtatatctctgacaacgatctgttcgaaaaagccaaagccaataaaggcggcgaagctgataaactgctgggtatgattgggcgtaaacaatccttctgggctaacattctggtcgttaaagatccgaaagcgccggaaaacgaaggtaaagtgtttaagttccgtttcggcaagaaaatcatggataagatcaccgctgctatcgctggcaaccctgatctggatgaaccaggtatcgctgtaacttgtccgtttggtggtgctaacttcaccctgaccgcgaagaaagtaggcgactggcctaactacgacgacagcaaatttggtgttcctggcccaatcaaaggcatcgaagacgaagcgcgtcagaaagaaatcttcgaaggtatgagcgatctgcgtccaatcactgctccagaccagttcaaaccaactgcggaactgaccgcgaagttcaccaaagtattcggtggtgctgcaatgggtgctggcgcaagcgctggtgcggatctggattcagaactgaactcatttgacaacgaactgaaaaacttcgataatggcaaccagtccaaaggtgctaaagaatctggtggcgtaagtcaactgaacgtaggcggaagcgtaccggaagatgacaacacccctccgtttgacctggaaggtggttccggtgatgacgacctggataaactgctggatctgtaatgcttacgggggcgaaagcccccaatttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggactgattcacgacgctcgcgaagcgggtacgaaaatcaacgagtccaaaagcaaagaattccttgacaatgcggcggatcgcgttgtagaatccctgattaacggcacttttgcctaattgaaaactataggttgaatatgaaattctctaaacaaacgatcgacatcctgaaaaacttctcccagatcaacccgtctgtaatgctgaaaaagggttcgttcattatgacgaaatccatcaacagcgtagtttacgcagaagcaacaatttctgacgtaattgacgaagatgtaggtatctacgatctgaactcattcctgaacatgctgaacgttgtaggcactgatgccgaagtaactcacgacctgtccactggcgaaatcgtcattcgtggtgagaaaatgaaaatcgttgagcgttcaagcgatccaaccacaatcgtacagcctaagaagcgtctggaaatgccagttgcggatctgattttccagattagcgcgaacgatttcgaaaaactgatcaaagcgtcacgcatgatgaaactgaccgacctgtctgttgagccaatcaacggcaagctggtaatcaccgcgaaaagtaaagaaagccagtcaaccttctctgtagaagtgggcgattacgaaggtgataacatgttcaacttcgatatgaagattgacaacatgcagttcatcaacagcgattacaaagttgaaatctcttctcgcggcgctgcgaaattctcgtccgaaaacggcgttgcgtatgtagtggtacttgaagcaaccagccagttcaagtaagataaacaaagtagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctggacgcatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctctatgacgcagaagaaaggcggtaaaatcattctgattgatgaattcgatcgccctggcatggcagaagcacagaagcacatgcgtagctttatcgaagcgtacagcaagaacgttactgttatcatcaccgcgaacaacatcaacgggattcaccctgcgctgatctcccgttgtccggtagtcaagttcggttccccgtcgaaggaagaacgcgttgaactgatgaagcaaatgatcaaacgctgtttcggtatcctcgaaatcgaaaaaatcgaatatgaccagcaggtgatcgccggattcgttaagaagcactacccagacgcgcgatccatcgttaaagctcttgggttctattctaagcgtggcaaaattgatgctggtattctgtctgagattgttggttcggacatcacaccagtgattgaggggcttaaagcgaagaacttcaaagcactgcgagccgaagcaatcaagtacgcgcctgagtatgaaactttcctggctaaacttctggatgcggtatacccgatcgtcaccaacgaatctaaggttgcactcattcaggcagtaggcgaaaacaacgcacagtacgggctggcagtgaacaaagagattcacctgcaatacctgttcatgggcttaatgcttaccctcgcgtgggaggcttaaaaatgtcactggctgcttttctcgatgaagaagaactgaacgaacatgaagcggcctggcgttctaaagactgggacaagatcgaagaacttgtgaaagagtacaccaaagacaaggaaaacaccttgtttatggtgctcgaagaactgaacaacgggaagacaccattacggatctctgcccttgattcatacgataagtttttcatcgacaatgcaatgagccagcatatcgaaacgctgatacctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacacgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgtatcgggatcgcaaataacaaaaagaaaatgctgtggcagtcttgccacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtattgactcacgcacaaaaagctgaatggactttgaaatacaagtaccggatcggacattaatcaaaagcccttgcagaaatgcaggggctttgttatattggttgtacaccacttgtgaggactaaattatgaaaattcgtattgaagaaatccttaactctctcaaaaaagaagaccacttgattacccgtctgcaccgcgacgaaatcgatctgtctctgacctgcaatctctcggatctgcgcacgtacaattacgcgcagaactacttccctaatttctatacccgtatcatgaatgaatatacaatgctggtaaatcagttgaattcgcttgagggacacgaaaaacttcgtgaatctgcacagcgttcacttgatctgatcaagctggctggggtatcattcctgtcacgattaaacacggagaaagaaaaccgtaatgaatgaattttatctatccgttgagcaaatgggcgatcacatctacgagcgcttcattgactctgagggacgcgaacaggttcgcaaaacaaaatatgcgcctacaatgtttcaacacgctatggcgggtgtagactcgccatatcgcgacatttacggcaagacctgcatcaaaaagaactttgaaagcatcaaagaagcaaaaaactggatgcagcgaatgaaagatgtaggcatggaagcgctaggcatggatgatttcaggctggcgtatatctccgattcctacagaaaggaaatcgaatacgatcgcgacaagatccgcattgcttcacttgatatcgaagttaccgcgcctgaattccctgatccacgcgaagcaaaatacgctatcgacgcaatcacccactatgacagcgttgaagataaattctttgtgtacgatctggtcgagggtggtttagatgaatgggtagcgtcgaaagttgataccgaaaacgagatcagcgaagaagatttgaagaaaattgtttaccgttcattccagaccgaaaagtcgctgatgtcggcttatatcaaagactggaaagagcggacgcctgttattgttacgggctggaactcaaacaagttcgatatcgcgtatatcatcacccgttacctgaacatcttcgggcaaaacgttgttcgtcatttcagcccgttcgggaaagtgactgcgaagacaacaaccgaccattacgggaacgaacaactgggctatgagatttacggcgttgctcaaatggatggaatggatctctacaagaaattcagtttcaccccgcaaccaacttacgctctgggcgcgatcgctgagttcgaaacaggtaaaagcaaagttgattacgaaggttcactgtctgaactgcgtcaagcggatcaccagaaatacatcacgtataacatcgttgacgttatccgcgtgttggatatcgacggtaaacgcaactttatcgaactggttctgtctgtagcatactacgcgaaaatcaacttccctggggttatgtcaccgcttaaaacgtgggacgcaatcatttacaactctctgcgtgaagagaagaaagtaatcccagaaaacaaacgccatactaaaacgccgtatgatggtgcatacgttaaagatccggttgtcgctccataccgttacattgtatcgttcgacttaaccagtctgtatccgtctatcatccgacaggtgaatataagccctgagacaatcgctaacagctttgcagtgcgtccgatgcataaatacatcaataagactgcgccgcgtcctagcgacgaatttagctgctctcctaacgggtggatgttccgacgcgatgttaaaggcgtgattccggtcgagatcaagaaagtatttgatcagcgtaagacgtggaaaaaacgaatgatggcgggtgagcgaaatctcgaactgattaagcacgaactcgaacacctgacggacgcgcacaaccaaatgatcaaccctgatttcgagttctacgaagatttcagtgatgaatcaaaagctgtactgaaaacgctgtctaagcaaatgcttaaagccgtgaagaaagtgtgtgagaagaaaatcgcacaggcgaacaccgcacagcttaaccgtaaaatcagtatcaactccctttatggtgcgttgggtaacgaacattttcgttacttcgatattcgaaacgccagcgcgatcaccatgttcgggcagttggctattcagtggattgagcgtaaggttaacgaataccttaacgaactgtgcaacaccacggattacgcatacgtgcgttactgtgacaccgactccatttatgtttgcatggacaacgtgatcgcgaaagtcggcggtgaaagtaagttcagggataacaaccattgggttgacttcctggataagttcagtaaagaacgcatggaacctatcattgataagggctaccgtgaactttgcgagtacatgaacaacgtcgaacacctgatgtttatggatcgcgaaatcatttctggaccacctctgggatcgaaaggtctgggtagtttctggacggcgaagaaacgatatgcggctaacgtatgggactccgaaggaacccgttacgagaagcctaaattaaagatcatgggaatggaaacccagcgaagtagtacaccgacagcggttaaaaagttcttgaaagaagcgatccgtcgcatcctgcaagaaggtgaagaatccttacacgaacacttcaaagtatttgaagaagagtataaggcgcttgactaccgtgaaatagctggtgtatcatctgctaacaatatctcaaaatatcgtgatgattttggatacccaatcaaagggacaccaaaccacatcaaaggcgttctgttctttaaccgccatacgaagggtattcaaggaatcaccccgatcatggaaggtgaaaaggtgatggttctgccgttgcgagataaaaacccgtggcaagctgattgcatcgcatggcaatccggtacgcgtttaccaactgagatcgaagaagatattttgaagtgggtagactacggcggattatttgaaaaacatgtgattagcccgttgcaaaacatcacggaagcatgtaaaattgattacgaaaaacgcgcatccctgaacactctgttcggtgatgactggtaagacctgacggggcagaaatgccccatttatataaatttgtgaggaagatattatgcgtgtatataaaccggaaaaataaatgtctaataaagcactcctgaaaaaactgatcaaaaactcgaatagtcaatctgcgtcaattctgtctgaaagcgatgttttcaataacatcaccaaaactcgaacccgtgtaccgatcctgaacctggcgctgtccggcgctttcgatggtggtctgacttccggcttaactctgtttgctggcccgtcaaaacactttaaatcgaatctggggctggtgacggttgcggcgtacctcaaagcgaatgaggatgctgtgtgtctgttctacgattcagagaaaggcgtaactaagtcttacctgaaatcaatgggcgttgaccccgatcgtgtggtgtatactcgtatcacgacagttgagcaacttcgaaatgacgttgtgagccagcttaacgcgctggaacgtggcgacaaagtgatcattttcgtggactctgtaggcaacaccgcgagtaaaaaagaactggctgatgccctgtctgacaacgacaaacaggacatgacccgtgctaaagcacttaaaggtatgttccgtatggttacgccttacctggcggatctggatattccgatggtgtgtatctgtcacacatacgacacacaagaaatgtacagtaagaaagtcatttccggtggtactggtctgatgtattccgcagataccgcgatcatcctgggcaaacagcaggtgaaagaaggtacggaagttgtcggttatgacttcatcatgaacatcgagaaatctcgcttcgtgaaagagaaatccaaattcccgcttcatgttacctatgagggcggtatcagtatgttctctggtcttctggatctggctatggaaatgaacttcgttcagactccaacgaaaggctggcgcggtcgtgcgttcctgaacacggaaacgggcgaacttgaactggaagaaaagaaatggcgtgaatcggaaaccaactcgatcgagttctggaaacctctgttcactcaccaaccattccttgatgcgattcaggataagtaccgtattcctgacaaagagatcactgacggggcagcactcgaagatctttattctgacgatgaagtagaaccgtcaaataaatttgatctcgatgacgatatccctgatgatgtggatatgtcagaagagtaataaacaactgggggctttgcccccttttaataggtgaatcatggacattgaacaaaaaacaaaaaacattcttgatgaagcaatgcaggacgttattcaagaactgttgatcaacgatgaaaacgatgttgcacacttagtgtacatccataaggtgtattgggataacggcctgaaagtcgaattcagtacgccggacgaagacaaagaaaaactgattccgctggttcacgatgcaatctacgcgcagatcaagccaaatctcccaaagcctgaaaagaccttatgggcggcgttgaaagtaaagctgtataatttctttcagatgttcgctaatctggtttaagaggtaacaatgatcgtcgaaacaatattttcaaatctggtttttaatggtacgtattttgttcaggcgtggccccatttacgccgtgaatatttcgaagggaacgcgcagattctctttgatttgatggataagcacgtacaggaattcaacagcattccttcacaaactgctttagaagtagctctggacaaaaagagcctgagtgatgtagtctacgaagataccaaaaagatgatccgcagcatgaaaaatgcgccggaagatctggaatggttgatgaaagaaacggaaacctattgtcgtgacaaggcaatgtatcgcgctctgtcccgtgcaattgagatccaggcgaatgctgaaaaacctgctggcgaacgcaacaacaaaatccctgacgttggggcaatccctgacatcatggcggaagcgttagcgattagcttcgatagttcggtcggtcatgattacttcgaagactatgaaaaacgctggatgctttaccagtccaaagcgatgaagattgctttcaatatcccgatcctgaacgccattactaaaggcggcgcagaacgtggaacattgaacatcttaatggctggtgttaacgttggtaaatctctggggctttgttctctcgctgctgattacctgcaatcaggtaaaaacgtcctgtatatcagtatggaaatggctgaacacgtttgttctaaacgtattgacgctaacctgcttgatgttgcgatggacgatatcgacaacgggaacatcacctatgcggactataagaaccgtatggaacgcctcaaacagtcgaaggtcgggcgtttaatcgttaagcaatacccaacagcaggggcgaacgcgaaccacttcaaagcgctgattaaagagcttaaattgaagaagagtttcgtacctgatgtgattattgttgactacctggggatctgtgcttctacccgtgtacgcggggcggaaaacacatacatcctggttaaagcgattgccgaagaacttcgcggtttggctgttgaaacaaataccgtaatgtggactggtgcgcagactacccgcgccgcgtgggatgcttctgatatcagcatgggcgacgttgccgaatctgctggtcttccggctactgctgactttatgttagctgtgattgagaccgacgagttagctgatcagggcttgcagttgttcaagcagatcaaatcccgttacggcgataagaaccactttaaccacttcaaactcgaagtgcgtaagggtaatcaacgctggatggataccgacaacagcgatatcgggttcaaatctgattataaaggtcgtcagatgccgaaaacgcttgaagaagcacaaggtgctatggtaaaacaagctgaaactaaccgaagcagtaagttagccgaagtagcaaacagcacagacattcaattttaacggggcttcggccccaatcaaaggtatagtgaaatgaaaaagattctcgttattgtgttcctgatcctcctgtctctgaaactggcagcaatcggggttatggcaaatgcttcctggtggcttgtgtttgcacctctgatcgtgatcggtgtgattaagctggctttctgggtgctgtttgtggtggcaatggcaaatgtattccctaaactgactctctggattgcaaaaaacgcaaaataatcctgattaggggttgacgggagttatgattgtgataatatgactcccgtagacaacgaaacggattaaaggagataccaaatgaacttactgaacaacccatacgacgaagtgatgaacccagaactggatttcagcgcgggttatttcgatgcagtagtgaacagcgtagtaaacagaggtttgctggttgaaatgctgaaaagtgggaaagcggatgttgaaggtagcgttgatttcctctggggcttcctcccaatcgacccagaattcaaactctgctgtaacgaagttcaggccaaaaacgttcttcggtatcttatcaacaaagcataaaaattaagccccgaaaggggcttttttgtatctgtaggtattgcaatcccatacgaaaggtgatactttattctaaacaaacaaaggaggacatcatgaaacttgcaatcgcttttatcttactggttctaaacgcacttatgggctttccgttcccgtggttggtgcttctggctatcccgtttgcctggaacctgttcagaatcggtttagcgggttgtgttggtgtcctgatgcttatcatcggcgctatcggtggcaaagacgcttttatcggtgtcctgaaagccatgaaagagggcgttaaagaaggtttagtgaaatgatgaatttagatttttgtaaggctgaaataaaagctgatgcagacgaagaagaaccgaagttcgatagtcctcacagttcgcgctggatcgtagctgttgacgatgaaggttatgttacggtattatctcgtccgttcatccacgatgcattttttgaatgtgggcgcagtgcggaagatatcgggcttcctgattccgtagaactgccgccaggtgtgtacgaatggatctgtggtttcgaacaaactactgactgggaaaccggatacgtggacgggtgggaattctacccgaatgaatcaacattactgtatagctgggacaatggcaaagttaacgaaagcggaaacgaagcaacacaacaagataatggatctggtggagtctgataaggcgctaacctacgacgaaaagttattcattatcgaaaacttccatgaaggtgcatttacgaataactctgaactgggcgcgttctttaccccgatcggacttgctcgcgatttcactattgatgcttgtaccagtggaagcgttgttgacctgtgtgcgggtattggtgggctatcgttcgcgatgcttcatatgatgatgtacgccaaaccgcgtgaaatcgtctgtgttgagttaaaccatacatactataagttgggtaagcgtatcgtaccggaagcgacctggattaacgcagacgcgttaacgacggagtttgatactctgtttgatatggcgatcagcaatccacctttcggcaagataaagacatccgattttaagggtaagtatacgggcgcggaatttgaatataaagtgattgaacgtgcttcacagattgcccgtgcgggtacgttcattctcccgcagatgtccgcgaatttccgttactctggacggcgttatttccaacaggacgaatcaacgacaacatcgaaatgcaaaaagtttcttgatgaaactggccttgaaatgcaaccaggttgtggcattgataccggatattatctggaagaatggaaaggcgtgaaaccgatgtgtgaagttgtctgtatggaattccccgaaccagaaaccaaacccgcgcaaaaccttttcactttcacaatagagtaaagactatgagcgatcaattaatcaaaaacatggatttaacctacagtgtgcgaatgattcgcctactgaaaaaaccctggactgaatggacggcttacaagctggggatcattgacggtcaaggggaagtattgaaaaacccgaagacgaaggaagaactggaagcatattccccgttccatcgctctgtgaggcacatcaagcgccgtttaaacgcggttccttatatgtctgggttcatgaaccttacaagcgcttatgactcgttacggagccgctggaacctgaccgagcaagagcacgaagagatcatgatgaacctcccagaacttcgcgaaagactcaacgaagaaatggttgcaggtgattcaggcggtagcgtggataatattgcttcgggtgtgactacaggcgcgatcacgaacaaagggccgaaggttctgggttctacgcgtccgcataaacgcaaacgtaaaatcatgaagagtgaagaatgaaaccattaccgcctctgaattatcggatctgggttactgcgaacaattacacctggtttcctatccgtatcaagtacatgagcgacacagcgatcgtgtacacgaacgaaagaaaaacatcatcgggtgtcgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggagaattcagtatccattcccgttgtccgatttgtggcgactccatgaaggataagcacaaaaaacgtttctggatattcccgtcaaaacgaggcacacacatgatgtgtggttgttttaactgcaactacagcaagccgttttctgtgtttctgaaagattattacccggatgattatacggcgtatttgatggaatctttcaaggatcgtaaagatttaaaacagacacacgaagaaccgccgaaggaagaaaagaaatatattcctgaattgcagttctgcgaacgtctggacacgttgccagaaaatcaccctatcgttaagtatgttgcaggtcgtcacatacctaaagacaaatacgatcgcctctggtttacgcgtcaatggcaacacctggttaactctgtgaatgcggacgcataccctttaccgaaggatgaaccgcgtttggtgatccctatctttgatgaaaagggtaaaatagagtcattccagggacgtgccttacgtgacaatgccaacgcaaaatacatgacaatcaaagcgtgtgaacactcaacgaaagtgtatggacaagataccatcgatccgttgaaacctgtctaccttcttgaagggccattggatagcctgtttgtagataatgcgggggctattacgggcggacaaatggcgctgtccgatgttccgtataaaaatatgcgtgtttgggtgcttgacaatgaagcccgtcaccctgatactactcaccgccttttaaaattgattgaggctggcgaaaaagttgtgttgtgggacaaatgcccgtggccgtcaaaagatatcaacgaaatgataaaaactgacggcgcaactaaacttgaaatcatgcagtatttgaaagacaatactgtttctggactcacggcaaaacttcggtttaagtcgtggaacaaatcaccgaaaaaatgagattgatatgactgataaaactcctgtgtttaatagctgtgcgcacctggttaaagccgatgatctggaaatggtagaaggtttctaccgcaatgcattgcagaacggaatcgacccgctgcaaaagatgctggacttgcaaaaccatgcacaacaaagcctgtctgataccctgaattgggttccacgtcctgataacctgaaaacgtgcggtgagatcctggactggctgaaactgcaagatgatgcgatcgcagacgaaacccgcgaactttacaccgctctgggcggtatgtctcgcggtgcaaaagcggcttccggtgtctggaaaccgtggaaagcaaatcaccaggaactgcgtagccaggtattcgcagaaatgaaagaagaagacaaactggaaatcctgtttgaactgattgaccagtggcacttcttcatgtgtaagttcctcgcgctgggacttgatgcggaaaccatctacaagctgtatgctctgaaacaggcggaaaacctgcgtcgttgggctaacaactactaatggaactcaccgcgctacatgccgtatttgctttgtcttatatcgtttgcgcggtgataacgtatctcttcggatggtgcgttttccacgttaacggtgttgacagaaaagcctctttgatagtattatcattgctatgggttataggttttttctacgtcatctatgaggggcgaaaatgattgacaaatactatatcattgttacgaaagacaaagacggctttactattccacacgttgaaaacgggaaaacgccggaactgtttgcatcaccgcaacttgcaaaagataaattagattttatccgcaagtgctacgaaaccaaactgaactacacgccggacgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagtgacgatcagaagtccgcgcatgatcgcgtgatccacaacatccagaacgccattcatacaactattacgggtggccctggtgttggtaaaacaacactggttaagtttgtctttaacactctgaaagggttggggattagcggtatttggttaactgccccaacacaccaggcgaaaaacgtgttagcagcggctaccggaatggacgcaacaacgattcattctgcattgaagattagccctgtgactaacgaagaactgcgtgtgttcgaacagcagaaaggcaagaaagcgcctgatctgtctacctgtcgcgtgttcgttgttgaagaagtctcgatggttgatatggatctgttccgaatcatccggcgcagtattccaagcaacgctgttattctgggactgggtgataaagatcagatccgtccggtaaacgccgatggacgtgttgaactctccccgttctttgatgaagaaatctttgatgttatccgtatggataaaatcatgcgtcaggcagaagggaacccgattattcaggtttcacgggctgtacgtgatggtaagatgctgaaaccgatgtctgtcggtgatctgggtgtgttccaacatgctaacgctgttgacttcctccgtcagtatttccgccgtgtcaaaacgccggatgacttgatcgagaaccgcatgttcgcttacactaacgacaacgtggacaagctgaacgcaacgatccgtaaacacctgtacaaaacaacagaacctttcattctcgatgaagtgatcgtgatgcaggaaccgttagttcaggaaatgcggttgaacgggcaaatcttcaccgagattgtgtataataacaacgaaaaaatccgagtcttagaaatcatcccgcgtcgggaagtaatcaaggcggagaagtgcgacgagaagatcgaacttgaattctatctcctgaaaacggtatcgcttgaagaggaaaccgaagcacagattcaagttgttgttgatccggtgatgaaagaccgtctgggtaactatctggcctacgttgcgagcacttataagcgcatcaagcagcaaacaggctataaagccccgtggcattcgttctgggcgattaaaaacaagttccaggatgttaagcctcttccggtttgcacgtaccacaaatcgcaggggagcacgtatgaccatgcgtatatgtacacgcgcgatgcgtatgcgttcgcagattacgatctgtgtaagcagttaatctatgtgggagtaacccgcgcacgttacaccgttgattatgtataaggggctttgccccttttgaggttattatgaaattgactatccttgtaaaagacattccccgaattctggaagcactcgataaaattcgagaaaaagacccacatgcgttcaatatgttcgggatgtatagcgcagcagatccgcaagaagttattcaccgtttgcgcttcattgaaaaatctaacgatgttctgtattctccgaacgggccaagttattcatggagtcctattgcaaaagaagtcgaactgacttatgatcaatatggcgttatcgtgctgatccttcgaatggcacgaaacattcgtgaagataaagacatatggacattaatatcatgaaaaaagatatatctatccagatcccacgcctccacgcggaagcgattgcagatctaattttcaaaacccctgttcaagaacttccgcatttcatcgatcgtgatgtgttggacgaattcacagaagctgttgaaaacgcgaatcgtctggaaaaggcaatttatcattccggtctgcgtcagttcggtatgatgactttgcaaagcaaagagtttgaaacttttgatatcaacccagaagttgcgcttacgcttgcatacttcatggaagattataagcggagaacttcatgagtcatttacccgtagattacgtatgggattatgaaacggttggtccttccccgaacgggaaggtgatcgaactctcatacgttccgtttgttgatgatccacataacccgccaacgttcgcggaattggtagcacgggggcgcaagtacaaatttgatttgcgcaaccagcctgatcgtattgctgatcagggaacaatcgcctggtggaaacaacaaagcgaagaagcccgtcaaatcctgaaaccgtcgccggaagatctggaactgtatgcaggacacagacaattctttgaagacctgaaagcggacggtgtgagccgttggcaatcactcgattatgttcgtggccctgaattcgatcgcggtatcctggttgatatcgtgcgtaagatggttggtaagatcgacatcttcgaagatatgccgaccgtgttctggaatagtcgcgatgtgcgtacctgtatcgaaaaccgcctgttaacgcgtgatgcttcgacctgtcctcttcggaaagggttgcttgatggttttgtgatgcataattcaattcacgattgcgcgaaagatgttttgatgatagtctattcattgagatatgcgctggggctggaagaacccccaagtgaagaagaaaccgatccattgagtctgccgaggaaaagatgattaaattatcatttgtaggtaaaactgtacatgcaaaaacactgaacgaagcgaaagcgcagatgtttgacattctcatgaaccccgcgttcgttaaagtcgaatacgatgaatatgttgttcagcctggagatagcatgtattcaatagctgaaaaattatacggttgtggtgagcgctggcagtctatcgctaagttgaaccgcaaaaccgttagcaatgcaagctatatccttccagggatggttctgaaattgcctcagttagtcgaattatgataaaaagcccttgcattcgtgcaggggctttgttattttgtagggactgaaacaaaagaggataaaacatgtttggtgatttgaaagaaggtttgaacattttaattggattcgcgatcattggtgtgattgcttgtgtgtccggcgcggtgtggttgtcttatcaggcgatcgtgtggttgggcgaatggcttcacattctggcacagtaaggggatattatgcgtttatgtttagttggtgtaggtttcggtcgtgcgttaactcaagggttaatcgactcaatccgctggattcaaccaagcgttgaactgtattcattacctaaccggatcgaatactctgatccaacaccgtacaaaatgaaaccttatcaagcgccacgcgttaaccgtgcgttacaccgtcaatctgtgaacaggggcaaataatgagcacagcaattccacttatagtaatttttgtgttggttgtgctgtttgtcatcttcaaagcaatcgaccaatccatagcaagagaatggtttagcgactactacacgaagaaagcgtttataaaacattttcgaatggaagcagtgtgtacccacgtatacacggagctaaaccaggttagattctcattctcacagaagggaaccgattatgacatcacggtatctctttccaaagcaaaagagctttacgatatcacccaaaacgggggaatccgtagaacacttaaatcattaaaatagcactttttgttaaactagcctcttgcaatgcaggaggcttttttgtatattacacacatcgaaacgaaacagacaaaaggaacgcatcatgaaaaacttagaagccaaagtagttaaagtcctggttaagaacgggttcaatgaaaaagacgcagtagcgatggttgaaaagaatctgaatgatgcgttgaaagttagaccagaagcaaaacctgctaaactcgcagaggtgattgtatgcatcatgtaaaagtaagcatcaaggatatcacggttggtgacaccgtgatccacgaagggaaaatgaagactgtcgggaaaaacgatatcaagcgcgatcctttgtttggtgtcctcctgtttggtgatagtttcaatctggggagaacttttatcgagcgggttattttcccgaaatggtatcaagggaaacgggtttaacaaatagcactttttgctaaagacttcacgggatagctttgatatagttatcccatcgaaacaaaacggaaggagagttatcatgatgcagaacggttctttaatcaaaggtcacggcaaattcctgattcagcagatcaacgacaacaaaggcatcatcgcctattgcgacgagaagatgaacagcgatatcgcagcatgggaaaagaaagagtatgcagcagtgaaaaaagccgcagaaaaatcccttgctaaagcagaagaaaatttggctaacctggagaactacgcatgaactacaaaactttcgtgattaccgtcaaaactaaaaatggtgaagactgcttcttgtatcaggcaaaagacgagaaagaagctaaagcaggtgtattgaagttcattaaacgcgatgcattgagcaatatttgcgaacaaccaaaataatgcttgcaatcctgaacgcataatagtatattacacacatcgaaacgaaacacacttaggagattttaccatgtatacttttgacgaactgaaagccgcagcacagcctttactggacgcgatgcacaaaggtcgtaacactggcatgtggttcagtgattacactgaaactgtgttcgttctggaaaaaggccgtaagtatcaccgtatcgtgcaggatacccgcaacaaagaaacgggtgaaatgttcaatcagcgttcagttgctggcttcatcgacaatgacggaaatatcttgaaagccgctggctggaaagcacctgctaagggtattcgtggtaacatcttcaacaacccagagaacgcgatcgaccggagtggatacgttcgctatcttcgctaaaatcggggcttcgtcccctttggaaattaaaatgaaactatcagcaaccgccagttggtcaatcttcggactgatagccgcaggggttttattcttcgcatggcaatcaagagatccgaacaaagcggcgtatgaagccgcacaacgagtagtagaacaggatgcagaagcacaacacgaagcaatgctacaacagcgtcgtgatatgggctttgtggagactgtgagttacacaaacgcttttggtgatgtcactacgcgctctgtaaacgtcttagggcgcacgaaagggacaatgctcaccatcagacgggaaggaaccggaaagctcgtagacgtgtgtttcagtgcgattacggacgattccaaacgcgaactattcgccccgtatttttctacgcctgtatatgctaaatttgacggcggagaaacaaaagagtttagcgcaagcagaggaagtaccgaagattttctgtgtattacttccccgcaacgcttccttttcaatatggatcgtgctagtgttatgcaagtccagttagtattcctggatcattactccaaagtgccagaagtgcatgaatggaacctgaaaacatataatgaggttgtgaataaatgagcagacgcccaaagaacagcaaaaccgaaatgtttgcaacgtttgatgtaaacggaaagagcattgagggtaaaccatgcacgaactcaaagtttatgcatatcgccggattgcctggtatgagtgttaaaacttcttactgttgccactacaacgaagaaaccacctctgtttatttgggcgaagaactcatggctgaacgcgtcatgcaatgtgtgcatttccctggcgaacgtccagaagtgaactgttttattgttggttatcataaaggtattgtaaatgagcaagtataaaattggtgatatgtacgccccgaaatctatgttaatggctgtgtgtcaaatggcatccgaagccgacccgattcgtcgtatgtatgacgcgttgcgtaagaatccgatggacttcaattcaccacgccggatcagtatggtgtatgaagaaacggggattctttatcttgaaggtattcccgttcctatcaaattcaacgatatgaaagggcttttcaatccggtatgggttgcaccagaaccggaaactgaaattacgatccacgtcaataaaggtgaggaagtaccgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgtgcgttggatgtgatttacctgaaactgggtactacccacgggacaacagaaatcgcgcaagtgatcaataaactgcttgataagaaattagataagtggtactctacttgtagttaatcaattacgaggatcggatcatgttggtttatcgcgttgaattgaaagcgtctatattatccaaatatgatggatggtgtaagcaattaggcccgtacacgggttgtgttggtgatgaagacgatctctatgagtatcttgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatctgtatggtgtacgaaactgatctcatgtttgcagggaacaaacaatgtgttttcagcaaagccgcaaccccgatccgttttattccattgtcagagatttattaatgccaacatatacctataaatgcaccaagtgcgaaaaagaattcccgaagatgtccagcatcgcgagccgtgacgaaccgaaagattgtgattgcgggggcgaggcgaaacgaacggttgataagccgcagatggtgaaagatggttttccctatgtctaaaataaacgaaattgtgcccgacgattacggatatgccgatgggtttcaaccgcaagagtattgtgatagactggttattgaatttgattcagaatctgtgtctgaaataacgcggattaaccaatctggttttgagatctcattaacacgaatgcaagttgaagaactgatacccattcttcaaaaaatcaaagatgcttaaaccccgaaaggggttttctttttcatagaaccctatataatgcctgagaactaataaagaggtgaatatgagtttagatttcttaatggacgataacgagccgcagaaagcaccagaagccccgacaaagggcgctaaggtggatgaatcattctgcttgagcgatcgcgatcacattcgcaaacgtccgaacatgtacgtgggttcagtgaacaaagaagcccatgaacgttttatcatgggtaaattccgcaaagtggaatacgttgaagggttggtgaaaatcatcaacgaaatcctggataactccatcgacgaagcgatccgaactgatttcaaatttgcgaacaaaatcgaagtcaagattgatcacaatctggttactatttcggacaacgggcgcggtattccacaagatgacgtgagaacgccagaagggaagattgttcctaaacctgttgcagcctggacaatggctaaatccggttctaacttcgatgacgaaaaccgtgtaacaatggggatgaacggtgttggttctttcctgacaaactgttacagcgcaatctttatcggtgagacatccaacggtaaacgcaaagtcacgatcaactgtacggacggagcgcagaacatggattaccgcaccagcccgacgaaggagcaagggacaaccgttaagtttacccctgacttctctattttcggtgtggacggtatcgacgaagagacaaaggaagtcatcaaagatcgccttatggcgcttgcagtggctttccctgccgttaaattcacatataacggtgatatcctcccgaacaaattcgcgatgtatggcgcgatgtacggtgataaaacgattacccagacaaacaacaaaatcagtttcatcctggcgagcacagaagacggtttcaaacagaaatccttcgttaacggattggatacgaaaaacggcggtgttcatgttgacaccatgatcgacggtatctattccgaactcgaaccgatgatcaagaaaacacacgctatcgagatcccgaaagcccgtgtaaaagaatgcttgactttggttgtgtttttgcataacttcaatgcaccagcttttgatagtcagacgaaagaaaaactgactaacaccgctggggagttcaacaaccacgccggactgaactacaaaaagatcgcgaaacagattatggatacttctgaaataatcactccgatcattgagtccgctctgattcgcaaacaggcagcagaagccgcagccattaccaaagcgaagaagaaagcgaaaaaggcgaaggttgcaaaacatgttccggcatcagggatcgacactgacggggtagaaaccactttgtttctgaccgagggcgattccgctgtagggcagtttatcgagtgcagaaacgaagagacacaaggcgcatttccgctacgtggcaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgcggacgttgacgggggcgatattctcaccctactgattgcgttctttagtcgctggcctgagttgttcgagaagaaaaagatccgttatatccgcacaccgattatcattgcgaaagtcggtaaagatgaaaaatggttctactcccttgaagatttcgcaccgttccgcgataaagcgaaagaggtacgatatatcaaagggctgggttctttacgcaaagaagattacgatcgggtgttgggcgaccagttaaaatacgatacaatcgtactgggcgacgaatacaaagacgttctggaactgtgtttcggtgatgaatccgatccgcgtaaagactgggtgaacggaaaacataaattttcggtgaaatgatggaaagaagtattaaagacgttgtacaggtagaagggcttacgtttgccctttacacaatttattctcgtgcgatcccgcacctggtagacgggttcaaacccgttcaccgtttcttcgtgcattccgcagcgaaaggcggtacaggcttccagaaagtagcctctatcgctggcggtgttgcaatgtatggttatcaccacggggaaacatccgttgaagaggcattgtctcttatggcggcgcactggtgcaataacatcccgctttttgaccgcgatgggttctttggttcccgtctggttaaaaagccaggcgcaccacgctacattaaatgtaagctgtctccgctgttcaaggctatctacatggatgaagatttaacaattccgcatgaagatcctgaacacgtaccgccagcctattacctaccaatcattccgatggtactggttaacgggttcagcgggatcgcgaaagcatacgctaccaacattccaccacacgatccaatttcggttctgaatggatgtgttagttacctgaacgggaaagatttcacactggatctgaaatacccgcatttcaaaggtgacattgaaaacggtacgatgtacggcaagtatgaactccagggtaaaaccaaactggtgatcacagagattccggtcaagtacgatcgcgtgaaatatatctctatcctggataagctggaagagaaagggtatatcgtaagctataaggatctatcgaaagaagattttcgctacgaaatcaccctgaaacgcgaatacgcaaacgggcttacccgtgagaagatcctgaaagatttcggattgattgagaactcaaacccgaacatcaacgttatctttaacgggaaactgcattcatacgagcgtcctgaaacgttgctgaaagacttcgttgatatccgtattggtgtttaccaacagcgtattgataaacgcatccaggagactaaagaagcgttagataaagcgctggcgaaggttgacttcatcgaccagatgatcgcacagcctgacgcattgaaggggcttagtcgcagcgaagcggttaaacttgtctctacgtggacgggttgcgagaaccacgccgaaattctggttgcgatgaacatctatcatctaaccacggatgaacgtcaaaagctggaagacgaagcgaacgaactgcgtaagcaactgaaatactgggaagaaacgaccccgaaaactgaatatctcaatgatttgaaagaactttcgaagaaattgaaataatttacaaaaagcctcttgcattgcgggaggctttttgttatagtgtcctcactgattggggaggatataaaatgttcaaaactcgtagcgatatggaaataaccatttgggccaaaagcatcatggcgaagcatggcttatctcattggtctttcaaaatcaacggacgtttcaaacgtactctgggacaatgcaattacagtcgcaagtcaattgaattaagccgttctcacgttaaggaagatatctacgagaacgttttagatactctcatgcacgaaattgcacatgctctgaccgaaggggctggacacgggatcgtatggcagcgtaaagctatcgagttgggcgcacagcctacaccatgcaaaagccgtatccgtgagaaatcagtaattcaggaaagcgaaaaagacatatacgcgtttttcttgaaaactccgaacggtgaagtttatcagtgcaatatgaccgaaaagatgtacaatgagatccaggaaggtaaacgcaacattgcaaacatctacatttcaagaaacaaacgagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcatggatatgaaagaccgcgaacgtcagaagcaacaggtttacgaataccttgaccggatgtgtacacctgttgaatatgggcttgatcaaaagcctgtgaaatattcatgcgataacatcatctttaacaccaagtgagatataaacaatgaaattacgtcagttagcaccacaaaccattcacacaacgggcttcgataaaggcgaacgcacgaagtttaaaatggctaccagtgcgaaaacatacaaaatcatgtcatcaaccatttacaaatacaagatccgcgcaatcattcgcgaaatctccagtaacgccattgatggtcatatggtagcgggtaacatgaacccgttcgatgttcagttaccaactgttctcgatccgcgtttcatcgtccgtgattacggcacagggttaagtgactggatggttaaagaggtgtttgcaacctacttcgaatccaccaaaaccgacaccgacgaactgatcggggcgctgggactgggtagtaaatccccgttctgctacaccgaaacattcactatcgaatccatccaggacggcgttaaacgtgcgtacacggcttatatggataatggtgaacctttcgttgaccaaatctacgaaatcgaaacagacgaacctaacggcgttcaaatcaccgttccggttaaagtcgaagatatcgaagaatgggaaagagaagcggcgcgtgtttacgaaccgtttacgggtatccgtcctcgcttcatcggtgttcagattgatgttaactggcaaccaaaagaagcagacgatcgcgggatcattcgttataagtctgcaaactattccggcgtatatgctcgtatgggtaacatttgctatccaatcgatttggacatgttcgaaaactcactgttctattgctaccgtaacagcaattatgcatatattctggatttccctctgggatcgctggacttcatgccgtcccgcgaagagttaagccttgataaagtcaccaaaaaagtgattacggatcgactggacaaaatcaacaaacgcttcgatgaagagttgatggaacagtacaaaaagcagaagacaacccgcgataaactcgtatggttcaacaatctgcctagtttgttacagacatttgtaacccgcgataaccgtttccgtgtgggtaaagaatcgctggcggaaatcctgacacgtatcaaaaaccctgatacagcaaccggaaaatatatctggggcttttgggctaacccatatgacgggaaagattgcgtatatgagcgcgtaggcagtggtcgccgttatgagaagtataaagcggaaacaaccaagcgccaggacgttatgcgaattattcaaccgtggcgacagaagaaactgttcattgttgaaaacgacaatgaagcgcgttcactccgtccgtacctgatcggttattgcatgatgcacggttctgatcgtatcagtttcgtgacgaaagagatcaacagcgatccggtacaggatttgatcaaaactggatattacgatgaatccgaaattgtcacgctgaaaaccagtgaattgacgaaagaatttgaaacatacacggaagaccgtaagcgttggaaagcaacgcgtgaatcatcttctggtgattatgaatcgcgcccgaaaacgccgactgcatatcattacttcctggatgaacagggcaacttacagaaaaacgatctgtacctgactaaagcacagttcatgaatctgggtgaaatgtacgcgatgcgcctctatggggttgatgaatatagccgactggacggagaatcaccaaactattctctgggtagcatcgccagcagtatgatgaccatgttaaaggtcacagggctgaaagatgtgatggttctgcgaaactctctgtggagtcgcatttcagatagcaacatgaaatgtcttgatgattatctggtaaaacgttttacagacgcagcgaagaagatgaaacctaactggttccctgcgtggatttcatcgaaccacggaagcgagatccgaaccctgcgtgattctatgggtgtaacccttgatcgtatggttaaaaaccgatacaatccagaattgtatttgttgcttgattatcttgatggtaagtttacctacgatacgatcgagggcaaaaacaaatctaaaactgtggtacgtaaccctttacttcgtgaaatgtcaacgaagtattacaaaatgcggaaagatatgaaagaacgcgttgatactgcttacgatttatttgcagaacgcaacccatcaatccattacatgttattgcattcgtcttattctacattccgcagtatgtttaatgacgaaaaacttacgatggatttggtcaaccttatacggtggaaataatgagaaacgttaagatccttgatgatgtacagaagaaagcagtctacgagggctttctgaccagcgcgaacaaaaccgccctggctaaacaatttggtgtaagcgtccgaaccatcgggcgcgttattaccgaacaacacgccaaatacaacaaaccggaaccgtctaaaccacttccggttacagataccagttcaaaaatgatcggttctgaatcgtttattactctggtgttgaatggtaaaatcgttactgctgattcgtcgcatcctaactttgaaaaagcacatgctttaatggttaagggtgatatcgagggagttgctaccctgctggatacaacagaagcattgaagatttacagtaaaggcaacattaagatcatcgggcataaagtcttgtacaaagatatcgtgtttgacagcgggatcacgcaacgtatcgttcgcgaaatgtataacgatcgcccttatgagcacctggtgaacttcttcgagaagttgatggaaaacccttcccgcgatgctgtgtaccagctttacggattcctggtgcataacgatatcgaactggcagatgacggggatttctacgcgtggaaacgtgttcgtgaagacttccgcgatctggcttccggtaagttcgataactcacctggtgttgtggttgaaatgccacgtaaccaggtagacgaggacaaaaaccgaacctgttcatgcgggttgcatgttgcggctaaatcgtatctgcctcactatggcggcggacgtggaaaagtcattcaggttaaagttaacccgcgtgatgttgtagcaatccccactgattacgataacgctaagatgcgtgtatgccgttatcaggtgatgcgcgatgtgactgtgggatttagtcactactaaccctacaacaacgcctggagcgattcaggcgcggaggatttgattatgaaattcctacagagcattcctgactactggcagaacttgagcggggcagaaacagccatcaaaaccgctaaagaaatctggaacggaggcaacgttaccgctggacgtacagaagacggagaacagacatacttcaaaaaaccttacggtattatcgcaacagcccttgcatttaatctgggttatgttatgctggtactcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattaggaaataaactggtgaagaaaaatgaaaagaattctgacaaggcttgacatccacaaatatgctgttaagataggtgacatgaagcgcggtgacttcaccaagttcgaaggggttgacctgaaagaacacggcttctacctggtagttgatgataaaacgggtaaagtagtatttcgattctacgtagccccaaatcaacgccgtaagactggcgcaaaccgtactctgttacgcatcaaacgccgcgaacatgaaccatcagcgatggtggccttgctggatagtgcttctctgtacttcgttgcacacgataagattaaaaacctcttcggtttctcgaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagacgaaatcgtagcaacttttgacaaaaccctgaccgaactggaagcgcgtattgcgcatgatcagaagcaggtcgaacaggtagcagcagaccgcaaagcagcggaagaagaacatcagcgtaagctggctgaactggctaccaaagaaagcgatcataccgcaagcgcaacacgagccggacgtatcgcggataaaatccgcaaactgctggattaattatctaaaatggggctgaaaagccccaataaggaaaataatatatgtttgtaatttcttcgtactatgattcacgtcaacgagtatcgttgtcttctatttccaaagcaccaaaagatatagatgacttcggattgcttaactttgtcaaaaaagaaatcgaccgcgttgttccagaaaaatacagaattgttaaaggatctgatagcttaactatcgtaaaactgtatggcgaagtcagtattcaacatcatgtgccattatatcctcgatgaacaacctggtagcgaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacacggggctgtatctcgttgaagccgacgaagatatcattgaaatcctcaaaaccgctcacggacattatgtgaacggatgcaacaataccccagaacaggatcacgctgtcaatatcgttaacctcatgttagggccgcgtacagatgacaacctgaaatgggcgagcgaatccaacgttcctcatgagtatgtcgggatgtattatcagtgcaacgttgacgataaagcgccactgataccggaaaaacagatcgatttagtagttcgaacaggtttcttcttatgagttcacaaattctgttcagcaaagaagatccattaggcacagattcatcggtgcagcgcttattctggcacatggattatgcaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaagcccttgacttcggttgagggcttttgttatattggccttgtcgaaacgaaaccactaaggagattcaccatgactaacctgactaaagttaccgcgacatatttcatttcttctggcgctaaaaacgctatgtacactctgcgtgtagagcgtcgtggaggtgaattcacttctgataactatatctgcaacctgtctactgacccagataaagcggaagcgaaagcgcgtgaatacttcgatcgaatggtggatcgtctgaaccaaaccgatactttccagatggtgttccagggcttcgcagatttcgatctgtttgaacgtcgcggtaaactgtccgtacaggataccgaaaacctggaactgctggaacagggcatcatgccaatcggtaagcgtaaaggtgaagtgattgctgatatgccgatgtatacgattctgtggtgggctgatcagtgcaaagaaaacggcaacgatagcccagtatttcaggctatttgctcttactgcatgggcgtagcgctggagaaggattacatcgctaaacgtgaagagatccgcgcagaatgggaagcagagcgccaggcgaagatcgcagcagcacagcacatcggggaaatcggtaagcgtatggaaatgagcggggttgttgagaaagtgatttctctcggatatacccaagtttcttattacaccgaagtggaacgtttcatgaccaaaatcaacgtagatggtaacgtggttatctactacggaaacaaaattgttgaagagggtgatgtgattcgcttcaaagcgacacctaaacttcacaacgaatacaaagaagttaaacaaacaatcgttcagcgagtaaaggtattataatgacatacgaagaaatgcttaatgaagtgtgcgcgggtaaaaccgcgtaccgcccgattaacccagatatgatcgtgttccgcgaaggggatacgatcattcgccgttctcaccgtaaggttgagattaaccaggtattcattgccagtgttgaagaacagaaagcgaccgactgggatatagttgcagaagatgataacaacgacgaacttgacccgatcttagtcatagataatcacccactgggtgttcgtccatacatctatcacaatcaatacagaggcgaagtgattctatcatgacacacgacgaagccatgaaagccgctacacgcggttttaaagtcgcccctgtgggtaaggctgggttctttgtatatcacagcgtagaggctggtttccggcgcattacgataggtaatgttggatactggaacgatgaatatgttccgacaccttacgaactcatgcgcgtatgggacatatacgataaaagcccgatgacgaaagtaaaagatttcatcaatcgggctttgagtagtttgaaactgaaattatcatcgaatcctgcctaaaattcttgcggcctgattgcacacggtcatcaacttcgtatcggtgacttcgggcttctgtatataccattccattagaatcgatccagaatagtagttttcgagattgaaataaggacaactaaaggtatatgctaccggaacaaggtcttttgttggaagatacgggcttgcaatatctgagatatagtacagcccgtttatatgtctattatactcttccgatgtcttgtctataggatagccacccagatttttcgggttaatctgttgcggtaacttcccttcatacgcaattatatcaacaaaataattgacattcttaggtctgaacccaaagattgccgaaaaatccgcacccgtagttaaatgcactatgtttaactgttcgatggatgcggattcaaacttttttgccttttcaatctccatcgtcggcacgtctataacgcttgaagatgttttccagactgaaaataagtcatcccacttgtaccatgttacgaacataatgaaaatagtgacgataagaaccaatttaatgaatagctgtttccatgttttgactgccatgatgaacgatattacccgttcaagcaccgccaatttatcttgtaatagcgccatgtttaatcctcaagttcggggatgccgacccccgaacatatttaggaatttacttaacgttgcgtaaccaaaccagaacggttctgacctgtacgggcgttcagatagtcataccatctggtcgcctgagaagaaataacctgatattgacgatatccatcatgtatacgtccgttgttgtcaaaatcgaatacaccgccgtcatccatagtaagacgtaggttgacagcaggaccgttttgaatagtaattacactgatatcaggtgttgattgtgctgcaactacagtaccgaatgcgttgccgttaaaactaccaccaaccgcaggataaccggaaggttttgaatatggtgaataccaaccaaccccccactgaccacgataacgggcgttgttatagtaacgttcatataccgtaaagttgatgttatataccgattgtcccgccattcgagacatccaaaatggtggcgttaatctcacttttgctccggcttgcgccatccatctttcacctgtttcatcaacggctgaagacccaatccagccgggtacacctacaattgccatattatttcctcaagggccgctagggcccttttatcatttagcctctaattctttaacccgagcagtcagttcattcactgagttgacaaggagagcaattagaccgttatagttaacttgacgtttaccttcatcgttcatagttactgcttccggaagaattttttcaacttcttgagcaataacaccgacagtacgtgtcttatcatttgaatctttgatgttataagtataaccattaatttgattaactttatcagtagcagattcaatttttttaagattttccttataagctttatccgaacggatataaacgttataagcctgcattgtaccgtcacgaaggttcatgaagatggtgtttttgttataatacgctgcaccagagttatgagtgtttttaaagcctacaccaaaccaagaacgaatttcgatattagcgtaatcattatcggcggcgtctcggccttggaaaatacctgtaccagaaccgttgccgaggctaataccacggttttcaacttcttgcatattaatgttggcgttcatggttaatgtgccagtcatagtgccgccaccaagactgagattatttgaatgaacccagtttaaagcatcgcccgcccattcagaaccaccaaaagatttccagcgcgttccctttaagttaccgtcatttgccagggcagcgcctgcgttaccccaagaaatagcatcacctgctgtactagtaaccgtgagacctgaataatgagttacaactaaaggagtgcctatagaaacttggcctgttccgttatttattgttaatggacgaaggccgttccaactaccatacggatctcccgaattagtcaacatgaaataagtactaccgccatcgtttcggataaagaatccatagttaccttgaacagcgcggaattgtccgcctgaactactcgatgtactttgaacctccgcacgggcgcgaacataaccagcagtcgaaacctgtagttcttcctgtgcgtcggtagtacctgttgccagtctccacacaccaccctgaacagtttcatgccagattgtgtccgcgttaccgcctcggaactgacgcaaatagtttttcccgccctgtccaacagtaggtaagaaatattgcgctggtgtgccctgtggaacgtcgttataatacgatggtacgtttacgttaagccccaatttggtgttgatagaagtcgaaccagtaccacggaaataatggttatatcgtccgttgccgtctttatagcctaagtgggtaacaccatcaccaaccccgtttccatcaccgtttgtttcaacacgaagaatcgctgagtttattccttgcgaatcataatttacgcctacagaagcacggttattgaatacacccagaccattaaatgtagcctgtccaggaacggttagatggttagcgagaaataaagttccatcatatgcaaaacgagttgcatatgcaccaccaccagtacgaacatatacgttctttccggtatcggcgtagaccaaacccagttcattacctccagcatcctggaagtataggtttcggttcgaatcgcctttaatagccatttgtgtaccaaaaatagtaccactgacaacggtttgcatcccgatcgttaaaccggaaccagtcatttgtagttgaccattttccccgttcatcaacagttgccctgtcaccgatccagaagcgcctgttgtcttattaggtggaccaaatacctgtataaacatcacacccgcaccggatgctttctggttaaacagatgtgcggctaaagtagcaccacccgcaggatcgcttgtatgtgatttggtattaactaataaactgtatacgcgagtttccgatgacggaaacggatctgtaactgcgttgttatccgaacgcgttgctacagtatacaccgccgatgaattatcggaaataaggttaatgcgacgaggaagagttaatgaagcattgttcgttaacgtcaagttgcctgtcatatcgtcgccagctttcttcacctgtgcatcgttcgttacgttgcctaatccgatttctgcctttgtcggcttatcgttttcggtgtagattttaaagcctttatatgtgattgtgtttccagaagggagcaaaggcaagttcgcctgactccagatagtattaccgccaacggtagtacccgcttttaaatctgccattattagatcctcaaatgcttttatgatatttataaaaagaaaaagccccgaagggcttttaattagcgggatttaagttccctgacttcctcacggagttcttttactgcgttaaccagcaaggcgataacagcagaagaagaaacagttaagatctcgttctgttcaccatcaacacctttcttaacagcttccggtaatacttcttgcagttgttgtgcgactaaaccagcctcacgggtagtttcttcacccccaatgtgatttgctttgtcgtacaccataccatcaagtaaatcaactttatccaatgcattttcaatcttactgaaattgcttttcagtctttcatcagaacgaatatacacatcgctaaagctaccgttaccgttcattaccaactgaatgccggatgaagggttgcgttcaaaataaaccagatatgatgcactatcagagatttcaatacggtttccacgagaagcatcaccagcatggaagatatacatatcgcgagggtttgcaccactgcgaataaattcaacgcgtccgttgccactaccgtttaatgttaaatttccattgtcaatataactgcttgactggctgatacgtccgttgactgataacgtatgtcccatcgagacattaccagtatcattatttatatacaaaggacgtaggttattataacttccccatgcatcacctgagtttgttaacatgaaataggtgttaccaccgtcatttcggataaagaatccacggttattgtatgcaatacgcaatccgttggctgagttggaaataatatcaccataagatacaaactcaccagagttatcaaaataccattgacgatctaccgatccagtacggtaatggactgtaaacctgttggtgtttaccaacgtacccatagaccacgcaccgccagcctgagaataatattgcttaataataggccagtattcagatgtcgatgtagtgttaatattctggaaaatcggagcttttgcagtgctttgagaagcccaagaacctctaccttcccccgatgcatcaaaataaccgcctgtttggttgatggttcctgttaccgtgcctcctgtatttttcaagaacagtgcatcgatccatcctgcaaacccgcttttgttgatatacacgttcccgtcattagccagaacaccaccgccgggtgttttaagtggttgagatatgtttgccagtgttagaacaccagtcatcgcatcaccggatttattgactgcccctacttccgccggagtcggaggaagcgaagtatcataaattcttctccatccattagcatcacccgcactataagaccatgcaccaggagaacccgtcgcagcacgaatccatgttgatgttatatcatagtaagtctgaaccagagaaacaccactattcagagtacggcgatatgtggcaacctgaccgtaatatgttgtgtttccatatggaccgtccgttacgttaccacctaccgacagaacatcgttcttttcagtaaccgcagcagccccgaaactgtttccagacataccgcgaggaatacccgtgatataacgttcatcatggttagcccagtttgacggagttactgtattcgcagtaaccgcgccactaactgccattgatgtagcattcgttaagccgaggttagaagtcccgatcacacggaaagaaccctgttcaactgttacctgttgggtttgtgagtccagactcaacagcgtattttgagtaccatttttaaaggcacggatgtatattttattacctccgtctgtgcgagcgttcacgttaattgtacccgctaactgtccgccagaaataccgctgtatgcgttaatgtccatcaacccagattccacatcaggaaccgaagtaatatcagaacgacggaaaacaactgccggagcaacagcacttccagtgatcctgacccactggttagattgaatattgtttgcgatcaacaaaacgcctactgtcacgttttgactaaacgtagtattcttcgcaacagtaccgccgttaatcgtcgatagtgcgtttatatcctccgctgtcggacgatcgttttcggtgtatactctccagcctttatacgttaattgtccaccagagggcaatagaggaaggttagaagcactccagatacccgcaccacccagcgttgtacctaatttcaaatcagccataaaaatttctcctgtaatgactgtatttatgaaaaaggggctttcgcccctttatctcacgattgacagtttaacgtctttagcggataccgtaccgatgtttgtgttgtttggatgacgatataaaccgaaatcaaacgtaaccgcaccagcaggaataaccccttcgtttttatagaatgaatatacgttcgggatcgtaccaacatcacgcatgtggatccctgaaatatacttattattcgcgtcccagaactgcattacgatatatgcatctttattgttggcgattgcgtttgcatcgcgtttcatttggcattgcatacggatcgtatcaccagcttttaagccataactgcttagtgatgctttcgttaccgccgcttgctgggtagtagtccattctttgaactggtactccgctgtatttgtcgaagtgtattcaaccggatcagaaacaatataatcaagttcagcaaagttatgcgaaatgattttcttatcactgataaccccagtaggcgaaacaggcagagaaagcaatttatcaatcgggttttgggttccagcatcatcaacttcggaaagcgtttgcatcctgataccattgacaccaattgccgccccgttgcgatcggtttcgattcgtggaactttgctgatctggacattgcgacactgagcaagccccactttcacggtagacgggtagtgatataccatacagcccatcttcacgtttagcgcgtccgtagggatagtgaaatatcctgacagagaatgccattcatcaggagctaacccagtcgttcgcaggatcgtagaggatatccattgaccagaggcgttctgtgtccacatatagagataacattcgccgccagcattgcgaagttcttgtgagcaataaacatcaccagtgaacttgaagatgtcccccaagaaaacagtagaaccaatatcccacatcccgtataaatggaagccgtaagcactgccactgttctgatatacctgaacatcatcaaccattctttcaggaataccagttaccccgatatcactgaattcatcgaatacaacctcaacaaaactcgtcgtgttgtctttgagtccactaccagaaccacctacaaagttttccatacagatctttttcatcgtggatgaatagattgctgaataagatgaacgttgcgggttgtttgttgatgatgacggcgtgctaaagaatcgtgtttcaggccatgcaacagatccgattgtgcgcatataacttaaaaacgcatcagtcgattttattgcatcgaaagtatagaaacatacaattctgttcgctggaagtgaattcaggtagtctttaatcgcattcccgttcgtagtaggatcaccatacatatcaaatgatttgtaatccagtaaagccaaactcgtaccgtcaattacagcaaggttaatccctcgaccgcgctgtacgtttcggttaataatatcagccccattgatagatacctcaaccgagttgaccgcagaatcgttattcgttccacggacaacaaggcgatatttcacggcgtttgcttctgaaaacacattcgccgtgaaactatcagggccgaataacgccataaattcgttattcgccatttaaattattcctcccacacaaattcacaagtcttagttgctgggtttgcgaagattttcacgttaccgattttgatatagttacgtacaaccagagtatcgacggttgaacccgctaccgctaccgccccgatttctgctggagtcggtttacgacccgcatgatagatcaggtttccgttgatcatcgctttgttgtaatcggtgatattgatgttgaactcagtcaataccttatcgtcaatgccagttaagcgcattttctggacgttcccagagaaatcacccgcctgaacatgtgccgtaccgctcacactggtaaagcgtccacccgtaccgtttacgctaactgacagcgcaccagtcatagtatcacccgttacgttgacataggtactgtcaagatgctgggtaaagtttcgggtgttgatcacggttgcagtggttgtgccgccgtcattactgattgttacaccgttccaaccattagttgcagcggttcgtaattgtaccgtaggcgttgctgtacttgcaacaaacaaatcaccccccgtggtgatattagccagagctttaccattcagacgaatgttcgtaccgtaatacgccattgtgccgttaccgacatcacctactgtcagaacgtcaaccagatccgttgtacccgtcgccaggcgatacgtgcttgcctgaacagtttcatgccagatcgtatccgccacgccactacggaatgtacgaagcaagtttttggttcccgcagcctcaccactcagaacagtatttgcataaacagtgtttgctttcgcagactgattaatgttattgttcgtggttacggtgttgttaaccgttaccgcagcgttagccgtcagtgttccgttagtggttacgttaccaacgaagttgcttgtaccgttaaacgtgttatttccagttaccgtctggtttgcatcacgacgcatccagcttgcagcaaccacaccgcccagactcaaactattctgtgccgttgccattttcggtaagaagttttgcagagcaaagttcagaccgcgaggcgatacagcatagaaatcttcgagataatcgtcaacggcctgagtagaaccaaccagattatcaccgatgaaagtgtttgattgggtagtgataaacaccgcaccgcgtcgagttgtcgtcgcaccccacgccggatcagtaccgttcaagaactgcatggtagccggagtaattgctaggttagtagcagtacccgcacccgcttccgcgttagtcgcacaacgaataataccttcggcggtatccgtcgctttcttcgcttgcagttttttaggcgtgatcaccacgttatccagagtaccagcatcagtttcaccctgagtcgcaacacgtaaagtaccgcgctgtgtttcagtagcagacgcaatccccaggttaatcgttgtccagatagtgccggactgagttaaaccatcagcagttgcaaccgcaacatgactcgtaacgtcgaagaactctttcagcttaaccggaacaactgccttattcgttaccgtacctgctgcaacttccgcagtggtagcgagggcaataataccatcaagcgattcagtagccttgcgatcgttcagtttcttaggcgttacagcacggagatcatcagttcccgtgtttgtttctgtctgggttgcgatctcaatcaatccgatacgcgattcagtagacgttttacgatgcagcatttcaggagttactacgatcggcattgaagcagatccagcagcagcaccagttaccacttcgttttcagtcgccagaacaaccagaccttttgacttttcggtcgccgtcttctcgttcaatgatttcggggtgatcagatcaacaccgttattgaagttgtagacgttagtaccagcatccccacgtaaagccccctccgctgtcgtagcgcccgttgtaacgagtttcccgatacctgctagggtttcggtcgcgcggcgcgtgtcgagcttcttaggcgtgattgcggtagtgtcatcagtaccagcgtttgtttctgcctgggtagcgatttccagcaccccacgacgatcttctgttgctgatcgttcgttcagctttttaggcgtcacgatcacgtcatcaaggaaggttgctgtcgtgttctggttaacttccgcagttgttgccaggcgagcgataccacgacgcgtttcagtagcggttttattcgccagtgtacgcggggttactgccagttcatcagacggcgtatcttcatggttcttgtttacttctgcctgtgtagccagcgcaatcacacccagacgagaacggtttgttggatcgacacgttcaatgatcgggcgatactgtgcaactacccattctttcgtagctttcagatacgacaattccatgtatggaagatagtcagtatcggcattgaaagtcagagtgtcaacactgaaccaatcattaggcggataatccttacgctgtgggaactgcatcatgtttttgttggtgcggatcttttcaccggaaccatctttaactttgatcgtgcagttctgcgttttccccatcatgtacatactgatatatacgcgatcaccttctgcaacatcttgcggaagagtcagcgttacattacgtacagttggtgggttgccagcaatcggagtgatgaacacgtaatcgttaggcaacatgttcaggtcatcactgatacgacgcagacgaacgcgctgatcaccgtcataaacaacccaacggttattagcctgatcgaacatgaagataccataaccggaacgctgtgaagtcacagaggttacgttattgataccgtcatagctgatcgtgtgtccgctaccaggataaacttgcagagtcgcaacgttcaccgaagcaaggcgatccagatcgtaagttgtgattgagtcaccatcgtttgcgtagcgaggcaactgcaacgtaattttacccgttccactgttacggaatgttaccatacccgcttgcatttggaaagcggttaaaccagtcgcattaacaaactgcgaatcacggttatcacgcatttcagcaacacgccataagttgccgttaaaaataaacgcaacggtcatatatgggtgagtcagtcgataagagcttgactgaatatcacgtaaacggatctgacgagtgtttgaacgcactaacaggttgttgatccctgcaagaccgccaccatctttaatagtgataatatcaccctcaacaggggcatctggcagaatataggtcaattcagagaaacgaccgtcagccattaagtacgtaccggattcaacagggagaccgtcattgctcgttacgttgttatatacccattttggatcgttacgggttgagatccattttgtttcatcgaaagcacccgctggtgatggaatatctgcgcgagcgtaccaaatacgacgcgcgtacatgatagccataaacgcagcataaccacgggtagaatcgtattgttggatcgtgttaaattcgttaaaaaagtcaacgttcacgccgtcgctcaacacagagcgtgatgctttaccaacgttgataactttttcgccagcagcatcaaggccacttgtggcgcggaatgatttagctaccattatcgttttcctttatcttattcaatactgatatttataaacaaaaaaggcgaccatcaagtcgcctttttctcacggtaattgttcagccaatctttaacaatcgcgtgatgaagaggattcgcataatctaatttgtttcttttcttgtatggcgtaaaagcgtttttctctttgtccgtcatttggaaaagggtttgaaatgatttgcgttgccttttcgtttgaactgcttctgtggtttcgataatggcatcgggaaaatatttttccttcatgtatttcgctaaccgcatatcaggcacaaataaattaatctttcttttgctgttgttgtgtcggatatcagaacgagcgcataactgaaaggctggttcgtaatatttactgacaacataagcatcaactaattcttcctcttcaagcccagaggacaccgcaaccgctcgcaacatttgacgaagccagggtaacgggttgtaactgaataatgccaccacgttagtataacttgaatagaagttcaatccgtgcgagttatacgggatttcctgcccctcgctaaacttcgatctgtatgtgttggtgcaatagatgaactgttcgccccctaaaagcgcctccacgcgttttttaatctgggtgtatattgtcgtcccagattgagagagatcgcccgtataacgcgaataatccccctctgcgagcacatgtattttaatgcgcttcgtgtttttatattgcttaaagtcaaccagcgtttgaagcggtgaatctttgaactcaacatcatgaaacgtttgtaagatcttccctgtaatcgtatctttgatgttggatgaagcaatggttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagcccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatgtacagggaaaaatccttatacaaatcaaagtcatcaatgtttttgagtgctgcatgagtgataaagatcacatcataatctttgacaacctcacgcagcgcgtcattgttggttcttttggttcggtgatccgtgtcaacaatcaccgctcgtttcccttttacctggttgatgtagtagtcataagactgttttgataacatcatggaaatcgaagcgatgattgctttttcgcccgtttgattgatatggttcagaatcgcctttgttttaccgcttgacggaacacattcaatcgtattaaagatcatttattcttagcgtatttcttctggtatttcttgattgcttcgtcggtgatctgtttaggcatttgacgtgctttcttcggtttcagtggttcgacaccgaagatttcaacgccgtaatgtttcagtatcattgcaacgatttcctgacgaatgaagttgcggctaaccttttcagggaattgatctttaatctgcttatgaagacgatcttcgagcgcgtccaggtgagtaggagtgatgatcgcggtattatcgcgatcaacgaatttctccatgtattccatcgtttcagcatgaacagcatttgcagcagggagtaaaatttcacggctcatttaatcaccaataagttgtttcagttgcagataaccgccgataagtttgttatcgacaaaaatacgcgggtattgaaacgctaaactacgttgccttacccgttttgctaactcttcgatacgtgggcgatcgtattcaaagcccagatcgtttttcgcttctttcagaacgggataaaatgtatattctatccctttttctgtcaacagcttttgcgcttgtatacacccgtaacagttatgaagactttcgggaattccgtagatttcgactttcattcttctttccgtatggtttgagatcctgcaaaatacgctttttctctttgcctaacagtttttcgatattctcaacagcggttaactgagtgtgcagatcgaacaggtttgcaatctggtcttcctgcattttcagttcagattccatgttgatttgatagatgctaccaccactgaaaacatgttgcaaggcgaaacgaagcattgcatcagatttacgtactggcatcggtgcgatgctcaacgtttccaggttagccccgaatgatggatcgatgcggagatcgcgcataggattttcctgtacagggcgatacgtgaatttagggatctccatcagacgcagatccgatccggcaacaccagcggaaacctcttccggcgtagcgatatgcataacgttttcagcctctacacctttactcagattaacttcttctggttcttctgaggtgaattcaccattttccggcgttacttccttgaaccatttccatagtgatgcagggagttcatattcgtaaccaccgtccatgataaacgcgcggtcttcgaactcaccgatcgaggtgcgatcaatcgtcacgtaacctttttcacgaatgatgtttgcgatacctgttttccaggttttctctgcaaagatttcaggggatacggttaaaccgtaagtttttccagcgaataattccatgattacctcaaataaaaaaaggggatgccgtaagcacccccgaattatattacttacttgccagcaatgcaagttttgcggcggcttcacgaactgcgcgagctttctgcgcaacaacttcgatcgctttctggtgttctgtcagtgcgtcttctaccgcctgtgcagcttcgatgatctctttgtcgcgttgctgtttggcaatatcaacggtctgaaccgctggggtatctgcctgaactgtgccagtaccgagttcacggaagaacttacgctcacgatgcataatatacgggagagtacgatctagtgtgatggatgcatcaccgtcgccgtcaacagactcaagcaccataacaccgttgttgtttttgatgtgttgcacaatgcgtttgttcgcggtatgagagcgcaggaaaccagcttcatctaccagaacatacggacgaccagcaacgaaatgtgtaggcatcgcttcaatatctgctggttgtggcacagcaggttttgtaactggttcggttgtcgctggagcgaggttaacaccaccatccagttcagaatccagatctggtttcactggcgcaggagaaacggacggtttgcctactggttttggctttttagcgcgttttggcgctggagctttagccggagcaacttctgtgaagtatttcgcttcccatgcacgaagggtaaacattgcaacaccgaccggagcgtcaaaggtgtaggtgtcaccgttacggcttgtgatggttacaacaccatccagatgtttgttgatctgtttcgcctgtacgctattggcggtgtttttgccgttattggtgaaaccttcgacatcaaccagcttgtattttttgccgttttcgaagcgggtttctttggttctcaccgtccacggatgtgagccgcttcctttggtgatgtttttcagcgggatcgaccacttccagcaatagtcacgggcttctttacgggttttgaaattcagaatcatgatattatctctcaattgggttaaatttatgctacgtggatatcttaacagaactacaaaccaggtcaagcgatatttttaatttcgatggaattctttttgaactcaatcattcgctgattatccgaaccgcgaaacggtttcttagtcggtagatccttttcgtaccgtccatcgatcagaacatcaatgaatggtaacagcttagagcgttctgtatcgccctgtaaggcttcgagggtgtaacccgtccaaacccacacatctttatcagggaacgtcgcacggacgcgctggagcagttttaagagcgttggatgattggtgcggtaaaacggatcgccgcctgtaagcgtcaacccgtccacatggggatttgaaaggagtttaatcaactcgttttcagtctcttcggtgtatggtgtaccgttgcggggattccatgttgatttgttgtagcaaccttcgcatttatgattgcagccagtgacaaacaacactacacggattcctttaccgttgaccatatccatgttgtagatgcggtcaaagttcatcagccttttgcccctgggaacaggttgttcagcgcctgtgtgtctaatttcagttgaatcattttatagtgcctttcttctcaaggatcagttctttgatccgttccacgattacggcgtattcccagttggctaacttctgggtatcacaccactgttgaaaatccttcattgcttttacgtgaccttctttccagtaagtcaccgcgatttcgttgcaaagattttcagtagcagtatttttgattttcatgatttagcccctatagtttgttgtctacaggggcatattataacatcattcgtcgtccgtcaactcttttttgaatccgacataataagcatcagatccattccatgtggaggcgttaacgctacccaacagaacacgacaaggcatatgtttaagcgcagactctacaacctgggatactgaatccagcggattgctaccagacacccagcggagcagatgacgatcatcaccgttaatcggatcaacgaattcaaatctgataccgttttcaatcagttcgtgcagaagaaagtttatcgctttgcactgcgctttgttaatcagcataaatcacctaccagatctttatcaattttggtgtatgtgagcgccggatcatacttctccagcacgttctttttgcacgaatggatgaacttttccatcgcacgggctttcatcaatactttgaaatcttcaccaaagcattgtttgattgtgggaattgcacgagccgctttgtcacaatcaatgatcagtttgtactcgccttgtgtcgtgacaaccaccattgagatcagaacacaaccatcaaatcctttttcattgattttatggaagttcagcttatccgtagtgcttgccaggttcgcataacgatccccgcgaatgttgcccggagaactataccgagaaacgttgattgaaggaatacgaatatcttcaacgatatcgcacgacgcaacagcttcaacgaaatcgagaattctggtcgctttgatgacgtgcgccttaaacgaaccgacttctaactcatattcatctttccagcctgaatagtagtcaaccgcagggctaatcgctttcatgagcgcttcgggaatgtcaatgtgccatagctgttctgcgtactgtttgcgccagtctggataagttttacgtgctggtttgaatgcactgttgccgtcttcgaacatcatttcacttttcctctctttttcgtaaatgtcgtacacacttcttcgttcgtaagcgtcttttaggttgctgtttactatactatcatgcgtcagttcttcgcaatactttttatcccattcagaacacgcatgatcaaccatttcctgaaaaactcgctgtggaacattcccatctacaagaatcctcaataagcgatcagtatcatcattcggtaaagtatgaaagtttttaggaagtttaacatagaagtttctcgcacgagaaatcaaccattcttcaccgcgatcacgttcaatagtgtaatcgtacatagcaaaaaaggggctttcgccccttcctcttatttcgcgttcagggagtcgatgtaagcgctaacgtcagcggaggttacagaagcggcatttttgccacccagcaacacatcaatcttcgtcacgatggtatcgacgcttacggaggtgtggcctacagcggcgatcacgtcttccggtacagtcagacccagactttcggtttgcttgttcagttcgatgatctccaggttgattttgacatcagccagtttgcgatccagttcgacgacagagagatcaatctctttgttcatcccttccagttcttcgatcttcgtctgcaagccctgccagatgttacggtgttgcagcgccagaacataatgactgttggacacttcctgccccgccgccagcagttttttgatctcagactctttaccactgtgaaggtctttgtgttctttgactttctttttcaacttcacgatttcctgaacagcagaaacgcgagtatgttgcagacggtcgatctctttgatcaggatacgtgcagcactgcgccaggcttcttctggggaagtgttttgttcaattgcagtttcaactttaccagtcacgaatgctacgattttcttgaacataattttaccttatttgatttcaaattgattggtgaaccattcaggggctttaacaactttcccctctctgatataaccgattttacacagttcgttggtcaagtcaagtctttttccacccgccatataaaattttaatctgcttactgggatcaccggacggataacgtcgcgatagccgaaatgcgcactacgcaccactatagagagcatacgcaaacggttgatacatccggtatacgaac

SEQ ID NO: 40 - DNA, 179471 bp, Unknown
  source: /note="Description of Unknown: M16-7a Bacteriophage Sequence"
attatattctccaaattgaatacattcattatagccgattgaatcaggtgtttcaaacctacttccaatctatattatttaataaaatcagcgcgaagcgcttccgtgagcgaagcgaaacggatagttaaactggttaaaaagtatacggaaatgtactgttttctctatatataaaatataaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggcgagtaccctgaaattgttctagcctttgatgataacaagtattggcgcagaagtaaagcctggtactacaaaaagaaacgaaaaatggaacaagaagcatcggattgggactgggatcgcctgaatggtttccttcacccgacatacgatgaaatccgtgctaatttaccgtacaaaggtatccgtgttgacttcgcagaagccgatgacgtgatcggtgtggtgacgcgtaaagcggtatccgaaggtaaacgtgtcctgatcgtttctgctgatggtgactttgcagcccttcaaaaatatcagggtgtgcgtcagtggtcgccaacccaaaagaaatgggttacaccgaaatatggttcacctcgtaacgatttgcgcatgaagatcatcaagggcgataaaaaagatagtatcgcttgcattaaaatgcgaaatgactatattgttacgaaggttgaaggagaacgcgccccacaaatcagggctgctgaactcgaagcctggctggaagcggacgatccgaccgtgggtatgcccgaagagtgggcgatccgttacagagaaaacgaagaacttcgcgactttgattttattccgaaagatgttgcaacggcaatcgaagaagcgtacaatgctccaaaaatcgggaacaaagcaaaaatggagaaatacttcatggaatgcaaacttacccgtatgtatgaaaaactaagtgacttttgaggtaacaaaatgagtgtagaattactgcaagaaaacccagacatcgctaaagcggttaaagaactgatcaaagaagcgtcgaacgtgaaaacccagatcgaacacttccagggttctttcaaagacatcaaatccaaagcgaaaacggattatggtatcgacggtaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaaccgtaccgaaagcgatcatcgacaagattagcgacgaagccattaaaaacaatctgctgcgtccttctgtggctaaagaccacgcgacgacgcaaacactggatgatttcatgtgaaatttaaaaccccgtttgacagttcagacgctaattcccgtttgaaaccgatcgcggtatacaaactgtatctggtgatgaaaaatcactttgctgggaagtatgacgcgatcaagtacaaatgggaaataaagatcactgaaaaagcgttcgaaaagagaagagataagtattttttcaaaaagttagccgaaaggtttacattcaaagaaatatatcttatacttctctccaacatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggtattcccctctcaacggtgtttcagtatagcgtcaaatcatcaacctcgtatatcagcaaactcgtacagtctggggtgatttcttatgaatcattcttgatcctcgactcgtttttagacatcataaataaacacgatgaaatcgcaacggatttcgtctggaatgaatttagtaaaaaactaaacgcatacagaaaattagttgaaatcagtaacgaagaaatcgtaaaataccgaaacttaatgaaacaaactttaattaacttaaacgagaaataacatatgtcattctttaaacgtcaagatccaaccaaactgcaagaacaagtcgccgctctgaaaggttcatccggcttccagaaagatgaaaaagagtggaaactcggtgtcgatgcacagaaaaacggttctgcggtgatccgcttcctgcctaaccgatctgatgatgaactggcgttcgtgcgtatcgtcaaccattcattcaaaaagaataaccagtggttcatcgaaaactgcccgtctactcacggcgattacgatgcttgccctgtgtgtcagtatatctctgaaaacgatctgttcgaaaaagcgaaagtgaaaggcagtgaagccgaaaaaacactgggtatgatcggacgtaaacaatcgttctgggcgaacattctggtggttaaagatccaatgcacccagaaaacgaaggtaaggtgtttaagttccgcttcggtaaaaagatcatggataaaatcactgcggctatcgcggggaacccagatctggatgaaccaggtgttgctgtgacctgtccgtttggtggcgctaacttcaccctgaccgcgaagaaagtaggcgactggcctaactacgacgacagcaagtttggtgttcctggcccaatcaaaggcatcgaagacgaagcgcgtcagaaagaaatctttgaaggtatgagcgatctgcgtccaatcactgctccagaccagttcaaaccaactgcggaactgaccgcgaagttcaccaaagtattcggtggtgctgcaatgggtgctggcgcaagcgctggtgcggatctggattcagaactgaactcatttgacaacgaactgaaaaacttcgataatggcaaccattccaacggtgctaaagaatctggtggcgtaagtcaactgaacgtaggcggaagcgtaccggaagatgataatacacctccgtttgacctggaaggtggttccggtgatgacgacctggataaactgctggatctgtaatgcttacgggggcgaaagcccccaatttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggactgattcacgacgctcgcgaagcgggtacgaaaatcacagaatccaaaagcaaagaattccttgacaatgcggcggatcgcgttgtagaatccctgattaacggcacttttgcctaattgaaaactataggttgaatatgaaattctctaaacaaacgatcgatatcctgaaaaacttttcccagatcaacccgtctgtaatgctgaaaaagggttcgttcattatgacgaaatccatcaacagcgtagtttacgcagaagcaacgatttctgacgtaattgacgaagatgtaggtatctacgatctgaactcattcctgaacatgctgaacgttgtaggcactgatgccgaagtaactcacgatctgtccactggcgaaatcgtcattcgtggtgagaaaatgaaaatcgttgagcgttcaagcgatccaaccacaatcgtacagcctaagaagcgtctggaaatgccagttgcggatctgattttccagattagcgcgaacgatttcgaaaaactgatcaaagcgtcacgcatgatgaaactgaccgacctgtctgttgagccaatcaacggcaagctggtaatcaccgcgaaaagtaaagaaagccagtcaaccttctctgtagaagtgggcgattacgaaggtgataacatgttcaacttcgatatgaagattgacaacatgcagttcatcaacagcgattacaaagttgaaatctcttctcgcggcgctgcgaaattctcgtccgaaaacggcgttgcgtatgtagtggtacttgaagcaaccagccagttcaagtaagataaacaaagtagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctgggcgcatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctctatgacgcagaagaaaggcggtaaaatcattctgattgacgaattcgatcgccctggcatggcagaagcacagaagcacatgcgtagctttatcgaagcgtacagcaagaacgttactgttatcattaccgcgaacaacatcaacgggattcaccctgcgctgatctcccgctgtccggtagtcaagttcggttccccgtcgaaggaagaacgcgttgaactgatgaagcaaatgatcaaacgttgtttcggtatcctcgaaatcgagaaaatcgaatatgaccagcaggtgatcgccggattcgttaagaagcactacccagacgcgcgatccatcgttaaagctcttgggttctattctaagcgtggcaaaattgatgctggtattctgtctgagattgttggttcggacatcacaccagtgattgaggggcttaaagcgaagaacttcaaagcactgcgagccgaagcaatcaagtacgcgcctgagtatgaaactttcctggctaaacttctggatgcggtatacccgatcgtcaccaacgaatctaaggttgcactcattcaggcagtaggcgaaaacaacgcacagtacgggctggcagtgaacaaagagattcacctgcaatacctgttcatgggcttaatgcttaccctcgcgtgggaggcttaaaatgtcactggctgcttttctcgatgaagaagaactgaacgaacatgaagcggcctggcgttctaaagactgggacaagatcgaagaacttgtgaaagagtacaccaaagacaaggaaaacaccttgtttatggtgctcgaagaactgaacaacgggaagacaccattacggatctctgcccttgattcatacgataagtttttcatcgacaatgcaatgagccagcatatcgaaacgctgatacctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacacgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgtatcgggatcgcaaataacaaaaagaaaatgctgtggcagtcttgccacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtattgactcacgcacaaaaagctgaatggactttgaaatacaagtaccggatcggacattaatcaaaagcccttgcagaaatgcaggggctttgttatattggttgtacaccacttgtgaggactaaattatgaaaattcgtattgaagaaatcatcaaagctattgaatccggtgatcatttgatcaaccgtctgcatagcgaagacatcaaactgtctcttacttgcaatctctctgatctgcgcacctacgcatacgcgcgggatcacttccctaagttctatacccgcatcatggaagaatataccgtgctggttgaacaactaaatcggcctgacacccaacgctatcacaaattagcgcaacgctcgcttgatctgatcaagctggctggggtatcattcctgtcacgattaaacacggagaaagaaaaccgtaatgaatgaattttatctatccgttgagcaaatgggcgatcacatctacgagcgcttcattgactctgagggacgcgaacaggttcgcaaaacaaaatatgcgcctacaatgtttcaacacgctatggcgggtgtagactcgccatatcgcgacatttacggcaagacctgcatcaaaaagaacttcgaaagcatcaaggaagcaaaaaactggatgcagcgaatgaaagatgtaggcatggaagcgctaggcatggatgatttcaggctggcgtatatctccgattcctacagaaaggaaatcgaatacgatcgcgacaagatccgcattgcttcacttgatatcgaagttaccgcgcctgaattccctgatccacgcgaagcaaaatacgctatcgacgcaatcacccactatgacagcgttgaagataaattctttgtgtacgatcttgtcgagggtggtttagatgaatgggtagcgtcaaaagttgataccgaaaacgagatcagcgaagaagacttgaagaaaattgtttaccgttcattccagaccgaaaagtcgctgatgtcggcttatatcaaagactggaaagagcggacacctgttattgttacgggatggaactcaaacaagttcgatatcgcgtatatcatcacccgttacctgaatatcttcgggcaaaacgttgttcgtcatttcagcccgttcgggaaagtgactgcgaagacaacaaccgaccattacgggaacgaacaactgggctatgagatttacggcgttgctcaaatggatggaatggatctctataagaaattcagtttcaccccgcaaccaacttacgctctgggcgcgatcgctgagttcgaaacaggtaaaagcaaagttgattacgaaggttcgctgtctgaactgcgtcaagcggatcaccagaaatacatcacgtataacatcgttgacgttatccgcgtgttggatatcgacggtaaacgcaactttatcgaactggttctgtctgtagcatactacgcgaaaatcaatttccctggggttatgtcaccgcttaaaacgtgggacgcaatcatttacaactctctgcgtgaagagaagaaagtaatcccagaaaacaaacgccatactaaaacgccgtatgatggtgcatacgttaaagatcctgttgtcgctccataccgttacattgtatcgttcgacttgaccagtctgtatccatctatcatccgacaggtgaatataagccctgagacaatcgctaacagctttgcagtgcgtccgatgcatgaatacatcaataagactgcgccgcgtcctagcgacgaatttagctgctctcctaacgggtggatgttccgacgcgatgttaaaggcgtgattccggtcgagatcaagaaagtatttgatcagcgtaagacgtggaaaaaacgaatgatggcgggtgagcgaaatctcgaactgattaagcacgaactcgaacacctgacagacgcgcacaaccaaatgatcaaccctgatttcgagttctacgaagatttcggtgatgaatcaaaagctgtactgaaaacgctgtctaagcaaatgcttaaagccgtgaagaaagtgtgtgagaagaaaatcgcacaggcgaacaccgcacagcttaaccgtaaaatcagtatcaactccctttatggtgcgttgggtaacgaacatttccgttacttcgatattcgaaacgccagtgcgatcaccatgttcgggcagttggctattcagtggattgagcgtaaggttaacgaataccttaacgaactgtgcaacaccacggattacgcatacgtgcgttactgtgacaccgactccatttatgtttgtatggacaacgtgatcgcgaaagtcggcggtgaaaataagttcagggataacaaccattgggttgacttcctggataagttcagtaaagaacgcatggaacctatcattgataagggctaccgcgaactgtgtgagtacatgaacaacgtcgaacacctgatgtttatggatcgcgaaatcatttctggaccacctctgggatcgaaaggcctgggtagtttctggacggctaagaaacgatatgcggctaacgtatgggactccgaaggaacccgctacgagaaacctaaattaaagatcatgggaatggaaacccagcgaagtagtacaccgacagcggttaaaaagttcttgaaagaagcgatccgtcgcatcctgcaagaaggtgaagaatccttacacgaacacttcaaagtatttgaagaagagtataaggcgcttgactaccgcgaaatagctggtgtatcatctgctaataatatctcaaaatataatgatggtgctggcttcccaatcaaagggacaccaaaccacatcaaaggcgttctgttctttaaccgccatacgaagggtattcaaggaatcaccccgatcatggaaggtgaaaaggtgatggttctgccgttgcgagataaaaacccgtggcaagctgattgcatcgcatggcaatccggtacgcgtttaccaactgagatcgaagaagatattttgaagtgggtagactacggcggattatttgaaaaacatgtgattagcccgttgcaaaacatcacggaagcatgtaaaattgattacgaaaaacgcgcatccctgaacactctgtttggtgatgactggtaagacctgacggggcagaaatgccccatttatataaatttgtgaggaaaatattatgcgtgtatataaaccggaaaaataaatgtctaataaagcactcctgaaaaaactgatcaaaaactcgaatagtcaatctgcgtcaattctgtctgaaagcgatgttttcaataacatcaccaaaactcgaactcgtgtaccgatcctgaacctggcgctgtccggcgctttcgatggtggtctgacttccggcttaactctgtttgctggcccgtcaaaacactttaaatcgaatctggggctggtgacggttgcggcgtacctcaaagcgaatgaggatgctgtgtgtctgttctatgattcagagaaaggcgtaactaagtcttacctgaaatcaatgggcgttgaccccgatcgtgtggtgtatactcgtatcacgacagttgagcaacttcgaaatgacgttgtaagccagcttaacgcgctggaacgcggcgacaaagtgatcattttcgtggactctgtaggcaacaccgcgagtaaaaaagaactggctgatgccctgtctgacaacgacaaacaggacatgacccgcgctaaagcacttaaaggtatgttccgtatggttacgccttacctggcggatctggatattccgatggtgtgtatctgtcacacatacgacacacaagaaatgtacagtaagaaagtcatttccggtggtactggtctgatgtattccgcagataccgcgatcatcctgggcaaacagcaggtgaaagaaggtacggaagttgtcggttatgacttcatcatgaacatcgagaaatctcgcttcgtgaaagagaaatccaaattcccgcttcatgttacctatgagggcggtatcagtatgttctctggtcttctggatctggctatggaaatgaacttcgttcagactccaacgaaaggctggcgcggtcgtgcgttcctgaacacggaaacgggcgaacttgaactggaagaaaagaaatggcgtgaatcggaaaccaactcgatcgagttctggaaacctctgttcactcaccagccattccttgatgccattcaggataagtaccgtattcctgacaaagagatcactgacggggcagcactcgaagatctttattccgacgatgtagtagaaccgtcaaataaatttgatctcgatgacgatatccctgatgatgtggatatgtcagaagagtaataaacaactgggggctttgcccccttttaataggtgaatcatggacattgaacaaaaaacaaaaaacattcttgatgaagcaatgcaggacgttattcaagaactgttgatcaacgatgaaaacgatgttgcacacttagtgtacatccataaggtgtattgggataacggcctgaaagtcgaatttagtacgccggacgaagacaaagaaaaactgattccgctggttcacgatgcaatctacgcgcagatcaagcccaatctcccaaagcctgaaaagaccttatgggcggcgttgaaagtaaagctgtataatttctttcagatgttcgctaatctggtttaagaggtaataatgatcgtcgaaacaatattttcaaatctggtttttaatggtacgtattttgttcaggcgtggccccatttacgccgtgaatatttcgaagggaacgcgcagattctctttgatttgatggataagcacgtacaggaattcaacagcattccttcacaaactgctttagaagtagctctggacaaaaagagcctgagtgatgtagtctacgaagataccaaaaagatgatccgcagcatgaaaaatgcgccggaagatctggaatggttgatgaaagaaacggaaacctattgtcgtgacaaggcaatgtatcgcgctctgtcccgtgcaattgagatccaggcgaatgctgaaaaacctgctggcgaacgcaacaacaaaatccctgacgttggggcaatccctgacatcatggcggaagcgttagcgattagcttcgatagttcggtcggtcatgattacttcgaagactatgaaaaacgctggatgctttaccagtccaaagcgatgaagattgctttcaatatcccgatcctgaacgccattaccaaaggcggcgcagaacgtggaacattgaacatcttaatggctggtgttaacgttggtaaatctctggggctttgttctctcgctgctgattacctgcaatcaggtaaaaacgtcctgtatatcagtatggaaatggctgaacacgtttgttctaaacgtattgacgctaacctgcttgatgtgccactggacgatatcgacaacgggaacatcacctatgcggactataagaaccgtatggaacgcctcaaacagtcgaaggtcgggcgtttaatcgttaagcaatacccaacagcaggggcgaacgctaaccacttcaaagcgctgattaaagagcttaaattgaagaagggtttcgtacctgatgtgattattgttgactacctggggatctgtgcttctacccgtgtacgcggggcggaaaacacatacatcctggttaaagcgattgccgaagaacttcgcggtttggctgttgaaacaaataccgtaatgtggactggtgcgcagactacccgcgccgcgtgggatgcttctgatatcagtatgggcgacgttgccgaatctgctggtcttccagcaaccgctgactttatgttagctgtgattgagaccgacgagttagctgatcagggcttgcagttgttcaagcagatcaaatcccgttacggcgataagaaccactttaaccacttcaaactcgaagtgcgtaagggtaatcaacgctggatggataccgacaacagcgatatcgggttcaaatctgattataaaggtcgtcagatgccgaaaacgcttgaagaagcacaaggtgctatggtaaaacaagctgaaactaaccgaagcagtaagttagccgaagtagcaaacagcacagacattcaattttaacggggcttcggccccctccaaaggtatagtgaaatgaaaaagattctcgttattgtgttcctgatcctcctgtctctgaaactggcagcaatcggggttatggcaaatgcttcctggtggcttgtgtttgcacctctgatcgtgatcggtgtgattaagctggctttctgggtgctgtttgtggtggcaatggcaaatgtattccctaaactgactctctggattgcaaaaaacgcaaaataatcctgattaggggttgacgggagttatgattgtgataatatgactcccgtagacaacgaaacggattaaaggagataccaaatgaacttactgaacaacccatacgacgaagtgatgaacccagaactggatttcagcgcgggttatttcgatgcagtagtgaacagcgtagtaaacagaggtttgctggttgaaatgctgaaaagtgggaaagcagatgttgaaggtagcgttgatttcctctggggcttcctcccaatcgacccagaattcaaactctgctgtaacgaagttcaggccaaaaacgttcttcggtatctaatcaacaaagcataaaattaagccccgaaaggggcttttttgtatctgtaggtattgcaatccttctcgaaaggtgataccttattctaaacaaacaaaggaggacatcatgaaacttgcaatcgcttttatcttactggttctaaacgcacttatgggctttccgttcccgtggttagtgcttctggctatcccgtttgcatggaacctgttcagaatcggtttagcgggttgtgttggtgtcctgatgcttatcatcggcgctatcggtggcaaagacgcttttatcggtgttctgaaagccatgaaagagggcgttaaagaaggtttagtgaaatgagtgatttattagatatgatacttccagacgaagaaccggagttcgatagtccgtatcgttccgaatggatcgtatcggttgatgataaaggctatgtcgatatcatgcgctggcctaatattcatcctggctatctggacgaaggtatcaatgcggaaatgctgggtatgcctgaacaggttgaagatcctgctggggtgtataagtggatttgcagcccgtgggaaacccgcgactgggaaagcaatattgttgatgactggggctttgatgtggtagaatctacccctctgttcttattaccggaaaaggtcaatggcgaagttaacgaaagcggaaaccaaacaacacaacaagataatggatctggtggagtctgacaaggcgctaacctacgacgaaaaattattcattatcgaaaacttccatgaaggtgcatttacgaataactctgaactgggtgcattctttaccccgatcggacttgctcgcgatttcaccattgatgcttgtaccagtggaagcgttgttgacctgtgcgcgggtatcggtgggctatccttcgcgatgcttcatatgatgatgtacgccaaaccgcgtgaaatcgtctgtgtggagttaaaccatacatactataagttgggtaagcgtatcgtaccggaagcgacctggattaacgcagacgcgttaacgacggagtttgatactatgtttgatatggcgatcagcaatccgcctttcggcaagataaagacatccgattttaagggtaagtatacgggcgcggaatttgaatataaagtgattgaacgtgcttcacagattgcccgtgcgggtacgttcattctcccgcagatgtccgcgaatttccgttactctggacggcgttatttccaacaggacgaatcaacgacaacatcgaaatgcaaaaagtttcttgatgaaactggccttgaaatgcaaccaggttgtggcattgataccggatactatctggaagaatggaaaggcgtgaaaccgatgtgtgaagttgtctgtatggaattccctgaaccggaaccagaacccgcgcaaaaccttttcactttcacaatagagtaaagactatgagcgatcaattaatcaaaaacatggatttaacctacagtgtgcgaatgattcgcctactgaaaaagccctggactgaatggacggcttacaagctgggtatcatcgacggtcaaggggaagtattgaaaaacccgaagacgaaggaagaactggaagcatattccccgttccatcgctctgtaagacatatcaagcgccgtttaaacgcggttccttatatgtctgggttcatgaaccttacaagcgcgtatgactctctacggaaccgttggaatctgaccgagcaagaacacgaagagatcatgatgaacctcccagaacttcgcgaaagactcaacgaagaaatggttgcaggtgattcaggcggaagcgtggataacattgcttcgggtgtgactacaggcgcgatcacgaacaaagggccaaaggttctgggttctacgcgtccatataaacgcaaacgtaaaatcatgaagagtgaagaatgaaaccattaccgcctttgaattaccggatctgggttactgcgaacaattacacctggtttccgatccgtatcaagtacatgagcgacaccgcgatcgtgtacacgaacgaaagaaaaacttcatcgggtgtcgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggagaattcagtatccattcccgttgtccgatttgtggcgactccatgaaggataagcacaaaaaacgtttctggatatttccgtcaaaacgaggcacacatatgatgtgtggttgttttaactgcaactacagcaagccgttttctgtgtttctgaaagactattacccggatgattatacggcgtatttgatggaatctttcaaggatcgtaaagatttaaaacagacgcacgaagaaccgccgaaggaagaaaagaaatatattcctgaattgcagttctgcgaacgtctggacacgttgccagaaaatcaccctatcgttaagtatgttgcaggtcgtcacatacctaaagacaaatatgatcgcctctggtttacgcgtcaatggcaacacctggttaactctgtgaatgcggacgcataccctttaccgaaggatgaaccacgtttggtgatccctatctttgatgaaaagggtaaaatcgagtcattccagggacgcgccttgcgtgacaatgccaacgcaaaatacatgacaatcaaagcatgtgaacactcaacgaaagtgtatggtcaagataccatcgatccgttgaaacctgtctacctgcttgaagggccgctggatagcctgtttgtagataatgctggtgcgattacgggcggacaaatggcgctgtccgatgttccgtataaaaatatgcgtgtctgggtgcttgacaatgaacgacatcatccagatactaccgcaaggttaaaaaaattgattgatgctggagaaaaggtcgttttatgggataaatgcccctggccgtcaaaagatatcaacgaaatgattaaaagtgatggtgctaccaaagcagacattgctaagtatctgaaagaaaatacagtgtccggtttaactgcaaagttgagattcaaccaatgggatcgaagtccgaaaaagaaatagatggtataaaggatcttctgactaaggttagaatagattacaataccggaaaggtttactggcttaaaaatggtatggaagctgggacaaaaaccaaaaagggatatacccgcatcgaaacaaaaggtgtgaaatatatgcgtcatcgtgttatattttactcgcgttttgggtatctccctgatatgattgaccatatcaaaggcgttgatgttggtgactttcctgataacttgcgtccagcaagtacagcggaaaacaatgcaaatcacattaacaaacgtaaaaacaacacaagcggttccattggtgtataccctcgcggaaaccgattttctgcaagtattcaatataagggcaaacgaaaacatttgggttcttttgcaactgttgaagaagcacaagccgcttacaatgatgccgcaaaagagattttcggcaattttcataatgaagagacaaataaatgactgataaaactcctgtttttaatagctgtgcgcacctggttaaccctgctgatctggaatttgttgataccgaatatcaaaaggttctggcacgtaacggcgatcctctgcaatcaatgctggatctgcaaaaccacgcacaacaaagcctgtctgataccctgaattgggttccacgtccgaacgaactgaaaacgtgcggtgagatcctggactggctgaaactgcaagatgatgcgatagcagacgaaacccgcgaactttacaccgctctgggcggtatgtctcgcggcgcaaaacctgcttccggtgtctggaaaccgtggaaagcaaatcaccaggaactgcgcaatcaggtattcgcagaaatgaaagaagaagacaaactggaaatcttgtttgaactgattgaccagtggcacttcttcatgtgtaagttcctcgcgttgggactggatgcggaaaccatctacaagctgtatgctctgaaacaggcggaaaacctgcgtcgttgggctaacaactactaatggaaatcaccgcgctacatgccgtatttgctttgtcttatatcgtctgcgcggtgataacgtatctcttcggttggtgcgttttccacgttaacggtgttgacagaaaagccgctttgatagtattatcattgctatggtttataggttttttctacgtcatctatgaggggcgaaaatgattgacaaatactatatcattgttacgaaagacaaagacggctttactattccatacattgaaaacgggaaaacgccggaactgtttgcatcaccgcaacttgcaaaagataaattagattttatccgcaagtgctacgaaaccaaactgaactacacgccggatgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagtgacgatcagaagtccgcgcatgatcgcgttatccacaacatccagaacgccattcatacaactattacgggtggccctggtgttggtaaaacaacactggttaagtttgtctttaacactctgaaagggttggggattagcggtatttggttaactgccccaacacaccaggctaaaaacgtgttagcagcggctaccggaatggacgcaacaacgattcattctgcattgaagattagccctgtgactaacgaagaactgcgtgtgttcgaacagcagaaaggcaagaaagcgcctgatctgtctacctgtcgcgtgttcgttgttgaagaagtctcgatggttgatatggatctgttccgaatcatccggcgcagtattccaagcaacgctgttattctgggactgggtgataaagatcagatccgtccggtaaacgccgatggacgtgttgaactctccccgttctttgatgaagaaatctttgatgttatccgtatggataaaatcatgcgtcaggcagaagggaacccgattattcaggtttcacgggctgtacgtgatggtaagatgctgaaaccgatgtctgtcggtgatctgggtgtgttccaacatgctaacgctgttgacttcctccgtcagtatttccgccgtgtcaaaacgccggatgacttgatcgagaaccgcatgttcgcttacactaacgacaacgtggacaagctgaacgcaacgatccgtaaacacctgtacaaaacaacagaacctttcattctcgatgaagtgatcgtgatgcaggaaccgttagttcaggaaatgcggttgaacgggcagatcttcaccgagattgtttataacaacaacgaaaaaatccgagtcttagaaatcatcccgcgtcgggaagttatcaaggcggagaagtgcgacgagaagatcgaacttgaattctatcttctgaaaacggtatcgctcgaagaggaaaccgaagcacagattcaggttgttgttgatccggtgatgaaagaccgtctgggtaactatctggcctacgttgcgagcacttataagcgcatcaagcagcaaacaggctataaagccccgtggcattcgttctgggcgattaaaaacaagttccaggatgttaagcctcttccggtttgcacgtatcacaaatcacaggggagcacgtatgaccatgcgtatatgtacacgcgcgatgcgtatgcgttcgcagattacgatctgtgtaagcagttaatctatgtgggcgtaacccgcgcacgttacaccgttgattatgtataaggggctttgccccttttgaggttattatgaaattgactatccttgtaaaagacattccccgaattcttgaagcactcgataaaattcgagaaaaagatccacatgcggtcaatgtgttcgggatgtatagcgcagcagatccgcaagaagttattcaccgtttgcgcttcattgaaaagtctaacgatgttctttattctccgaacgggccaagttattcatggtctcctattgcaaaagaagttgaactgacttatgatgaatatggcgttatcgtgctgatccttagaatggcacgaaacattcgtgaagataaagacatatggacactaatatcatgaaaaaagatgtatctatccagatcccacgcctccacgcggaagcaattgcagacctgattttcaaaactccacgcacagaccttccggtgaatattgatattgatttgctctatgaattcatggaagctgttgaaaatgcaagccgcctggaaaaagcgatctatcattgcggtttgcgtcagttcggaatgatgtcaatggctagcgaagagatccgaacattcgacatcaacccagaagttgcgcttacgctggcatacttcatggaagagtacaagcggagaagttcatgagtcatttacccgtagattacgtatgggattatgaaacggttggtccttccccgaacgggaaggtgatcgaactctcatacgttccgtttgttgatgatccacacaacccgccaacgttcgcggaactggttgcaaggggacgcaaatacaaattcgatttgcgtaatcagcccgatcgtattgccgatcagggaacaatcgcctggtggaaacaacaaagcgaagaagcccgcacaatcctgaaaccgtcgccggaggatttggaactgtatgcaggacacagacaattcttcgaagacctgaaagcggacggtgtgagccgttggcaatcactcgattatgttcgtggtcctgaattcgatcgcggtatcctggttgatatcgtgcgtaagatggttggtaagatcgacatcttcgaagatatgccgaccgtgttctggaatagtcgcgatgtgcgtacatgtatcgaaaaccgcctgttaacgcgtgatgcttcgacctgtcctcttcggaaagggttacttgatggttttgtgatgcataattcaattcacgattgcgcgaaagatgttttgatgatagtctatgcattgagatatgcgctggggctggaagaacccccaagtgaagaagaaaccgatccattgagtctgccgaggaaaagatgattaaattatcatttgtaggtaaaactgtacatgcaaaaacactgaacgaagcaaaagcgcagatgtttgacattctcatgaaccccgcgttcgttaaagtcgaatacgatgaatatgttgttcagcctggcgatagcatgtattcaatcgctgaaaaattatacggttgtggtgagcgctggcagtctatcgctaagttgaaccgtaaaaccgttagtaatgcaagctatatccttccggggatggttctgaaattgcctcagttagtcgaattatgataaaaagcccttgcattcgtgcaggggctttgttattttgtagggactgaaacaaaagaggatgaaacatgtttggtgatttgaaagaaggtttgaacattttaatcggatttgcgatcattggtgtgattgcgtgtgtatccggtgcggtgtggttgtcttatcaggcgatcgtgtggttgggtgaatggcttcacattctggcacagtaaggggatattatgcgtttatgtttagttggtgtaggtttcggtcgtgcgttaactcaagggttaatcgactcaatccgctggattcagccaaatgttgaaatgtattcattacctaaccggatcgaatactctgatccaacaccgtacaaaatgaaaccttatcaagcgccacgcgttaaccgtgtgttacatcgtcaatctgtaaacaggggtaagtgatgaaagagcttacgatcgtcgcagcagttctgattttcatcatagtttcaatgattatcgtcagactgtaccagcacggggaagcgtttgaatggttcctggatcacgacaaagcgtttcgaaagcatttcgcgggtgagttcatctttactcatgtaagcgtagcaagcggtacggtaacgtttgattttgacgggaaagggaaatcataccatgttgaactctcccttatggatgctaaacgcgtgtatgatgccacacaaaacggcggtatgcgaaagatgcttatacctctttcaaaataattttaatagcctcttgcaatgcaaggggcttttttgtatattgcgcacataccaaacggaggcaactatgacacgtattaacacaatcgatccttctcttcttctgaacgaacacctgattgcagaactgcgcgaactccctcgcattcccaatgccgttttatctggtaaggcaaaaatcaacctgtcgaaaatccctgcattgtatacgctgggaaccggacacgtaaccttcttttacaataagctgggataccttcgcgatcgtcatgctgcattacgtgctgaatacctcacgcgtaacggtaaagaatacatggacggtgcatacgaagatttcgatcttagtccgctgtcaaactccctgtttcatcgtcatttgtgcgcggactggcaaccaacgccggaatcagtgaaaatcaatgttgagcgtatccgtgaacgtttcgaactgcgcaaacgtgcttatcggttcggtactgagatcatcaacgacgaagcggcatgggatacgtattacgaaaaattaaaagaaaaatacgattttctttgatttgggtattgacccaaatttcgatatgcagtatattacacacatcgaaacgaaacagacaaaaggaacgcatcatgaaaaacttagaagccaaagtagttaaagtcctggttaagaacggtttcaacgaaaacgacgcggtagcaatggttgaaaagaatctgaatgatgcgttgaaagttagaccagaagcaaaacctgctaaactcgcagaggtgattgtatgcatcatgtaaaagtaagcatcaaggatatcacggtgggtgacaccgtgatccacgaagggaaaatgaagactgtcgggaaaaacgatatcaagcacgaccctttgtttggtgttctcctgttcggtgatagtttcaacttggggagaacttttattgagcgggttattttcccgaaatggtatcaagggaaacgggtttagcaaatagcactttttgctaaagacttcacgggatagctttgatatagttatcccatcgaaacgaaacagactttaggagattgccatgtatacttttgacgaactgaacgccgcagcacagcctttactggatgcgatgttcaaagcccgtaacggtggcgcattcgaaaacgaattctttgaaactgttttcgttctggaaaaaggccgtaagtatcatcgtattgtgcaggatactcgcaacaaacagactggtgaaatgttcgatcagcgttcagttgctggtttcctggacaatgacggcaatatcctgaaagccgcaggatggaaagcacctgctaagggtattcgcggtaatatcttcaacaatccagagaacgcgatcgaccgtagcggttacgttcgctatcttcgctaaaatcggggcttcggcccctttggaatattaaaatgaaactatcagcgaccgcaagttggtcaatcttcggactgatagccgcaggggttttattcttcgcatggcaatcaagagatccgaacaaagcggcgtatgaagccgcacaacgagtagtagaacaggatgcagaagcgcaacacgaagcaatgttaaaacaacgtcgtgatatgggctttgtggagactgtgagttacacaaacgcctttggtgatgtcaccacgcgctctgtaaacgtcttagggcgcacgaaagggacaatgctcaccatcagacgggaaggaaccggaaagctcgtagacgtgtgtttccgcgcgattacggacgattccaaacgtagtcttttcgccccatacttttctacgcctgtctttgcaaaatttgacggcggagaaacaaaagagtttagcgcaagcagaggaagcaccgaagattttctgtgtattacttccccgcaacgcttccttttcaatatggatcgtgctagtgttatgcaagtccagttaacattcctggatcattactccaaagtgccggaagtacatgaatggaacctgtcaacatataatgaggttgtgaagaaatgagcagacgcccaaagaacagcaaaaccgaaatgtttgcaacgtttgatgtaaacggaaagaacattgagggtaaaccatgcacgaactcaaagtttatgcatatcgccggattgcctggtatgagtgttaagacttcgtatgattgtcattacaacgaagaaaccacctctgtttatttgggcgaagaactcatggctgaacgcgtcatgcagtgtgtgcatttccctggtgaacgtccagaagtgaactgttttattgttggttatcataaaggtattgtaaatgagcaagtataaagttggcgatatgtacgccccgaaatctattttaatggctgtgtgtcaaatggcatcagaagccgatccgattcgtcgtatgtatgacgcattgcgtaagaatccgatggacttcaattcaccacgccgtatcagtatggtgtatgaagaaacagggattctttatcttgaaggtattcccgttcctgtcaagttcaacgatatgaaagggcttttcaatccggtatgggttgcgccagaaccggaaactgaaatcaaccacgtcaataaaggtgaggaagtaccgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgtgccctggatgtgatttacctgaaactgagtacaacccacgggacgacagaaatcgcgcaagtgatcaataaactgcttgataagaaattagataagtggtactctacttgtagttaatcaattacgaggatcggatcatgttggtttatcgcgttgaattgaaagcgtctatattatccaaatatgatggatggtgtaagcaattaggcccgtatacgggttgtgtcggtgatgaagacgatctctatgagtatctcgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatttgtatggtgtacgaaactgatctcatgtttgcagggaacaaacaatgtgttttcagcaaagccgcaaccccgatccgttttattccattgtcagagatttattaatgccaacatatacctataaatgcaccaagtgcgaaaaagaatttccgaaaatgtccagcatcgcaagccgcgacgaaccgaaagattgtgattgcgggggcgaggcgaaacgaacggttgataagccgcagatggtgaaagacggtttcccgtacaacaagtaaaccccgaaaggggttttctttttcatagaaccctatataatgcctgagaactaataaagaggtgaatatgagtttagatttcttaatggacgataacgagccgcagaaagcaccagaagccccgacaaagggcgctaaggtggatgaatcattctgtttgagcgatcgcgatcacattcgcaaacgtccgaacatgtacgtgggttcagtgaacaaagaagcccatgaacgttttatcatgggtaaattccgcaaagtggaatacgtggaagggttggtgaaaatcatcaacgaaatcctggataactccatcgacgaagcgatccgaactgatttcaaatttgcgaacaaaatcgaagtcaagattgatcacaatctggtcactatttcggataacgggcgcggcattccacaagatgacgtgagaacgccggaagggaagattgttcctaaacctgttgcagcatggacaatggctaaatccggttctaacttcgatgacgaaaaccgcgtaacaatggggatgaacggtgttggttctttcctgacaaactgttacagcgcaatctttatcggtgagacatccaacggtaaacgcaaagtcacgatcaactgtacggacggagcgcagaacatggattaccgcaccagcccgacgaaggagcaagggacaaccgttaagtttacccctgacttctctatcttcggtgtggatggtatcgacgaagagacaaaggaagtcatcaaagaccgccttatggcgcttgcagtggctttccctgccgttaaattcacatataacggcgatatcctcccgaacaaattcgcgatgtatggcgcgatgtatggcgataaaacgattacccagacaaacagcaaaatcagtttcatcctggcaagcacagaagacggtttcaaacagaaatcattcgttaacggtttggatacgaaaaacggcggtgttcacgttgacaccatgatcgacggcatctattccgaactggaaccgatgatcaagaaaacacacgctatcgagatcccgaaagcccgtgtaaaagaatgcttgactttggttgtgtttttgcataacttcaatgcaccagcttttgatagtcagacgaaagaaaaactgacgaacaccgctggagagttcaacaaccacgccggactgaactacaaaaagatcgcgaaacagattatggatacttctgaaataatcactccgatcattgagtccgctctgattcgcaaacaggccgcagaagccgcagccattaccaaagcgaagaagaaagctaaaaaggcgaaggttgcaaaacatgttccggcatcagggatcgacactgacggggtagaaaccactttgtttctgaccgagggcgattccgccgtggggcagtttatcgagtgcagaaacgaagagacacaaggcgcatttccgctacgtggtaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgctgacgttgacgggggcgatattctcaccctactgattgcgttctttagccgctggcctgagttgttcgagaagaaaaagatccgttatatccgcacaccgattatcattgcgaaagtcgggaaagatgaaaaatggttctactcccttgaagatttcgcaccgttccgcgataaggcgaaagaggtacgatatatcaaaggtctgggttctttacgtaaagaagattacgatcgtgtgttgggcgaccagttaaaatacgatacaatcgtactgggcgatgaacacaaagacgttcttgaactgtgtttcggtgatgattccgatccgcgtaaagactgggtgaacggaaaacataaattttcggtgaaataatggaaagaagtattaaagacgttgtacaggtggaggggcttacatttgccctctatacaatttattcccgtgcgatcccgcacctggtagacgggttcaaacccgttcaccgtttcttcattcattccgctgcaaaaggcggtacaggcttccagaaagtagcctctatcgctggcggtgttgcgatgtatggataccaccacggggaaacatccgttgaagaggctttgtctctcatggcggcgcactggtgcaataatatcccgcttttcgaacgtgatgggttctttggttcccgtctggttaagaagcctggcgcaccgcgttacattaaatgtaagctgtctccactgttcaaggctatctacatggacgaggatttaacgatcccacatgaagaccctgaacatgtaccgccagcctattacctgcctatcattccgatggtactggttaacgggttcagcgggatcgcgaaagcatacgctaccaacattccaccacacgatccggtttcggttctgaatgggtgcgttagctacctgaacgggaaagatttcacgcttgacctgaaatacccgcactttaaaggcgacatcaaagacgggacgatttacggcaagtatgaactccagggtaaaaccaaactggtgatcacagagattccggtcaagtacgatcgcgtgaaatatatctctattctggataagctggaagagaaagggtatatcgtaagctacaaggatctatcgaaagaagatttccgctacgagatcaccctcaaacgcgagtatgcaaacgggcttacccctgagaagatcctgaaagatttcggattgattgagaactcaaacccgaacatcaatgttatctttaacgggaaactgcattcatacgagcgccccgaaacgttgctgaaagacttcgttgatatccgtattggtgtttaccaacagcgtattgataaacgcatccaggagactaaggaagcgttagataaggcgctggcgaaggttgacttcatcgaccagatgatcgcacaacctgacgcattaaaggggcttagtcgcagcgaagcggttaaacttgtctctacgtggacgggttgcgggaaccacgccgaaatcctggttgcgatgaacatctatcatctaaccacggatgaacgtcaaaagctggaagacgaagcgaacgaactgcgtaagcaactgaaatactgggaagaaacaaccccgaaaactgaatatctcaatgatttgaaagaactttcgaagaaattgaaataatttacaaaaagcctcttgcgttgcgggaggcttttttgttatagtgtcctcactgatttggggaggatataaaaatgttcaaaactcgtagcgacatggaaataaccatttgggccaaaagcatcatggcgaagcatggtttatctcattggtctttcaaaattaacggacgtttcaagcgtactctgggacaatgcagctacggtcgcaagttgatcgagttgagccgttctcacgttaaggaagatatctacgaaaacgttttagatactctcatgcacgaaattgctcatgctctgaccgaaggggctggacacgggatcgtttggcaacgcaaagctatcgagttgggcgcacagcctacaccatgcaaaagccgtatccgtgagaaatcagtaattcaggaaagcgaaaaagacgtatacgcatttttcctgaaaactccgaacggtgaagtttatcagtgcaatatgacagaaaagatgtacaatgagatccaggaaggtaaacgcaacattgcaaacatctatatttcaagaaacaaacgagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcattgatatgaaagaccgcgaacgtcagaagcaacaggtttacgaataccttaacaggatgtgcaaacctattgaatacgggcttgatcaaaagcctgtgaaatattcttgtgacgacataatctttaacaccaagtgagatataaacaatgaaattacgtcagttagcaccgcaaaccattcacactacgggcttcgataaaggcgaacgcacgaagtttaaaatggctaccagtgcgaaaacgttcaaaatcctgtcatcaaccatctacaaatacaagatccgcgcaatcattcgcgagatctcctgtaacgccattgatggtcacatggtagcgggtaacatgaatccgttcgatgttcagttaccaactgttctcgatccgcgtttcatcgtccgtgattatggcacggggttaagtgactggatggttaaagaggtgtttaccacctacttcgaatcaaccaaaaccgacaccgacgaactgatcggggcgctgggactgggtagtaaatccccgttctgctacaccgaaacattcactatcgaatccatccaggacggcgttaaacgcgcgtacacggcttacatggataatggtgaacctttcgttgaccaaatctacgaaatcgaaacagacgaacctaacggcgttcaaatcactgttcctgtgaaagtcgaagatatcgcagagtgggaacgtgaagcagcgcgtgtttacgaaccattcacgggtatccgtccgcgctttatcggtgttcaggttgatgtcaactggcaaccaaaagaagcagacgaacgcgggatcatccgttataagtccatcaactattccggcgtatacgcgcgtatgggtaacatttgctacccaatcgacatggatatgttcgaaaactcgctgttctattgctaccgtaacagcaattacgcttatattctggatttccctctgggatcgctggacttcatgccgtcgcgtgaagagttgagccttgataaagtcaccaaaaaagtaatcctggatcgactggaaaagatcaacaaacgctatgacgaagaattagttgcagagttcgacagacaaaaaacaacccgcgataaactcgtatggttcaacaatctgcctagtttgttacagacatttgtaacccgcgataaccgtttccgtgtgggtaaaaactcactggctgaaatcctgacgcatatcaaaagtcctgagactgcaaccggaaaatacgtctggggcttttgggctaacccatatgacgggaaagaatgtgtatatgagcgcgttggatctggacgccgttatgagacatacaaagcggaaaccaccaaacgacaggacgttatgcgcattatccaaccgtggcgacagaagaaactgttcattgttgaaaacgacaatgaagcgcgttcactccgtccatacctgatcggttactgcatgttgcacggttcggatcgtatcagtttcgtaaccaaagagattaatagcgatcctgttcaggacttgatcagaactgggtatttcgacgaatccgaaattgtcacactgaaaaccagtgaattaaccaaagaatttgacgtgtacacggaagatcgcaagcgctggaaagcaacgcgtgaatcatcttctggtgattgtgaatcgcgcccgaaaacgcctacagcatatcattacttcctggatgatcggggcaacttacagaaaaatgatctgtacctgaccaaagcacagttcgtgaatctggatgaaatgtacgctatgcgcctgtacgggattgatgaatatagccgactggatggcgaagcaccgaactattctctgggtagcatcgccagcagtatgatgaccatgttaaaggtcacagggctgaaagatgtgatggttctgcgaaactctctgtggagtcgcattccagatagcaacatgaaatgtcttgatgattatctggtaaaacgttttgcagacgcagcgaagaagatgaaacctaactggttccctgcatggatttcatcaaaccacggaagcgagatccgaaccctgcgtgattctatgggtgtaacccttgatcgcatggttaaaaaccgttacaatccagaattgtatttgttgcttgattatcttgatggtaagttcacctacgatactatcgagggcaaaaacaaatcaaaaactgtggtgcgtaaccccttacttcgtgaaatgtcaacgaagtattacaaaatgcggaaagatatgaaagaacgcgttgatactgcttacgatttatttgcagaacgcaacccatcaattcattacatgttgttacattcatcttattctacattccgcagtatgtttaatgatgataaaattgtgatggatttggtcaaccttatacggtggaaataatgagaaacgttaagatccttgatgatgtacaaaagaaagcagtttatgagggctttctgaccagcgcaaacaaaaccgcactggctaaacaatttggtgtaagcgtccgaaccatcgggcgcgttattaccgaacagcattctaagtataatacggaagcatcgaaaccacttccgcaaacagatgtcaaatctaaaatgattggttctgaatcgttcattactctggtactggacggcaagatcatcacagcggattcgtcacaccctaacttcgaaaaagcacatgctttaatggttaagggtgacattgagggagttgctaccctgttggacacaacgcaagcgttgaagatttacagcaaaggcaacattaaaatcatcgggcataaagtcctgtacaaagatatcgtgtttgacagcggtatcacgcaacgtatcgttcgtgaaatgtacaacgatcgcccttacgagcacctggtgaacttcttcgagaagttgatggaaaacccttcacgcgatgctgtgtatcagctttacgggttcatggtgcataacgatatcgaactggcagatgatggagatttctacgcgtggaaacgtgttcgtgaagacttccgcgatctggcttccggtaagttcgataactcccctggtgttgtggttgaaatgccacgtaaccaggtagacgagaataaaaaccgaacctgttcatgtggtttgcatgttgccgcaaaatcgtacctgcctcactatggcggaggacgtgggcgagtcattcaggttaaggttaatcctcgcgatgttgtagcaatcccaacagattacgacaacgctaagatgcgcgtatgtcgttatcaggtgatgcgtgatgtaactgtgggattcagtcactactaaccccaaaacagcgcctggagcgattcaggcgcggaggattcgattatgaaattcctacagagcattcctgactactggcagaacttgagcggggcagaaacagccatcaaaaccgctaaagaaatctggaacggaggcaacgttaccgctggacgtacagaagacggcgaacagacatatttcaaaaaaccttacggtattatcgcaacagcccttgcatttaatctgggttatgttatgctggtaatcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattcggaaataaactggtaaagaaaaatgaaaagaattctgacaaggcttgacatccacaaatatgctgttaagataggtgacatgaagcgcggtgacttcaccaagttcgaaggggttgacctgaaagaacacggcttctacctggtagttgatgataaaacgggtaaggtagtattccgattctacgtagccccaaatcaacgccgtaagactggcgcaaaccgtactctgttacgtatcaaacgccgcgaacacgaaccatcagcgatggtggccttgctggatagtgcttctctgtacttcgttgcacacgataagattaaaaacctctttggtttctcaaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagatgaaatcgtagcaacttttgacaaaaccctgaccgaactggaagcgcgtattgctcacgataacgaacaggtcgcacaggtagcagcagaccgcaaagcagcggaagaagaacatcagcgcaagctggctgaactggctaccaaagaaagtgatcataccgcaagcgcaacacgcgccggacgtatcgcggataaaatccgcaaactgctggattaattctctaaaatggggctgaaaagccccaataaggaaaataatatatgtttgtaatttcttcgtactatgattcacgtcaacgagtatcgctgtcttctatttccaaagcaccaaaagatatagatgacttcggattgcttaacttcgtcaagaaagaaatcgaccgcgttgttccagaaaaatacagaattgttaaaggatctgatagcttaactatcgtaaaactgtatggcgaagtcagtattcaacatcatgtgccattatatcctcgatgaacaacctggtagcgaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacactgggctgtatctcgttgaagccgacgaagatatcattgaaatcctcaaaaccgctcacggacattatgtgaacggatgcaacaataccccagaacaggatcacgctgtcaatatcgttaacctcatgttagggccgcgtacagatgacaacctgaaatgggcgagcgaatccaacgttcctcatgagtatgtcggaatgtattatcagtgcaacgttgacgataaagcgccactgataccggaaaaacagatcgatttagtagttcgaacaggtttcttcttatgagttcacaaattctgttcagcaaagaagatccattaggcacagattcatcggtgcaacgcttattctggcagatggattatgcaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaagcccttgacttcggttgagggcttttgttatattggctttgtcgaaacgaaaccactaaggagattcaccatgactaacctgactaaagttaccgcgacatacttcatttcttctggcgctaaaaatgctatgtacaccctgcgtgtagagcgtcgtggaggtgaatttacttctgataactatatctgcaacctgtctactgacccagataaagcggaagcgaaagcgcgtgaatacttcgatcgcatggtggatcgtcttaaccagaccgatactttccagatggtgttccagggcttcgcagatttcgatctgttcgaacgtcgcggtaaactgtctgtacaggataccgaaaatctggaactgttggagaagggcatcatgccaatcggcaagcgtaaaggtgaagtgattgctgatatgccgatgtatactattctgtggtgggctgatcagtgcaaagaaaacggcaacgatagcccagtatttcaggctatttgctcttactgcatgggcgtagcgctggagaaggattatatcgctaaacgtgaagagatccgcgcagaatgggaagcagagcgccaggcgaagatcgcagcagcgcagcacatcggggaaatcggtaagcgtatggaaatgagcggtgttgttgagaaagtgatttctctcggatatacccaagtttcttattacaccgaagtggaacgtttcatgaccaaaatcaacgtagatggtaacgtggttatctactacggaaacaaaattgttgaagagggtgatgtgattcgcttcaaagcgacacccaaacttcacaacgaatacaaagaagttaaacaaacaatcgttcagcgagtaaaggtattagaatgacgtatgaagaaatgttaaacgaagtgtgcgcgggtaaaaccgcgtaccgcccaattaacccagatatgatcgtgttccgcgaaggggatacgatcattcgacgttctcaccgcaaggttgagattaaccaggtattcattgccagtgttgaagaacagaaagcgaccgactgggatatagttgcagaagatgataaccacgacgaacttgacctgatcttagtcatagataatcacccactgggtgttcgtccgtacatttaccacaatcaattcagaggcgaagtgattctatcatgacacacgacgaagccatgaaagccgctacacgcggttttaaagtcgcccctgtgggtaaggctgggttctttgtatatcacagcgtagaggctggtttccggcgcattacgataggtaatgttggatactggaacgatgaatatgttccgacaccttacgaactcatgcgcgtatgggacatatacgataaaaacccgatgacgaaagtaaaagatttcatcaatcgggctttgagtagtttgaaactgaaattatcatcgaatcctgcctaaaattcttgcggcctgattgcacacggtcatcaacttcgtatcggtgacttcgggcttctgtatataccattccattagaatcgatccagaatagtagttttcgagattgaaataaggacaactaaaggtatatgctaccggaacaaggtcttttgttggaagatacgggcttgcaatatctgagatatagtacagcccgtttatatgtctattatactcttccgatgtcttgtctataggatagccacccagatttttcgggttaatctgttgcggtaacttcccttcatacgcaattatatcaacaaaataattgacattcttaggtctgaacccaaagattgccgaaaaatccgcacccgtagttaaatgcactatgtttaactgttcgatggatgcggattcaaacttttttgccttttcaatatccatcgtcggcacgtctataacgcttgaagatgttttccagactgaaaataagtcatcccacttataccatgttacgaacataatgaaaatagtgacgataagaaccaatttaatgaataactgtttccatgttttgaccgccatgatgaacgatattacccgttcaagcaccgccaatttatcttgtaatagtgccatgtttaaacctcaagttcgggggatgccgaccccgaacatatttaggaatttacttaacgttgagtaaccaaaccagaacggttttgacctacacgggcgtttagatagtcataccatctggtcgcctgagaagaaacaacctgatattgacgatatccatcatgtatacgtccgttgttgtcaaaatcgaatacacctccgtcatccatagtaagccgtaagttaacagcaggaccgttttgaatagtgattacactgatatcagggcttgattgtgcagcaactacagtaccgaacgcattaccattaaaactaccaccgaccgcaggataaccagaaggttttgaatatggcgagtaccaaccaaccccccactgaccacgatatcgggcgttgttatagtaacgctcatacactgtaaagttgatgttataaacggactgattcgccatttgtgacatccagaagggtaaaccgattcgaacggcattaccagcagcagacatcaatcgttgtcctgtttcaccgaccgcagacgaaccgatccacccaggaactcctacaatagccataattttacctctttaaagaggggcattacgcccctattttccgttcgattgcttccaaacgttcacgcaattcattgattgccgtaatcagaagcgcgttaacacttgacggggagatcgtcaacattccggtttcttcgttttctcttactgcttccggtaaaaccttttgcagatcctgagcaataatacccgcttcacgaccattaggttcatcatcttcgactttcagtttcttatcgtagatataacctttaagctgttcgactttactcagtgcatctttcagttcaactaggttagatttcagcctgatatcagaacgaatatacacatcgttaaaatcaccatgtgcccctgagtaaatataaccactggctttgaattgaccaccattgtcgaaggaaaaatcagcaccaccaacgtgcataactacaactggattgccgccacccgcatggacatccattgcggcaatatgctgatcgccccagtgtgtagctttccagatgctgtatgcttggtttctggagttaggacaatccaccaacaacccagcagcacggtcacgccattcgacccacgcaccaccctgaacagtaccacgaagtaaacctttatcgccaccagtggttagcgcacctgtagtttgaatcatgccgtcaccaaaacgagttgaatattgctgactcgtagtacggattttcaacccgccatcaggttccgcatatataactgccttttcaacagtaccagcattgtttctaaaccataagtgactgtttccgtctgagtttatgctcacaccgtcgccaccacgaacagatatattattctgtgcgtatgtcatgccattaacgtaagcatcaccagaaaacgcaatttcaaccaagttatctgatctacgctgtgtataaaaatgatacccagtaccgtcatgtacctcaaaaaccgcagcacgaagaccactatcaccccagtttctaatagtaaatgcacgttgactaacagcagttgatgcagagttaccaagagttaacgtagtattatctaaccgaaacgccgcgtttggtgtagaaacagcaatatcacctaatcggttatacaggttaacggttgcctgattacttgacccatatccgaaataagagttcaatacactcgtatctctgttccatatctggaacattgctgattctgttgcaggtttataacggatcttgaatccatcattaccagcatcagcagtgaacgtaccaccgtaaattgcgccacctcgacctaagccattaccatcaataaaaaattccatagaactatcggtagcacctgacatcagtcggtattgagttccctgtatagtttcatgccatatcatatcagggagaccaccacggaaacgacgtagtaagtttttaccgccagccgcaccagttgacagcatttcaattttgggcaatgccggatcaacaccattcatatacagcggagttgaagaagatattccacctttcacatcgatgaatatcgtaccagcaccacggaaatagtgataaaattttccgtcatcagctttcacgccaagatgcgttgcgccgtcaccagaagcattaccatccgaacttgtatcaagtcggatcaagctgttgtttgctggcaatccagcaccattaacaaaaatttgacgtggtgcggtcaaaccgtttgccagaataagagtaccatcagcagcgaaacgtgttacataagaaccacctgaacgaacatataagtttttaccagtatcagcaaatatcatcgctaattcgttaccgccagcatcacggaattcgacgttacggtttccgtcgccttttgtgatcagttgggttcctgttaagttaccactgaccgttgtactcataccaacgtttaacgaagcaccggaaaggttaattgaaccatcccagccattaagcccaatctgagcgcgtagaattcccgtagcgcctgttgtcttgtttggtgcatcatatgcttgcagttcgatagaacccgccccagtagttgactgatgcgataatagagcagcaaggttagcaccaccaaaaggatcggaagtattcgattttgtgttgacaaacaaagtaaacgtgcgcgtatgctgtgacgggaacggatctgtaaccgcgttgttatctgaacgagtagttaacagataaggagcattccccgcagtatcagcaactatgttaatacgacgaggaaccgttaactgggtgttgttctttaatgtcagatcacccgtcatttcgtcgccagatttcttaacctgtgcatcgttggttacgttgcctaatccgatttcggcttttgtcggtttgtcgttttcggtatagactttaaagcctttatacgttaatgtgtttccagttgggagtaaaggcaaattagcctgactccatatagtattaccgccgatggtagtacccgattttaaatctgccattattagatcctcaaatgcttttatgatatttataaaaagaaaaagccccgaagggcttttcttattttcgggctttgagttccctgatttcctcacggagttctttgatcgcattaaccagcaaagcgacaacagcagaagacgaaacccccaggatttcatttccttttgtatcttcacttgtggtaactgcttccggtaatactttttgcagttgttgcgcaaccaagccagcttcacgggtagtaggttcaccgccgatatattccgctttatcgtagatcataccttccaacagatcgactttatccaatgcagattcgatcttactgaaattacttttcagtctttcatcagaacgaatatacacatcgttaaagttaccattaccagacacggttacttgaccatttgcatcgaaatatacgtattggttactttggtgaatcaatcgaacacgggattgcgtaggatcgttatttggaatatgcacgtccatagcagcaacatgggtagcttgccatacagtagctttccagatgttatatgctgaggtagcaccgttaggcatatcgatctgcaacccagatgaacgctcacgccactgatcccatccaccaccatcaggtgttcctcgaatcaatgcaaaatcagtaccagtacaagggtcaccgctatagatcataccgcctcggaaatcccaagtggtttgacgaacgttatttgttcgaatgtggtattgtccgttagcatcaccccaagttgccgccttttcagcgccgttaagcaaacgataccaaataacactattaccgccagcatccagatatatgttagacgaaccaccctgagcaccgtttagcgttaagccgccagcactactaagagtgaaaagttcagcagagtctgtttgacctgttgctaaacgatacgcgccgccctgaacagtttcgtgccagatctggtcgccattgccaccacggaatcgacgaagataattcttcgaaccagttgcggttgtgcttaatgcagaagaacaataaacgttctgattcaatgcatcctgattaatcataccaccgccaggaagcgtaaagttaccatcttcaccgaatacgaattcacctgaatatgatgtatttccgttagctttgtttggtgtataacagctaatacggataccctggcgacgagaagtattacttactccatctttaaagataaaaccgtctatttctgtactaccatcatttttggcatattgaaatatgatatgacgattagtttcatttttgaaaatcacgtcactaaccgtattgagtgcgccagtcatggtatcgccagctttattcaccgcccccacttctgccggagttggtggagtagacgtgtcgtaaatccgtcgccaaccgttagcatcaccagcactgaacgaccacgcaccaggtgaacccgtaccgcttcgaatccatgatgaattcgcatcgtaatacatttgcaccagagatacacctgtattcaatgtacggcggaagttcgacatttgaccgtaatatgtggtgttgccataaggcccgtcgatcgcgttaccacctactgacagaacatcgttcttttcggttacaacagcagcaccgaaactgtttccttgcataccgcgcggaataccagtgatataacgttcatcatggttagaccagtttgtaggcgttactgtattcgcagttaatgccccgcttacacttaacgtggttgcgctaaccgcagcaaaggtcgaagaacccaccacacggaaagaaccttgttcaacggatacctgttgagtttgagagtcaacaacaaaggaagtatttggtgtgccgtttttgtatgcattcagatagatcctgttgccgccgtcagcacgggcgttaatattcagagttgccagagcaacaccagaaccattaagcccagtgatttgcataatgccctgttcggttgacggagttccggtcacgtcagaacgtttaaacaatatacccggagccgccccgcctgtggtgatatcaacaaaacttttcgaatataatgcgtttgccgttaagttaatacctacggtcacactttggttgaacgtggtgttcttcgcaacagtcccgccgttaatcgtcgagagggcgtttatatcctccgctgttgggcgatcgttctcagtgtatactctccaccctttatacgtcaatctgtcgccagagggcagcagagggaggtttgacgcactccagatacccgcaccacccagcgttgtacctaatttcaaatcagccataaaaatttctcctgtaatgactgtatttatgaaaaaggggctttcgcccctttatctaacgattgacagtttaacgtctttagcggataccgtaccgatgtttgtgttgtttggataacgatataaaccgaaatcaaacgtaacagcaccagaaggaataaccccttcgtttttgtagaatgaatatacgttcgggatcgtaccaacatcacgcatgttgatccctgtgatatacgtattattcgcgtcccagaactgcattacgatatatgcgcctttattgttggcgattgcgttcgcatcgcgtttcatttggcattgcatacggatcgtatcaccagctttcaatccataactgcttagtgatgctttcgttaccgccgcttgctgggtagcagtccattctttgaactgatactccgctgtgtttgttgaagtatattcaaccggatcagaaacaatataatcaagttcagcaaagttatgcgaaatgattttcttgtcacttgcaacaccagtaggcgaaacaggcagagaaagcaatttatcaatcgggttttcgtttccgcttgcgtccacttcggaaagtgtctgcattcgaacaccgttcacaccaaccgcagcaccattacggtttatttcttcgcgcggtactttcgtgatctgtacgttgcgacattgcgccagcccgactttaacggttgacgggtaatgatatacctgtgaacccattcgagcgtttaccggatcggtcgggatagtgaaatatcctgataacgaatgccactgatcaggggctaatccggttgttcgaagaatagatgatacgatccattgtccgctaccgttttcagtccacatatacaggtgaacttctccccctgcatcacggagttctttagaacaatacagatccccagtgaatttgaagatatcgcccaggtaaacatcgttaccgatagaccataatccatatgaatggaagccatacagatccccgctgttctggtatgtctggacatcatcaaccattcgttcaggaatacccgttaccccaatatcactaaattcatcaaacacaacttcaacaaaactcgttgtgttgtctttcaagctaccagcaccaccgacaaagttttccatgcaaatctttttcatcgtcgatgaatagatagctgaataggatgaacggtgagaatagttggttgtggtgatcgggatattaaagaaccgagtttcgggccacgcaacagaaccaattttcctcattgttgctaaaaagttgtcgtcacttttgatcgcatcgaaagtataaaaacacacaattctgttcgctggaagtgaattcaggtagtctttaatcgcattcccgttcgtagcaggatcaccatacatatcgaatgctttgtaatccaataatgctaaagttgttccatcaatgacagccaggttaattccgcgagcagcttgtgttcgtctgtttataatatcagccccgttaatagatacctcaaccgagttgaccgcagaatcgttattcgttccacggacaacaaggcgatatttcacggcgtttgcttctgaaaacacattcgccgtgaaactatcagggccgaataacgccataaattcgttattcgccatttaaattattcctcccacacaaattcacaagtcttagttgttggatttgcgaagattttcacgttaccgattttgatgtaatcacgtacaaccagagtatctacagttgaacccgctaccgctaccgccccaatttctgccggagttggttttcgacctgcatgatagatcaggtttccgttgatcatcgctttgttgtaatcggtgatattgatgttgaattcagtcaataccttatcgtcaatgccagttaagcgcatcttctggacgttaccagagaaatcacctgcctgaacatgtgccgtaccgctcacactggtaaagcgtccacccgtgccgtttacgctaactgacagcgcaccagtcatagtatcacccgttgcgttgacataggtactgtcaagatgctgggtaaagtttcgggtgttgatcacggttgcagtggttgtcccgttatcgttactgattgttacaccgttccaaccgttagttgcagcggttcgtaattgtaccgtaggagtcgcatcacttgcaacaaacagatcaccagcagtgttgatgttagccagggctttaccattcaggcgaatgttcgtaccgtagtacgccagagcaccgttactgatatcacctacagtcagaacgtcaaccagatccgttgtacctgttgccagtcgatacacgcttgcctgaacagtttcatgccaggtagtatccgtcacaccgccacggaaggtacgaagcaagtttttagttccagcggttgccgtactcaaaacagtattagcataaaccgtgtttgctttcgcagactggttaatgttattgttcgtggttacggtgttattaacagttaccgcagcgttagccgtcagagtcccgttagtggttacgttaccaacgaagttgcttgtaccgttgaacgtgttgttgcctgttacggtttgatccgcgtcacgacgcatccagcttgcagctaccacaccgcccagactcaagctattctgtgctgttgccattttcggtaagaagttttgcagagcaaagttcagaccgcgaggcgatacagcgtagaaatcttccagatagctatctacaggctgagtagaaccaaccagattatcaccgatgaatgtattcgatttggtagtgatgaacaccgcaccacggcgcaatgttgtagcaccccaagccggatcagtaccgttcaagaactgcatggtagccggagtaattgccaggttagtagcagtacccgcagcagcttcactgttggttgcacaacgaataataccttcggcggtatccgtcgctttcttcgcttgcagtttcttcgcagtgacaatcacatcatcacgcgtacccgcatcagtttcgccctgagtcgctacgcgtaaagtaccacgttgcgtttcggtagcagaaacaatccccaggttaatcgttgtccagatagtgccggactgagttaaaccgtcatcggtagcaaccgcaacatgatttgtaacgtcgaagaactctttcagcttaaccggaacaaccgccttattcgttaccgtacctgctgcaacttccgcagtggtagcgagggcaataataccatcaagtgattcagtcgctttacgatcgttcagcttcttaggcgttaccgcacggagatcatcggttcccgtgttcgtttctgtctgggttgcgatctcaatcaaaccgatgcgcgattcagtagacgttttacgatgcagcatttcaggagttactacgatcggcattgaagcagatcccgcagcagcaccagttaccacttcgttttcagtcgccagaacaaccagaccttttgacttttcggtcgccgtcttctcgttcaatgatttcggggtgacaaggtcaacaccgttattgaagttgtagacgttcgtaccagcatccccacgtaaagccccctccgctgtcgtagcgcccgttgtaacgagtttcccgatacctgctagggtttcggtcgcgcggcgtgtgtcgagctttttaggcgtgattgcggtagtgtcatcagtaccagcgtttgtttctgcctgagttgcgatttccagcaccccacgacgatcttctgttgctgatcgttcgttcagctttttaggcgtcacgatcacgtcatcgaggaaggttgctgtcgtgttctggttaacttccgcagttgttgccaggcgagcgataccacgacgcgtttcagtagcggttttattcgccagtgtacgcggggttactgccagttcatcagacggcgtatcttcatggttcttgtttacttctgcctgtgtagccagcgcaatcacacccagacgagaacggtttgttggatcgacacgttcaatgatcgggcgatactgtgcaactacccattctttcgttgctttcagatatgacagttccatatatggaagatagtcagtatcggcgttgaaagtcagagtgtcaacactgaaccagtcatcaggcggataatccttacgctgtgggaactgcatcatgtttttgttggtgcggatcttttcaccggaaccatctttaactttgatcgtacagttctgcgttttccccatcatgtacatactgatatacacgcgatcaccttcggcaacatcttgcggaagagtcagcgttacgttacgtacaactggaggactgccagcaacaggagtgatgaacacgtaatcgttcggcaacatgttcaggtcatcactgatacgacgcagacgaacgcgctgatcaccgtcataaacaacccaacggttattagcctgatcgaacatgaaaataccataaccggaacgctgtgaagtcacagaggttacgttgttgataccgtcatagctgatcgtgtgtccgctaccaggataaacttgcagagtcgcaacgttcaccgaagcaaggcgatccagatcgtaagttgtgattgagtcaccatcgtttgcgtaacgaggcaactgcaacgtaattttacccgtcccactgttacggaatgttaccatacccgcttgcatttggaaagcggttaaaccagtcgcattaacaaactgcgaatcacggttatcacgcatttcagcaacacgccataagttgccgttaaaaataaacgcaacggtcatatatgggtgagtcagtcgataagagcttgactgaatatcacgtaaacggatctgacgggtgtttgaacgcactaacaggttgttaacccctgcaagaccaccaccatctttaatagtgataatatcaccctcaacaggggcatctggcagaatataggtcagttcagagaaacgaccgtcagccattaagtacgtaccggattcaacagggagaccgtcattgctcgttacgttgttatatacccattttggatcgttacgggttgagatccattttgtttcatcgaaagcacccgctggtgatggaatatctgcgcgagcgtaccaaatacgacgcgcgtacatgatagccataaacgcagcataaccacgggtagaatcgtattgttggatcgtgttaaattcgttaaaaaagtcaacgttcacgccgtcgctcaacacagagcgtgatgctttaccaacgttgataactttttcgccagcagcatcaaggccacttgtggcgcggaatgatttagctaccattatcgttttcctttatcttattcaatactgatatttataaacaaaaaaggcgaccatcaagtcgcctttttctcacggtaattgttcagccaatctttaacaatcgcgtgatgaagaggattcgcataatctaatttgtttcttttcttgtatggcgtaaaagcgtttttctctttgtccgtcatttggaaaagggtttgaaatgatttgcgttgccttttcgtttgaactgcttctgtggtttcgataatggcatcgggaaaatatttttccttcatgtatttcgctaaccgcatatcaggcacaaataaattaatctttcttttgctgttattgtgtcggatatcagaacgagcgcataactgaaaggctggttcgtaatatttactgacaacataagcatcaactaattcttcctcttcgagtccagaggacaccgcaaccgctcgcaacatttgacgaagccagggtaacgggttgtaactgaataatgccaccacgttagtatagctcgaatagaagttcaatccgtgcgagttatacgggatttcttgcccctcgctaaacttcgatctgtatgtgttggtgcaatagatgaactgttcgccccctagaagcgcctccacgcgttttttaatctgggtgtatactgtcgtcccagattgagagagatcacccgtataacgcgaataatccccctctgcgagcacatgtattttaatgcgcttcgtgtttttatattgcttaaagtcaaccagcgtttgaagcggtgaatctttgaactccacatcatgaaacgtttgtaggatcttccctgtaatcgtatctttgatgttggatgaagcaatggttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagcccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatgtatagagaaaaatccttatacaaatcaaagtcatcaatgtttttcagtgctgcatgagtgatgaaaatcacatcgtaatcattgactacttcacgcagcgcatcgttattggttcttttggttcggtgatccgtgtccacaatcaccgctcgtttcccttttacctggttgatgtagtagtcataagactgttttgataacatcatggaaatcgaagcgatgattgctttttcgcccgtttgattgatatggttcagaatcgcctttgttttaccacttgacggaacacattcaatcgtattaaagatcatttattcttagcgtatttcttctggtatttcttgattgcttcgtcggtgatctgtttaggcatttgacgtgctttcttcggtttcagtggttcgacaccgaagatttcaacgccgtaatgtttcagcatcattgcaacgatttcctgacgaatgaagttgcggctaaccttttcagggaattgatctttaatctgcttatgaagacgatcttcgagcgcgtccaggtgagtaggagtgatgatcgcggtattatcgcgttcaacgaatttctccatgtattccatcgtttcagcatgaacagcatttgcagcagggagtaaaatttcacggctcatttaatcaccaataagttgtttcagttgcagataaccgccgataagtttgttatcgacaaaaatacgcgggtattgaaacgctaaactacgttgccttacccgttttgctaactcttcgatacgtgggcgatcgtattcaaagcccagatcgtttttcgcttctttcagaacgggataaaatgtatattctatccctttttctgtcaacagcttttgtgcttgtatacacccgtaacagttatgaagactttcgggaattccgtagatttcgactttcattcttctttccgtatggtttgagatcctgcaaaatacgctttttctctttgcctaacagtttttcgatattctcaacagcggttaactgagtgtgcagatcgaacaggtttgcaatctggtcttcctgcattttcagttcagattccatgttgatttgatagatgctaccaccaccgaaaacatgttgcaaggcgaaacgaagcattgcatcagatttacgtactggtatcggtgcgatgctcaacgtttccaggttagccccgaatgatggatcgatgcggagatcacgcagaggattttcctgtacagggcgatacgtgaatttagggatatccatcaggcacagatccgaaccagtgacaccagcggaaacctcttccggtgtagcgatacgcataacgttttcagcctctacacctttacccagattaacttcttctggttcttctggggtgaattcaccatcttccggcgttacttccttgaaccatttccatagtgatgcagggagttcatattcgtagccaccgtccatgataaatgcgcggtcttcaaactcaccgatcgaggtgcgatcaatcgtcacgtaacctttttcacggatgatgtttgcgatacctgttttccaggttttctctgcaaagatttcaggggatacggttaaaccgtaagtttttccagcgaataattccatgattacctcaaataaaaaaggggatgccgtaagcacccccgaattatattacttacttgccagcaatgcaagttttgcggcggcttcacgaactgcgcgagctttctgcgcaacaacttcgatcgctttctggtgttctgccagcgcgtcttctactgccagcgcagcctcgatgatctctttattgcgttgctgtgcagcaacatcaacggcctgaactgctggagcatttgccggagctttaccagtaccgagttcacggaagaatttacgctcacgatgcatgatatacgggagagtacgatcttgtgtgatagatgcatcaccgtcgccgtcaacagactcaagcaccataataccgttgttatttttgatgtgttgcacaatgcgtttgttcgcggtatgagagcgcaggaaaccagcttcatctaccagaacatacggacgaccagcaacgaaatgtgtaggcatagcttcaaccgttgctggctgtggtgcagcaggttttgcaactggttcagttaccggagcgaggttaacaccaccatccagttcagaatccagatccggtttcgctggtgcaggtgcaacagacggtttgcctactggttttggctttttagcgcgttttggcgctggggctttagccggagcaacttctgtgaagtatttcgcttcccatgcacgaagggtgttcatagcgacacctgctggagcattgaaggtgtagcgatcaccgttacggcttgcgatgtttacaacaccgttcagcaattggtggatctgttttgattgaacactgttcgcaatgtttttgccgttgtcagtgaaaccttcgacatcaaccagcttgtaatctttaccagtttcgaagcgggtttctttggttctcaccgtccacggatgtgaaccgcttcctttggtgatgtttttcagtgggatcgaccacttccagcaatagtcacgggcttctttacgggttttgaaattcagaatcatgatattatctctcatagagggcttgcaatttagtaacaaattcatctttgctacgggctttgattacaacttccagacgagatttggcttctgcttttgcagcgcccaaactccaaccatacacatcaaccagttcacagatttctttgatgattgcgtttttcattttctcgtcctcaagtttgtttcgatgtggatatcttaacagaactaccaaccaggtcaagcgatatttttaatttcgatggaattctttttgaactcaatcattcgctgattatccgaaccgcgaaacggtttcttagtcggtagatccttttcgtaccgtccatcgatcagaacatcaatgaatggtaacagtttagagcgttctgtatcactctgtaaggcttcgagggtgtaacccgtccaaacccacacatctttatcagggaacgtcgcacggacgcgctggagcagttttaagagcgttggatgattggtgcggtaaaacggatcgccgcctgtaagcgtcaacccgtccacatggggatttgaaaggagtttaatcaactcgttttcagtctcttcggtgtatggtgtaccgttgcggggattccatgttgatttgttgtagcaaccttcgcatttatgattgcagccagtcacaaacaacactacacggattcctttaccgttaaccacatccatgttatagatgcggtcaaagttcatcagcctttcgcctctgggaacaaacgggctttgatcgcttcgtcgataatttgcgggaattcattattcacgcgcttaacgatttcctgacgaaccgttacttcgaggtttttggttacgcgagcaataaacgcttcttcgtccgctttgaggtttccggttgcgttgttgattgcttccagcttgattgaatccagcaggtcggcgcactgttttttaacgtttgtcgtgatcaattctttgatctggcgaataccgcctgaattgatatcgaaaatgtcgctgtatgcatagcgtttctgaatgtaatcagcgaactctttatgcacaatcttttcgatttcgtgattggctggcatcatcaaattgacgtgcttgatcaccatgttttcgatttcttcggttacgcgcttaccgataacgctgtcaacaacgttcttgatgacagcggcttgcagatccattcgcgcttgtgttccttctgggaacaggttgttcagcgcctgggtgtctaatttcagttgaatcattttatagtgcctttcttctcaaggatcagttctttgatccgttccacgattacggcgtattcccagttggctaacttctgggtatcacaccactgttgaaaatccttcattgcttttacgtgaccttctttccagtaagtcaccgcgatttcgttgcaaagattttcagtagcagtatttttgattttcatgatttagcccctatagtttgttgtctacaggggcatattataacatcattcgtcgtccgtcaactcttttttgaatccgacataataagcatcagatccattccatgtggaggcgttaacgctacccaacagaacacgacaaggcatattgttatgcgcagactctacaacctgggatactgaatccagcggattgctaccagacacccagcggagcagatgacgatcatcaccgttaatcggatcaacgaattcaaatctgataccgttttcaatcagttcgtgcagaagaaagtttatcgctttgcactgcgctttgttaatcagcataaatcacctaccagatctttatcaattttggtgtatgtgagcgccggatcatacttctccagcacgttctttttgcacgaatggatgaacttttccatcgcacgggctttcatcaatactttgaaatcttcaccaaagcattgtttgattgtgggaattgcacgagccgctttgtcacaatcaatgatcagtttgtactcgccttgtgtcgtgacaaccaccattgagatcagaacacaaccatcaaatcctttttcattgattttatggaagttcagcttatccgtagtgcttgccaggttcgcataacgatccccgcgaatgttgcccggagaactataccgagaaacgttgattgaaggaatacgaatatcttcaacgatatcgcacgacgcaacagcttcaacgaaatcgagaattctggtcgctttgatgacgtgcgccttaaacgaaccgacttctaactcatattcatctttccagcctgaatagtagtcaacagcagggctaatcgctttcatgagcgcttcgggaatgtcaatgtgccatagctgttctgcgtactgtttgcgccagtctggatacgttttacgtgctggtttaaatgcactgttgccgtcttcgaacatcatttctttcctctctttttcgtaaatgtcgtacacacttcttcgttcgtaagcgtcttttaggttgctgtttactatactatcatgcgtcagttcttcgcaatactttttatcccattcagaacacgcatgatcaaccatttcctgaaaaactcgctgtggaacattcccatctacaagaatcctcaataagcgatcagtatcatcattcggtaaagtatgaaagtttttaggaagtttaacatagaagtttctcgcacgagaaatcaaccattcttcaccgcgatcacgttcaatagtgtaatcgtacatagcaaaaaaggggctttcgccccttcctcttatttcgcgttcagggagtcgatgtaagcgctaacgtcagcggaggttacagaagcggcatttttgccacccagcaacacatcaatcttcgtcacgatggtatcgacgcttacggaggtgtggcctacagcggcgatcacgtcttccggtacagtcagacccagactttcggtttgcttgttcagttcgatgatctccaggttgattttgacatcagccagtttgcgatccagttcgacgacagagagatcaatctctttgttcatcccttccagttcttcgatcttcgtctgcaagccctgccagatgttacggtgttgcagcgccagaacataatgactgttggacacttcctgccccgccgccagcagttttttgatctcagactctttaccactgtgaaggtctttgtgttctttgactttctttttcaacttcacgatttcctgaacagcagaaacgcgagtatgttgcagacggtcgatctctttgatcaggatacgtgcagcactgcgccaggcttcttctggggaagtgttttgttcaattgcagtttcaactttaccagtcacgaatgctacgattttcttgaacataattttaccttatttgatttcaaattgattggtgaaccattcaggggctttaacaactttcccctctctgatataaccgattttacacagttcgttggtcaagtcaagtctttttccacccgccatataaaattttaatctgcttactgggatcaccggacggataacgtcgcgatagccgaaatgcgcactacgcaccactatagagagcatacgcaaacggttgatacatccggtatacgaacgaccagtagcgcgggagaagtcctccagcgtaacacctggggcaatagcacctatcagatcaagataatccttttcaacccagaaccgcccgacagaacatttcgatacaccctcagccatttttgcgtttgggtgtttctcgtcttcgcgcttcttcttgtcctcaaggaacttattgaaccgaatttcttcgagtcggttttcccgttctacccgcgcacgtacacgggagggaaacagagtatcaaggattttcccgatcatatcgttggctttccgtttggtagtttcagatcgaaaggaacattcacaggccggacggtttctaattggagatattgttccatccccacacgcttaccacctactttgttataacggatgttctttccgtcatagcctacagcctgtgaaatgtagtagtgtttagtttcgcgtaaacactccatccattcttgtgttccggttttgttgcgtacccgcgcctttaatggaaacatcattcaccccgtagaactttcagttcaccagacaaacgctgtagattggcggttgcagtatcgtaacgcttttcggtgtctttcagggtagtttcccgcgccttacgcaagaatttttccagatcaccaggtttcgtcaccagcttaccatctacgtaaattcgtcccagcaggtgagaacaatccagcagttgttgtgcgtcggctttttcaacagcaggtttaagcgcgacaaactttttaaagaatccgcgatcctcgttatcaaacagatacgaatcttcggaataccatgttgtgccattggcatcaacgatcccactaacacctttccggttgcagtgcgttaccttgataggaaacacgacagatgatagttgattaggcgacagaggactaccacgcaaagctaaattgcggtacaccgtcccaaaactttcttcgtcacgaaattcaaaataatcttttgtccagtacatcattttcaatacctcatagtttcggtatgtgtaatataacaaaagcccctcactttcgcaaggggctttttgattaattttgatgcttagttcggtgcatcatttctttgttcttaccttcgttgaaaccacggacagcaggagcacccaaataaccgcatgtacggcgcgtgacgctcattttaaccggatcgtgattaccgcagtgcttacagtggaaaccttcttctgtaggcgtgaactcgtcatcagagccacatacaaagcacttatcgaccggaaggttagttccgaagtagtccagtttttccatcgcataatcccagactttttccagggcttgcaggttgtttttcatatcagggaattcaacataactgatatgaccagcagtagcgatgtaatgataatcggcttcatagtcgattttctcgaacggtgttaccttgcggtcaacgtccagatggaaactgtttgtgtaccagcctttatccgtgacacctttgacgcttccgaacttctcaaagtccagcttacagaagcgatggcagagagattccgcaggggttgaatacaggctgaaaccatatcctgttttcttcttccatgcttcggttgcagcgcggaggtactcaatgatcaatcgacctaatttctgggagccgatgcgatcaaatgggtgttggcctgagccaaacatcaacagcgtttcatgcagtccgatataacccagactgatagagctacgcccatttttgaacagttccagaatttcatcatccggtttcagtcggacaccaaaagcaccttctgtgtataggatcggcgcaacactggctttaacaccgcgtaggctttcgatacgagtcatcagggcttcaaaacacagttccagacgttcatcaaggatgcgccagaatgcgtcgtgtgcgtcttcgttttcctgtgcttccgcttcaatagcgatgcgtgggaggttgattgtcaccacacccaggttattacgtccatccagaacttcattaccgttatcatcatgccacacgctaaggaaactgcgacaacccataggagatacaggaacgctagaaccagtaatagcgcggttattagccgaactaatgatatctgggtacatgcgtttagaagcacattccagagccagttgtttgatgtcatagttgcgatcctctggatcaaggttgattcctttttccatgaacataaccagtttagggaataccggagtgataccctctttacccaggccgcgaatacggtttttcagaatcgctttctggatcattcgttcaaacatacccgtaccagtaccgaaagtgatggtaacgaatggggtttgaccattggcagtatgtagggtgttaacttcatattcgtaagactggaacgcatcaaaaacatctttttcagtcttttccatcgcgtatgtacgatcgccagaaataccgtatttccttgcggttttttcgtgtttttcatacgtcatacgagcgtatggagccagcactttatcaacattcgcaaaggttgtcccgccgtactggtgagaagcaatctgtgcggtgatctgcgccatgagagcggtagcaacaccgatcgatttaggcggttcaatgtccgcgttacccatcttgaaaccgttctccagcatacctttcaggtcaaccagacagcagttagtgtaaggggtgaacgggctatagtccagatcgtgataatggatgtcgccggagtcatgcgcttctacgatatgtttcggaaggatatgattacgggcgaaatgcttcgctacaatacccgccagcaaatcgcgctgtgtcgggaatacccttgcgtctttgttcgcgttctcgttggtgatctctttgttggacaggttcaccatgccggagatatctttgaacagcttacttttctgttcacgggcaatatcgcgatcgtggcgatattcgatgtatgcacgggcgaccgctgggttcgttttcatcagggattcttcaacgagttcctggatacgggcgatcttcattgcgctaccatcgcggatctgattgtactgaaccagcatgattgcggcatcagcatccgtcatagtcccgccagctttttctacagcaatacggattttttctttatcaaaatcaacggttttgccgtcgcgtttttctacacgcattacatttctccaaacttaccaaagagttcttgagatttgcgaattcttgcgttgatagcatcattcaaatcgtcatactctccgatataaattgattttccattgaattttattttcgcaacccatttgttgtatgtgttgcaccaatgtacgcctttatgtccagatttattatttctctgaacctttttcttcatgatgttttgttgttgtgtaatcttttgtaggttcaaaaatccatcaccaagttcaaccccatgaacatgatcaataacatacggtttttctggtagtgtaccatgaatcacataccatataatatgatgtcggaagaatttcttccctttgaaccctataacagtatacccgtttttatcaacaacaccagcagattgacctatacaaatttttcgatttgttggcttagtccatgtaacaacaccgctgcaaatgtctacacttacgcacttgagaagttcatcaagttccgtatatttttcattcatttagttgccttcattaattgctttctatattttgcggttaaggctttgcgttcgtctttgtcggcgtattcaaagcccatagaaaccatttcggcaatcatatcaggtttggtaagtcttgaaaaccattttaccttatctggtatgaatttgtcatgaatacggttttcggaataatcttgtttcagatatgcaagcaagttctctaaccactggatgtaatcaacatcacgggacaccagaccggatctgttgaatttgtgcttcacaataccttctgtaccgttgcataggttacacagtaggccgcgcacacgtccggcgttttcgccgtctaaagcatggtcatggtcaaggtgatgtttctcgatctctccctcaagaggacgtttgcagagagcacaacgcccaccttgtttttcaaagagggcttgcttgatagtcgggtagtcttttttggtaattcgtttcgtcagcataataacaccattcagtaaggtgtcattatttattacagggtgcggacgtactcgcgaagttggtcgaatccgcctacgtgtttcccgtcatggaaaatctgaggcatagtcatccggcgcgtaccaaccagggcttcgagttcgtcgatcaccgcttcattcagcacaggtttaccgtcttccacggaatccgcaacagacacgaactcatacggatgttttttcgcgtccagcaagcgctttgagttcaggcatggagcgcagttatacacagaagggatatagccataaattttaaacatgttaacctacattaaatcgttcagtgttaaagggaatgtatttacgtcgcgtttctggtagttgcacacgtagacttcttgcgttttgttttgctcgtaagagtcggtatgctggcctaacagatactttttatccagattatgaacgcggtatttctgcatccattcaatcaggatatcattttgttttccggcatggtgagtcacgttggacagtccgaacatgattccttcgctgtgtagttcatccaggaaagcatataactcgcgttcgcgatcttcgttccagaacttgttatacactgcatcggtgatcaggtacggcggatcacagtacacgaaatcattttcacagatatcaatgtcacggaatgaaccactggaaaactcaatacctttcacattctttttgaaatgttcaaagcgttttactgttgcatcgttgagcgtccggcatccgaaattagcgttgaagtcgcctttgtcgtttgtccggttaacgttgctgaatgaatgcaggatcaggacatagagccataacggatctttgttctggttgtattcatcacggaatttcaaatactcttctttcttgtctttccccagacccttcgatgcaatcaattctcgcaccggagacaggtcaggaagcgttttaagacgctcatacatatcaatcagcgtcttatcgtaatcgttgcttagaacgggtttagggacgtttaacgacacactaaggccaccgcaaaaacaatcaatgaaacgcatgtatgaacttctttcggggaacagcttgaagagttcaggtaatagcgactgtttgttgcctgtataggggataacacccaaataactcatagaaaagattccagattgttaacgtatggctgaacacgaagaatagaatcgtgataataattctccatcagttcgaagcctttgaaccgtctgttggttagtatcgacattttcatcactgtaccagagccagagaatatatcaagaaccaagtccccttcaaccgtccacgttttaatgtgatcttctgccagttgttcaggaaatattgctgggtgtttgaatgcaatctcgtccttcgttgagtgatttcgccctacagcgtaataccagatattacccttaattttatccttgccaacaggtttacgtttcttaccggaacgggctgaacggttcttttcgttggtttcggaaaagtagctgttttgtcgtgcggtttccttttcagggaacttacacggaatgcggatcgggttgaatgtttttggtgcgccttttgtccacacgaacatgtattcaaagtcctgttcgtatcggttatggttcttcggtagagcggttttgtgatagatcatcgtatcatgcaaccgaaaaccttgttcgagcgcgtacaaggcttgacggaaagatgtacccgtttcactaccgttgatagtcgcgtcacccacaacccacacaaccacaccaccaggcgcggtaacgcggtacagttccgatatcaactctttccatacgtgttcaccccagacatcaccagagccgttataatggcgcaagttgtcatacggaggcgaagttatggtcaagtcaacagaaccagattcaagctgtttaatcagctttacggagtcgcctaaatggaggtcaaccccttctttgattgtggtaatcataattcaccaagtcctttctcaaataaggcgatcgtttcgtacttatacccacgattcaccacgaagcaatgattttcgcctaatttctcaagcattgcaatagcacgatgttcatcttttttatctttcagcagataagcaattcgaacaacctcttttagtgtcgcgttgtccacctgttccaacttgaacccgtagcccaccaacttacaaaaaagccccttgcgagcgacaaggggctgattgttgtagaagactactgatccgttatcgttggcgcggatattaaatccttgctcgctcacggataacccctactgtatcggaggtgtttaatacaccgttgtcgtaatacgtaatcatcgcatcacgccacccgtcaggaatctcagtttccagagtgtcgattgttttgaattccacaccgttagtgatggtcatcagcaaacctttcttactctgtttccattcggaacctttcgggcatttgtaaacgcctttccacacaccattcacgcggatagcgcacagtttttcagcatacttttgagtgtcgcgggtaacttcttgcagcaaaccgccgcccataccgaacgcgatgttctcactcgcccacttgttcgcttccatccaacttaacacacggttgattgtttcaggcccgtggatctcgtcgccctggatgattcgaactgaattatgcagaactttgtaacctttgctgtttacggtgtaaccgaagatttcgcccagtttacgcagggtgtacatgatgttatcaatcatatcaccggaatcaggacgaacaaccagagtaccacccgcagcaatgatttgctctttatattcagcgatgcgatctacagcgcctttgtagtcccaggaatcgtacacacaagcgtataaccctgtaccgaacatttcgatgctgtttttgtatgcttcgtcttcgttctctttaccgtaggaaatcgtagtcgaatgttcgcgagccggaattgaaacaccgattgcttcgacgttttcaacttcatcaaacagagtttgatagtccgcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcaccagtcaggtcagaagtcatatcaaggtaatgagccagaacctttttacactcacgcgatagcgttgctacagatgacggataccagataccgcgaatcgtcattgtctccagccacccagccaaccatgagaattcacgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcagcaagaacccgcgcaacgaagttaacgccagcggttactacttcatcaaacttaccaccgcgagattcaatatagaacatcgctgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactctttgcacgtaggacaggtgatcatggttcctactttagcggcttttgcaacatcgtacaattgtttgatatccttctgccgctcggacgtaatgacacgcccgtttacttctttgacaaccgtttcagttcgaatcgaaccatcggaatatttaacaggagttttgacttgcttcggcgcatttgcttgttgcaaaagccttagagtttctcgacgtaaattatgaccacaaaaatcatcgtcgtcatcgtcgtagccaccccagctatcaatatattctgcttcactcatgttcgatccttagttgctggtcagtaagaagacccggttgtcgctatagtcgatgtagcaatcccaccaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttgggttagtgtcttgtctacgggagctatattaccacactcataactcccgtcaacaagtttttcgaattattttcaccaggtgatgtaataagtcagatcgctatatccgtcacgcttaggatcgctaaagttggtatgaacacggcgcgaattgaaagaggtagcgatacgtgcagcttgcaggttacgttgggtatcaaacgtaaacccttcttccgccagccattcacccagatccgcatatgctttttcggtacattcctgatccataaccttaccgataaaacgtttcatatcaaaggtatatgattgtttagtcggatatttcaggacatactcggaaatgtctttgcgggatgcttcgaccattttcgcgttgatttcgtcaaccagtttacgcgcacgttctgccagtgtcgggctacgtccacagcggggatcatcttgcgtttcgcgtttgacccactgtgtcccgcttcccgcctgtgcgttcacaccgattccattgatttctaccattatgtttcgccttttttaatgcctcttcaactgagaggcgttcgtaattacgtgattgttcgggagttatcaccagagaaaatccagagtaggaggtttagtgttaatccctaaagtatcgcagacttcatccagaactttttgattccaaagattgaacgttggaaccttatacaatctggcaagccttgcagcgatcgcagtaccacctttaacgcaaaaatctttctctaccgcccagaatagaacaaaatctgtaggtttgtccagattttcggttaatacctgcattgaattgcgagcatatcggcgctgtacccattcgttttggttgtcgaagtgtccagctacccttctcgcttcgtcagcggccttgtacgtgtcgtattctgtatagtcgatgatatccttgccattcgaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatactcgcgatacgttcagggggttcacggctaccgatcagggtagccgtttttgcgttttcgagaacagttttaaaattcattgttcaggattgcgccccagttctcacgaaccagatttgacgcttcgttagtgaaggttttcttcgccagcgttgggttttcgaactgttccaggaaaggcccgtagttacgttcgatttcttccagcgcgtcctgtaccgtaagccccatcacgcgaccgaaatctttagcggtgagattcgcgctgtcaattttggacagaacgtttttcacgcggttttcagtcaggtagcaggtgaattcgttcagcttcactttgtctgtttctgacagttcagaaggagcattgaagcggttcgcttgcttgttcttcttctctgtgaacttcgtcgttttgcatttgattgcaacgcgttcaccgttcggcatgaaagcgggttgaacaggcttcatcacgaaaccttctgcgatgttctcaccttcaccatctttcagcgtcatgaagtttttgaactcaggttcaacgccgttctttgcagggatcgcaccggagttcgccaggttaaccaccgaatcaaaggtgataggcagtgtgcggatctcgtcaaacgtaccgtatgccagcagtggagccattttcaagccaacagcaacagcgtaattcgcaacaacgttatcagggaggaactgaccattgacgcggatatcaaatacgtagaaatctttttctccgtagtcaacatctttctgtacaccacgccccgcgaattcgccgtatacctggatcaccagttcatcgctatactcaccgcttaactgacgcgcagtagagatcatttcccacatcttacgaacaggttcggagtatttcgcaactacgggttcgcaaccgtagaactgttcagcagggagaatttcaccgctacgttttgccggaatgactttgataccgtccgaagtgatcaggctaaagttagccccgtggatcttttcacgcgctacccacacgccaccagtcaaaccattcatgatcacaccgttgatgaatttaccttcataatggttagtcagagaagaatatttcacaaacataattaacccttgattttcagttgtttttcaatttgatacgcggctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaacggtctgccggagtaagaacatacgggttcactcattagcttcgcccagtcgcttaacgtcagagcaaattgaaggttgcggttacgcgcatcatcgtttttactgttgtatgaacgagcgacacgcagatcgaattcaatttgctttgcgcggcggcggtgttctaactcagcaggatcgagtgataccatagtttgaactttttccggttctactggctttggttttgcttcaaccttcaccaaatcctttttgatagtcgaagttatcacgcccgaccagcgattcatcattgaagacatataaaccccttacaccaaacccgcttcctggaacgccagcgccatagcgccgttgattgctttacgtttgttatctggacgcggatcgcgtttagctttggtcttaggtttacgctgttcttcacgatgtttgttgatatacacacgacgcagaacatgtttcacttttggattttctgcgcggaaagcacgaattcgctcaatttcctgaacaatcacgtaaatgtcgccgttatcgagcatgtgctcacgggcgatctgtgcatagcccagtttcagatcattgaatttgaaatgaatctgtactttttcctgctggctaacttcgctgatattacgctgaacgattttcatagttactttcctttagtagaatcaattttacgaataaactctaacacttcggcatttctgctgtcaacatttttaagaacaaaagttacaactacatgaacaccggatgcttcgttccaaccatcagcacacgggatcatcagatcatccagagtgttgacaaggttttccatatccgcagggtgatcgacaaacaaagtttgcgtttcggtgatactggctttgaatcgtttcccgatctgtgcttcgagttcgtccagcatcccagcagataacgcggcgatgtcgatgtttttcattccaccatatacaacatgaaatagtttcatatacaactaacctcattttcgtatttttcgcgttcgaaacagtcgggttcgttccagatctggtcaaactcacgtttcgtcatgatatagccacgggcgattttgcgagttagatctgaaccgatcggagcataccacaaaatcaatttacacaccattccctgaaccagacaatcatacagccctttttccagggtgcgtacatctgttacgctatcgactaaatcgggggcacttcgttcaggatggtctttccactgactttcgatgatgtcgtttagttcacgatggaaatagatccacgattggaacgatgcatcaggcggatttgacttgcaaccagcaggataaaattcaagcattttgatcagcctcattcgcaatacagatcgccataaaggtaaacataacccccaacgcaaccatccagatcgcggttaaatccccatacaaagaagaatagccacccatcacttcaacgcgatatcccagcaagaaaacgagatacgctaacaccttatctttcataattcctcacagaaagcccatgcagcatgataaacgcttgcgcctttgtcatcgttcatgcataccacatctaccggacacacaacccgatacagtaccggatcaccacctattgaacgtgcagcccttccagcatagatacgagccagcccgatatcagcagtgaagaaaacacgatccagatttttctttctgcctttttcagacagagtatcagaatcacaaggaggcaacaacatgctttcgattccggcagcagtacatgatccgtgatagaactcaacgaactctttgcggcagtgaatggtattcatggttatctccttgttttcagagattacagcttatcgctattcgcccgacaagtcaacaaattctttttcaacgtcttcttttgttctgaacaggtaatcagtaaggctacctgtcatcaattcgcgagttttagcaactgaacgaacacggcgttcacgttggctttcggcatcaccaattccgtgacctggttcccacccttccatatccaacataatgcgcgggtgcctcatcacacgaatatcgtttccatatgaatagctgttatattgcccgaatacaaatcttttgaatttttcgtggtgaacatcatcaacttcgacctgttctccgtagtaaacaatttcatcacagaacgcagcaagaacaagcccaccagagttttgaattttcaggattgcatggatcatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgatcactccatttgaagtaatcccattttggatcacaatctggacgcatagacggggtatgccagcgcttgaaccccaagagattacagaaatcgtcaatcagggtatcgcgacgggatttatattttgactggtcgccaagagcagcggcgttgatgaattcatgcagttcatttttcataattgttaccttatggttaaagttcttccggcttatccgtcgaacaattgcactataaacgcactcataaaccgtgtcaataaatacttttaaataaacacctggagttctaagatgaaatcattcaaagactttacgagccttgatgaagcgctgatcaccttcggcggtaaggcttatcctaaatttggtcaggtagtcatcctggctggcggtgcgggttctggtaaagggttcaccctcgaaaagctgttaggtatcgaagggatcaccctggacgttgacgcactcaaaaaattggtcatgggtagtaccaaactggcagcagagatcaaagcgaaaactggtcacgatgtcaaaacaatgaacctgaaaaacccggacaacgtagcaacactgcatcatgtgatcgcagacgtgttcaacgtatccaacaaaaaccaggcgcgtgtgtacgcgggtatcgcagcagcaccggaagaccgtaaaccaaacctgatctttgacgtaaccctgaaaagcatgagcaagctggcaagtatcgcccgtgatgttgaagcgctgggttatcagaaagaaaacatccatatcgtttgggttatgaacgatgttcatattgctatgcagcagaaccttaaacgcgatcgtgtagtgcctaaagaaatcctcatggatacccacgaaggggcagcgctcactatggcgaagatcctgaatatgggcgactctctgaaacagtacatggacggcgatatctggatcagcttcaacaaagtaggcattgacagcgaaatcaagaaatctgacaaaggcggtatgtttgtcgttaagtctaactacatcaaagttaaggcaaaaggaaagccgcagaaatccattgatcagcttgataaagagttagtggcgaaagttgcagcatacgcaccgaaaactgatacatggggttgacaataggaacatatatgaatatgatgcacacacaaaccgaggaattgatatgaaaaagtttttgttcgatatggatggtgtactgttcaactgggaaggttcttttgttccgatgtacggtgacccggcgagaatgccggaagaagaattgaaaaaagcgaaacaggctatatcacaaactgacttctacgaaaatctggaaccattacaagagggcatcgacctgttctgtcatttgagaactttaggtcaggttgcgatcttaaccagcgtagggaaatacaattccgatgcggtagcagaacaaaaaagaaaagcgttgatgaaggtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttcccttttttgtttatggtgtgtaatccgcaaaggagcggttcacatcctgaatagtgatgttcatatcgtcgttcaggaaaacactacgatatttccctgcgctatcccatgcttgacgatgcttatcattgcgggagatcagagggcaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcaatcgccagtttttcatagaaatctgtacgaaccagggacgatacagcagcttcatattctgcatctgtcatgttttgaggacgtttgccaaatttggcttcgattgcgtcgctgaattttgcgaatacatcattgaattcaaatagtagcatttttaccttcttagttgttattatggtgcaggtttaacgtttaccgtcagagttgcagtaacagatccagaggttgctgttacgacaacatcaccttcactaaccgcatgaagtttaccaccaactatagaaccatgaccggaagagtcaacactcagagtcattgctgtaccagaaggatcaatggtaaacagatcagttgcagccagatccgcatcacctactttgaaatcagcaggagcggttttcggtgtaattgttacgacaggatcagcaggagtaaaatcactcagcttatacagataaccgttacgggattcgatgaaatcaacatcggtgtaatcaatatacgcttgtttcagtgtgtcgaattctttcgcgtatttttcttcggcataatcacgccagtcttcgcttgcagcattcgcagccacgatgatatcaaagatccaccacggcagataggtaaagctggtgttacgccacgggatcgggtgtaccgtagtccatttttctgtagccattttcaaaacctcttagtttttctctatttagagaagtaaaattttgccgtcacaagacggacatttatcatattggttcacgcgcccatagccgttgcattcaggacagaacgggtttgttacaccgaacacattacggatcgcgtaagtggattgttcttctgtcagccccacaaacccatcggtattgatgaaatgttcactctgttccggcagcatatcggtatcgtcatcaaggataaggtaattcttacatccgaaggtgtcgatccatgctttgatttcatcaccgcgtcctgcttgtcggtctgttagattcgtacaggttttcccaatgatgcgatacaatccccacggatagaagatttcccgtagagtatgggttgtgttgccgatcctccatgtagaggaaatgacaatatcacagttcgcatgatttacgatccggcgcaggtgtcgagcacattcaatgtccatatgctcaccaaatttcatgcaccgcatattatttagaacgccgtcgatatcaaggaagatgacgtttccgatctctttaccttctgataagtctttcaggcattcgtgatttaattcagtcatattttacctacaaaaagggggctacgccccctttgaattttaatagaaaccgcgagcttcgttatccaggcgacggtctgcaatcatgtgcgcttccatttgacgagaaacataatcaggatcgcattccattcttgcttcttcgtagttgtcccaagtatcagcaacccattttgaaccattccaacgagcataaccgggttcagaaggaacaggataattagcttcggcagcgtgacgcagagcttcaccaacagtatagtaaggagcatttgaattgactactttcttcactttaccatcaacccaaacaaacagaactgggtagtaagcgtttttcatcatttcgtttttcattttgctttccttcttcactgcgagagccattcccccgccttcgagtacaaatatactttaaacgagggtatgtgtcaacaagttttttagcaaaaagtgctaaaacttaaatgtttcgaatcggctatttctggtttcgcgaacacgaacttcaccatcacgcacgatatagaacgcaagtgatttgattgtgtcgattgcgcttgcatgtggacagctatcaggatctttgtaccagtctggggtttgcttaatccagtcatagatccaccacggacaggtataatacccgttagaactcgcagagcgccccatcatgaagattgttgggctaaacccttccaaccataccagttcgcctttggactcgtcagaagcgcttacaggagcttctacgacatcaggtactaattggatttgatcggctacttccggtgcgacctctttaacgtactccataaaatccgcagaagcatcaataaccacatcaggaatgtttggggcttcgatgacaggttcacccatagtcacctcacctttgtatgcgacgatttccggttcaggggaatcaatcagcagttccggcttttcttcttcatccggtaaagcagcaaccagatcagccagcatgttatcaaaggatttctgtttgttcagcttaacagcaaacacgttcatagcataatcagctaacgcgcctttctgttcttttgcgtcgagggtacggaacccatcaaccttttcgtaatcaatgttcattggaatctccagtgtttattcaatatttagagcataaatacatatatactttgtacatagggtaatcatagtggatattgaagtcaaatttttaaacacaagccacgtacagattcaggcagaagcaaacattgtctatgaactgcgtgactatttcagcttccagcccccaggctatcagtatcaggccaaatacaaatatggcgggtggaacggttacatttacttgatggactacaacgggaaactcccgtatgggttagcctatctggtatccaaattcgcagaatcacgcgggtattcaatctgggttgatccaaagatccacgaaacagaggatatcacgcaagaagattttgataagtgggttaacgaacatccggtttatgacggcgacaaacagatcgacccgtactggtatcaacgcgaatcagtgttccacggtatcaaaaaccgtcgcggtgttctgaacctgccaacatcagcaggtaaatctctgattcaggggcttatctctcgttggtgtctggaacattacagcgggaaagtgttgatcatcgttccgactaccgcacttgttgaccaaatgatcgaagacatcgcaaactatcgtttgttcccgaaatcggcaatgctgggtatccgttcaggtacagcgaaaaacagtaatgcactgatttacgtttctacctggcaatcagcagttaaaatgcctgccgaatggttccaacaattcatgtgcttgatggttgatgaatgccacctctcaacaggtatgagcatcaaaaagattatcgacacgatggatcaatgtatcttcaaactgggtttatccggttccctgaaagaagggaaaacgaacatgatgcaatacatcggtgcgttcggtaaagtctttaaaccagttgatacgcgtcgtttgatggatgatggtcaagtcaccaacctgaaaattaacacgatcttccttcgatacaaagaagaagaggtcaaaaaattgaagggtgcggactaccagacggaaatcaagtacgtaaccagccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagacattgacgatcgtaacgaaatgaagaaaattgcagaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgtaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaaaatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacggcgagaagaactgaaagccgaacttgaaaccggagaagaagagaagttttaaaaagaaagccccaaccgaaaggaaggggctttttaattttgaagcatagttgatttttaacgcggtgtcgtcaccgctattctaaactgcgtaagctgattaatcagccagccatgccccacaaggggtactgtgacacattcgccgcaacatgcaatcgtatatttgcggggtagtcaatcgtagttcgtgccgttgcacactgttagcataaaggttccaggttgagaaaaaatcccaatcacgaatatatgttgcattccatataggccattaggtttatccgattatgaaaatgcatccatcggtaaacatgcccttgccctacaattatatttactgctataaatctgggcgttcgtcttcgatacaaccgctttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcgggccagcatcattgacaaacgccgtgttacgggagttcatcggttgtttgcacacaacgcatttacaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatgatatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacggaaatgtactgttttctctatatataaaatataaatattataaacagtacatcgtacttacccatcactcacttcgttcgtgaaaactcgcttcgctcgtttgaccttatagatctttattactataatggtcttctcaaaacaaaacttgttaacccagtttaggtaacttaatacctacgatctgacttagcttagatttaccagcaagggcagaccaatcatcacctttgatcaggcgatcagaatcactttcagcagtatacgggttcacagaaagaccgtaacgcatcagaatagcaactttcggttgcagtgatgccggatctacggatactttgattgaacctgcttcgtcagcttcggtatacggagcgaagaacagagagcctacgtgatccatatcacccagatcatatttgcagccagtcagcatataatcgaacgggctgtttgtgtctgtatagacataataaccgttgttcagcttacctgttgccagtgggtgttgttcgtcggtttcgtgcatccaaccagacgcagccagaatgcctacaacacgcgctgttgcgaggacataggtagcatcaaatgaagtcgttctattcatttcctgccccatttcacacgctaattggtacaggatacgacccaatgctggagcatccttcgcggtgtatgcggtagtaccgtcaaaaataccatccgtaacgagtccatcgacgttgtaacgtttggaaacggtgatcagtgtttgaataatgtctttgttgacttcttcacttgccacggttcccaggatgtcttcgatcaccccatcagcttcgaactggttagcttccaaatcctgcatcagttcaaccgtcatttcggttttaaacttacgcgagcgtaccggaatattccagcgatccatctggaaggaggttgacgcgatatcttcactggtttcgtatttcgaagtgtcagcggcttcgctaaccaggcgaatcttgctttggaacacagctttcatgatcgcggtgtctttgtcagtatccagagtgttcagggtaataggtgcaatcacctcataaacaacgtcagtgccgtcatgcttgaacaaatcacctttaacgtaggctttagtcagatcgatttcgtcgatgtctgtacgtccagagattcggcctgaataggttgcagcactggagaaagtcatatcaccgttagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtgcctgttgcttcgttgataactttttctcgtttaccagacggaagcgcagactgacgcatcaacttgtgaattgtgtagtgtttatcactcatttctatggttcctgaattagaggattatattgtgtatttatgcaacaaatttccaatcaggatacttgtcactttttagcctataatcgaggccagaacgggacatacccaactcaatagcagcatccgtcccacttttatatatgacaccatctatagacacagaacgacttattttagccttgtgtgcctctgagagcgtcgatccggttctgtcgaatgcagaacccttatacatcgctttgatagtctcagaacgcttcctgtttgattcttccgattgtcttttacctgtatgggcttttgacatacgttctcgcatttctggtgtctgcatagcttttgatgtattttcggaaatcagcttacgctgttcataactccatccaattagagccattggagcacctttaccaccaataccagcgttgtatgtatcaggtcggtttatgaattcaatattgacaatttctctttctttctcatacatttcttcgcgggtatcgaacacatggaggatttcttttgtaaaatgttccataccgtatttcttttgcgcttttttgatcgcaatacctgaacccatatacgaatcattgatatcttcggtcgaatgagcaccaatatagattttattgttcagtgtatttgttattttataaatgatatgtttcataatatagcctcgatgattttcactatttatataaacaaaaagggaacccgaaggttccctttaaaatcgttatttttcaataacttagaatcaaagtcccttcacccagaccttacggaagtatgcgtttttaccgcacatttctttgctgatcataccagaagtgatacgatctgccggagcctgagagcgagagttcgcaaacgggttgatgccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgagaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagcctacggtctgggtgaaaccagttttaccaatctgcgcggtgtagttgatcaggtcaacgatttcgcggttgatttccagcatgatttcagttgccaggattgcagacagttcggcgtcagcgtccataccgtgtacagcgcgaagatcctgcgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacactgccggaggtcacgttctggaagtacgcaataccagtttcctggaatacgtgcttaacgatagcgccggaagcgatagcagtaccggaagcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtagggccagtcataggctgaacaccgcaaatgtcgaatgcaatcaggttaggaatcgcacggcgaaccataccgattacagcagggccaatgttggtgattgcaccgctggatttaccagaggcaatgttggttgcgtcgtaaccgtgatcacctgcaatttcagcttccgccaggaaaccgccgaaggattcaacgattttttcgtcgcgatatactggatcagtatcagcatccttttcctgagtttccagaattgctgcaaccagttgttttttggacttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgcgattcagtcagatcttttgttttttccgaaacgatggtatcgcgtttcatgttggcgatctctttagcctgagcctgattagcttcgaacaggcgtttaacttcctgctgattctcggtcagttcatcttcgagttctgcaacaacatcaacctgcgcttctgggataactacgttgtgttcaacgaacagttctttcattcccattaccagagattcgaacagatcggccttgatatcacgggacacggcttctttgttttcagagagccattcctgcgcgatgtggtcgaagtatttattcgcatcttcgtacagtttattttcgatttcgccagctttttcggcaacctgggcttcaaccagttcatcggagagttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcggtttgcttgactgagattcggtaatcggcttaacgtaagcatctggagcgcttggcccccaaacaacatcaacgcctactgccaatttaaacccttcttgtacgataccgtaaccttttccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccacaatttttcaattaggatgcaagcattacgcggatcgacattcggtcgcggcgggtgattcatttcacccagagcttgacgggtattaacctgagttctgatataatcgtttactgcttcttctaatacttttttcggatacagtcgcttattgcggttgactttttcggcttgtaggaaaataccttcaatccgaagtttaccgtcttttttcgactcaccgaccgattctaaaattgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgcacgttttgtttttagcgcacgacgcgcaatttggcgacgttgagatttagttaaaccagttgtttgatacgcattacgttcacgagttttgcggtcttttttacgttccacattaccgcgcgaatctacgtgtttaacaatgacttcatctaaactcaaaccctcgacaatggacatcatagccagggctaaatgaggttcattgtccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgttgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttctttgatcagcttcgcttgttcgtcaatgtcttcatcagacattcgaagaatctctttcatgatgtatttatgggatacatatttccctactacaccttcaacctgtgacattaacgttaggcgacgttccatgatctcaatatctttcacttctgcgtaatatgaatcttgctggaaaatgaaggagattttgctaacgttctcttcccattcttcctctgtgatgatttttttcgcgatcaggttagtttttaacggatcggaaagcacagggctgaactgaatttgcagtgtgcggataaacttactaaatttcagttcatcacgggtgatttcgccaccaccaccaatttgcatacccccatcatcgcgaggcatacggcttaatggcacacgcagtgattcatagagcttacggttaaaccatttgatatcatccatatcagagaagttagcaccgcctggaagcgtgtctacttcggtgatagctttaccgtcacgacgcatcaaccagtaatcttctgtcattgacaggttgttttgctggttcttaacagtacccgttttagcatcgtacacaacgcggtttttaagcccctgtgcaatgttatttacgtactgtgtcgctttggtgccacccatctgacctacgtcgatgtagaacacacggcgttcaggtgcgcgggtgatacggtagatgaccatcgcatcttccagtaaacgcaattggtttgctggcttgactgcgcggtgaagatatccgataatgttgttactacaatcttccagaccagaatgcgcatacacgatagcggagcgcgggattttaaccttctggttatgctgatagatttgcccgttgtatgtatagccagatttaggagcgctatacacgaaaaattcgcgataaccacggaatactttcacgccaccatcaagggtttcagtgatagattcgcggatcagttccatcgaacgcggatcaagttgacgcagttcgcggatacctttgctttcgtctttatgcatgattttatggaagtagatacgggaatccacataccaatcacggaacagacgcgcacccatgttatcaaaatcatagatatttagaacgttatcaaattcttctacgattttgtcctgaatcgccttactaaaatctgttttggcaagatccaaagtaatgatatctttgccctgttcattcacgatcgcatcgtcaataatttcagaaacagcgttttctacttctgggtaagacatgatgccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatctaattcgtcctcacgggcgaaattcttgaaaaagctaagtacattgccaaagcccaaaaagttcatagtaactccgaaaaataatgataggggtattgctacccctgtatttataacctttattcccaccagtccagcgcgaacgtaacctcaaaggttgacacttcgttgttgctgtcccagtccagggtaacttcgcctacgttagtagggaacagcccgtggatggtgtgatcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgcgcgtcatcgttatagatcgtgattgtccagtcatcataggtacggtcaccagcaacgttgattttgcggttttggtatcctaccggaactttttcaactgtagccgctggcatggttgccgctttacacttgaatttaaagtttttgcccagatacgggatctctacttcgaacaggttcggacgtgcgaaatcaccggattcaaaggcgcgtaaaatgtcagtaagcatttttaacctcggattatttatgggggcttttcagcccccttgactttatacggcttgcggccctaccagttcatcgaaatctgcgcctgtagacgttgctacgaagttcagagtgatgtagttgatagaacgaggcggtttcacgtagaccgttgctacaaactcgttacggtcgattacgtccggcgtgttgttcgtggtgtcacagattacacggtaatcgtagcaaccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagaaacgctatcagtgtaaacacacaggccagcgatatcacctgccagcggaacccaacggttcacgtcattgtatttatcatactgatatttatagttaccatccaggaagccatagcttgaacttacgttcagattgttatcaacagcagcaccaccactgagtttatagccagtacgccattcaatcatgttatcaaccgcagttgccagcgggatattcaccagaagtgagcgcggaggcgacacaaacacggtacaatcctgacgttcatcaccgattgaaataacatgtttctgaacggtagacataatctctacggtttcgccagcacacgcaccagcaatcaacagaggcacatgcagagcttcgcgatcagcgaacatatcccaaccattcatcagttcatcagcgcctacagtatcgtttgaggacaaaccaccgccgaactccaggataccggagaagcctttaggccagttcagggaagtaccgtaaacgtactgagagccaccgttcgcgaaaaagtcatccatgaagatgttgacaccatagatatctttatcggtcttctcggttgacacgatgaaggattcctgtacaataccaccacgacgcacaacaaaagcgtactggttatcggtctgtggcccgtaggtcattacagaacgaccgctgttcttaacggaaaccccagaagggtagccggaaatcatagcgccagaatcgtaagcagctttggagataatctccacctgaacagttgaacccagttcaccaggatacagagccacaacagacggcaactgatatttctgggtaagagtctggaaagcggttccctgaattgtttcttttgcaatatccaggttcaacagagtgatcccagaatcgctttcgatgccgtcaatcgtaatcgacgcagaaacaccggaagactgagaaacaatttcggtagtccagccagtagaaatatctgggtaagtaccaatctgtttagcacgggcaacgattttttcgcttggaatgattaccgagaggatcttgccgttactgtcaactttggacactttacctttttcttctacaacaacgctgttgtattttactttaatagtatcgttcacagtgtagttagaaccctgtgatgcgatagttgttttgatctggttaaaaattgcgcttgcgtttttagcggcatctttatcgacaacgcgaaccacacggagatcattaccgtactgcaagaagttaacagcactcatgaaatagtcagcggtcaagttgtctggggaaccaaaatagtttaccagttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtctttctcgcagaattcggcaaatttcatttgagttgtaagccaaccgaaacaagcaagcgacataacgaggtcgtcgtgatatccttcttccgcagcccacgaaacgcctttttctgagaaagtacgaaattcgagtattgtctttttgttatttatgatcaatttatctttctcgaccaggtctttcagcgtcgaacatcccatagcttttgatcgcttagtctgtttcatacccagatcgttgtaactgtcacaaataacattctcatattccagttcggaaaacagagatttggcaactgaatgccctgtgctatttagctcaatgtaaatccatgcctcgttatacatattcagataacgtaacaggatgtccggcaaaataagatgcgacgttttgtttgagtgatacaccgcaacctgttcaaatggcatcgtcgtaatgtcgatgatgtgcattgcatggtaatcctgtccgcgcccttcggctggatcaagtaccgcaacgtatttatgcccctctactggacgtttatactgataaaagttcgtttcagtttcatcaatatctatccatgagagctttgacagtttccagccagcgatcagggttccactggtccccatgaattccgcgcagtgttcctgcaagaatgcctctttgctggagccagcgatcatcttcgcagaccacgaataaccgtcatcaaatacgccgttgtcgccgtctgtatacaatcgctctttaaccgatgtccagatcgcggtgtaaggcacgaagccggattttccttctatagcagcgttccagatatcatagaagtggttaagcccgttaggtgtcgttgtgataaggattttcgatttacgaccagaagagattactggttgaatcgctaaccacgcatcaacaaagttcgggataaacgcgcattcgtcgatgtagatcatcgcgaaggagttaccacgcaccgcatcgggagaagatgcaaacgcaccaattttacatttgttgtcaagttcaatagaacctttgttccattcaacgataccaggctgcaagaagtctggcagcagttcgatcgcttgtttggtacgatccagaacttccgcagacatcgaggctttgtgagccagcacaccaacatatttatcttcgttgaaacacacgaagtgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacggcatttcacccactccatcaacatttgctgagtccatttagtctggatatacgcgcgtttcaggttagggttgccattatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcattagttccgtaggggaaccaacaaatacggttgcattctcgatattcaaaccatcaccaccgcctttttcagcgcctggttttgtagtctcttccgtaatctcacgcatttctttgtgaatcttcatcaggccaatgtttgaaacgtttaactgattcatcaggcttgtgaatacctcgacgtggcgaggtgattcggagttcttcgcgttgtgtaatgcaatctgcgccatatccatgatcatctgattcatatggtgcgcagtcttacgcgcgagcgtataatcctcttccagatccggtttccggtctgctggatgtgattgaacgtcaaccagttcaagtttctcgtaaacaaccacatcctccccagactcaacgccgccagggagggaatcaatattcagcaattgctgtaaatctaatttttcatccattttcattccctcggcttaggaggttcatcaccagacgggatcggcttatcgtgcgagtacgtctgaatatattcttcgcccgtgtagtcctgcataggcagatctaccggatcggcttgactatccacggattcaaagttatctttatctaacgggttcatgttagcgaagaaatccgtgtaaacggttctgatttcgcctttaacatcagttacaggcgggtacagataaccctgtaattcaaacataaatgaccactcaacatgacggcgttgatttgcatcgccctcgaatgtggtatccggcgcaaccgattggagactgattttgatgtctcggtcaactgtgatatcgttcttatgcagttcggtaatcttacagttgaaatgcggttgaaaatatggcaaaatctgttctgcgatttggaacatatcatcttcatatcgcgtatacacacccagttcgaaaatcagacgatatggcacagggttaaactgtgtgatcgtttttcgtggggttgctaactgtgtcattttttggttgaccgcgatactggttttacggattgcgttatattgcagatccaccagtgataagttcatgcgcggtaaaatcgtttccgttttagcaacgttttcctgactcaacgtgtagttaagtttgttcatggaagcgagaaacttctctttcgatgcataggtgatcggaaccttgatgtatttttcttgatcgccgcgtactcttttaacctgaacatggttaaacaattgtcccataagaacaatgtagttacgcagcgaactattataccagtatccaaaaattttctaatccccctgctggacgcgtccagacttacagttatcaaagtgccagcgcttcgctgtattagcggcgcacattatcccacaatgggggcattgtaccttttctcgttttttgcctttgtgagcagcaacgagacttgctatatgttctggtgatagcttctttcctttatgaacagcaccaattctttttctgaattcgtcggtatggtttttcccgtaaaatgggttgtttttaccgtcatgtttgcctttcatctgttcttttttaacaatgcgcattgcttttcgcgcctttgtcttttcttcaagaatgaactgctgttcttgttcagataacgatgaatagcgtttgtgttcataggtgaacatcatgaagaacgcaagaatcattttaggatcattggtttttgctaatgtcctgtgggccatcaaatgcttcattatatcaagttctactaaattttctggttcgtgttcgaattcaggaaataaagaacgtggtaatatatgatgtttttctgtgtgttcagtttttggagaagcctttatgatatcaacatactcaacgtatagatcatgaggcaaccattctttaagttttgtgtatatcataaaatcctctttgaagagggtatagacttccgcctatacccatataacgtatttatggcagacttgcaaacggtgaaccgcgtccgttgacaacatcaaaagattcgatgaattcatcaccttctctttcaaattctttgtcttcttcgtactgttcaatgttgatatcagccagaccgtcaagatttcgaatcggttcgagatccagttctgcatcaggttcgatatggattccttcatttcgctgcaattcaggagccagttcttcaccagtgtagatgaatttcgccaggttgattttacgctgaggacgatcaccgaactgatagaacggatcggcttctacccatgtaacttcaaaaaggctattatccatagggaaataaatcaaatcccccagaacaggaataccaccatcagtttgatgtgcgaacaaacgaggatttattaccagcgtcatttcatcgtttgagttcaaaccaaatttactaaagaaatctcgttgcccttcatagttggcatacgattcaatatacgcagcaattttccatgacttcgtaaatttagattctcggtcttctccaagaatcttatcaatattcacaaagtcgcgccggacgtaatacatatcaggcgatttcatctggattgattctgctgtcagtgaatcgtgtagctgttgtgtcgggttgtatttgtaccagtttacatacgggttagtgacctgatcctttaagttgcgatcaaccccttcccccgtagacaactgagcgaataaactttcatcccagttttgcattgttccccctacaccataatgatcggtactgcgtcagacatcgaaatcagttcatcgcgcagactttgcagtttggtttccgcttcctggatcagtcgcgtaccatcaggagcaacaccgccaggcaattgcattccctggaacttagccagaatttgtccgttgatctctttcaccagtgcggtagagtagtcttttacccaacggttgttatatgcagacgttccgcctgtaacagttgaaccctgtcccgctcgtacaccgcctacaaccgcgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcacctttgttcacctgcccccatgcgcagaactgaccagtatcatcgttgaaccagtaatcaggcagtggagccagcaggtcttgcattgagcgttgataggacatcatctgggtaaagtagcccatatccgcgccgtatgcgttcataccgtacacactcgatgcacagcgcccacccagagagccaccagtcaaccccatcaggaaatcggtaaaccacggataaaccgctgtaccgtccattgtggtcaatgaacccatgtttgtacgcaataccttcgtgatcgcgaagatgtgttctttgctcaagtcgaacacgttgcgcgggttatcatcacccagtgtcaaaatcagatacgttttgtttgtgccgttataatgatattctgcatacaggtctaaagcgcgttgaatgcagtcataaatctgatcttgtgtgatttcgattttgatgattggtgcgcccagacgacgaagaatttcatcctttaactgttctggattgttcgtaatcatatgatcctcaaaaggggcttgcgccccttgttaaaattatgctaccgtcacagtacattcagcagaggtaattttggttgagagtgcatcagtcacttcaactttatatactcccgcttctgctactgtagccaggcttgcgccagtttccccagtaacttcaaccgtatctttaaaccatttgtatgtatatggtgttttgccaccagtaacaacaacggctaaatccatattatcgcctgttgtgtaactcttcgttgccggaagatccgttgtaaacgccagagccggacgagtagttacagtcacagtcgcggttgctgaatcgttggtactgttcatcgcgtcagttacggttacatagtaatcacccgcatctgcgctggttgcagcagatttaacgatagaagaaccagtttcaccagtcaatacagaaccgtctttatgccatacgtaagtgtacgggggtttaccaccgctaaacactacttccagagtcaatgggtcaccatcaacaacagaaatatcgctcaagtttgtatcgaactgaggaaccgtatgtaccgcaatgtcaagttcatcagaagtaatcacggtattttcagcgtcggttacgacaactttatatacgccggaatcactcgttgtgatgttttggatcattacactcggtgaatcagtcccgatattttcggttcctttcttccactggtacacataaggcagtttaccacctgtaacggtaacagataaagaaatatcatcaccctcgatataatcgttacgaccgaccagattttgagtaaatgacaatggaactttcttcgcttcgtatttgttatccgcttcaacttctgtgatatacggaaccagagcatcagtaacatcctggtgagaggctttattctgttccagatcgtccagacgttgttcaacgttaccaccaccgccagcttcgagagcagcaacacgcgcagtcagatcggaaatcagtttataaatccctgtttctgatcctgtagtattaactccgatcgcagttttgttatcgcgagccgttttctgaataccatctttgaggaatggatcagaactggttgcgtcaccataaacagctttacccatcgcgatattagccgcaacgagtccagttgacgtattacccacaattgcggtaacatcaatcagtgcctggtggtcgtcgcgctgtgtgttttccacattcagcagacggcctttgatgcttgttggctgggagtcagtaccgatatcggtcataacctgtgccatttcaccgcgcagaccatcatcacttgtttcaccaacgatcatgttcagatcgctaatgctacgtttcattgtgctgatatcgtaacggatactacctggaacctgtgagttaccaacagcgctttccagaaggattacgcgaggcagaacaccaacaaccggatcattcatctgggtttgcagagtagtaatgttcgtttccgcagtttccatgcgggaatcaatactaccagaaccacctgagcctgtacgcccgatataagtgttgatgtttgacagttcggtattaataccagtgatatcgccaccgataccattcagacgaacatacacagattcgaaagtggctaaatgcttcggtcccatttcgttacgcagatcggtaacttcatctgttaaatgacctacatctgagtttacccagtcatcttccagcttagtaatacgtgcttcatggatagataccgcctgagcgttagccattaccttgtatttcacgccggagccagtagaggacggatcaacatcaccatcttcgttaaagccaggatatgcacccagttcatctttcaggaaaataatatcttttcgaatggtacgatgtttaggatcggttgacgcatcccatacaccaatttccttttcgatatcctgaattttcagggtgttgcttgctgtagttgcctgtacagcagacatatctactttcagcacgtcaacatcagcgacaactttatccagtttgtcgatcacactatcatcagagatcgccgcgaggttttcagtaatgaggttaacctgatcgataacttcgttgatttttgatgtctgggtagttgtatttgcttctaattgtaccgcgttcttttgaaccagaacaccgcatctgtttaaagaaccctcgttagtggttttggtttttgcaccatcgagagtttcgccgttaacaatccaattgatctgggtttgtgtggtgtccgtagggacaccatcaacaaacgggatctttggtaacgggttaagttttgaaatcatggattaacccctttatcgtactcgaattacgtagttgaccgcaaggtttttcattcgcgtttcgtttccgccagtacctaatgctttgctgtaatcgttattcaggtgcataacacgttggtcatttttttccgcgcctttcagttcataaactgcttgactcttaggaagattaccgccgttctggtaaatcatctggagatcatgttcgtgatacgcaaacatatcagcctgatatgtaccaaaaccgcgacctgcatccacaccacgcccaccatcaaagccgcgagctacaagaccgcgcatatcaggcaagttgaaaatatcaccagaaccgccgtatgtataaccaattcgggcaaacagttctgggtttgaattgcggttcattgctcgcccgttacagataaacaagttaccaacatcggcgttaaacgctgcaagcatcatacatccgatcgggatatttgcgtcaacatctgtctttgtctggtatttattgtcagcactaatcgaaccctgatacaatgcaccaccagtaattgcactgtttttgttgctcggtactacgttagcaccagcagacaaagcagtattcgctaatccggtattgatatctgttgttaatttaaccataccgaaagtagagccggaacccttcacagcagcgagtttttgcggggtgatcgctttggtgttatcagtacccgcgtttacttctgcctgggtagcgatacggagtaaacctaaatcactttcgcttgcagtcagacgaataaacgtgtatggtgaaatcgcaaacccatcgcgaatagtacctgcgcgaacttctgcaacagttgctaactgaacaagaccaaacgaactttctgttgcgtttgcctgtaccggaaccagagcagagatcgcttgcttcactttaagcggagtcattgcggtagtgtcatcagtaccggatgttgcctgagcagttgttgacagtttcacagaaccccaaacgttttcttttgcatgacgggtgttaaacacatagttcaacgagcgcggagtaagagaaaccagatcgtttgttactgttactgattctgcatcagttgcgtaacgagtgtaaccccatacggtttgtgatgcatgagggttttgcagacggtattccagcaaagcaggagttacgatcgtctgggtatcagtacccgcatcaatcattgcctgtgtcgcaatagcagcaataccgcgcacaccaggcgcggcattaggcaaaccaacatcagtacgcgcccacggcccaatagcggctaatgcctgttgtacgttcttaaacgtgctaggccattgcgtaccagcaggatcaaatgtcacgtaaacggatttatcgcttacgtggttaattgtattgttcatttgttatcctcatgcaatacgcttgaaataataaatcggaactgctggagtaacagcaaggtcaatttcacctaactttgtccatgtaccgtaaccagatttagcctgtacgtcgattgttcctaccatcgaaattccatattcagttttattagtaaccggatgcggaactgaatcaataaaacgaacttccagaatttccccgttgagacctttacgagtaaccaaatcgaaatatttttcatcgttgacgaattcaacgaatttgttatagactgtctcacatacggtagaggcgttcgttgtattgtcgaaaacgaacgggaaaccataaacgtgaatagtcgcctgtgtttgatctggatctgggtttgaaaccgtcccatcaaacgtaattgattctacctgttgcaccgcagaaggggggctatcttccgtcatcatgattaccccattgatcgggatctgttgagacaaagaatacaggtcatcaattgctgattgtacgttagggtaatctaccccttttcgaagctgatcgacgtttgcaccaccaatagtacgtttaccaccaatcagcggttctttcgtacccatttcatattgcaaaaagtctgcttcgcgggaagggactttcgccccctcccttgttttggaaataaactgagtcatttatgctacccttatccagcggtgaacagtaatataaggcgggagcgtttttagtttatctggagtagtgttcccccgatttacttttaatacatcctcgcggtatttagtgtaacctggccctgttgcatctgggtcaacctgacagccaccaataataatgatcccgttgtcatctttaatcaacaccttatcggttgactgaatttgtggaacgttgatcggtttaatttcataaccacgttcgccaccagtaccaccagaagtgtgagttggttgaccggaaccatccagatcgttattgttcagaccaaaatcgctatccgatgcatcggttgtccaacctgcaaggaacataccttccgcgtaacgtgtccagataccaaagcccatataatcgcctgggttagcatcattatgcgcgttttcgtagattgtcccgattgggtgaataacatcaaagaacgcttgcagatccagaagacgaccgctaaatgtatccgctactttacgcgaggttttctgcgttgggttgttataatcagtatattcgatctgattaaccagcgtcacttcttcttcgttgttcaggtaaatcttatcggtgtgttctttaataccgcctacaccgtcccattccattacagtaccgatatcattgttgaaccagcgaatagttaccacatcacgggattccagaggttgagcaaatttaatgccagtaaccacggagtcaacaaaaatcagactgtaatcctgtccagaaggaacccacgcgccggagttcgcaatacagctatcttcatcataaccttctgcgccctcacaaacaaatgtcgggagatccgcatcacctgctttaacaagctggcgaccgttcagcagcagttcgaacgagttcgggttaatcaaaattcgcggactgataccaaattcagcattagtgaacgtgcgtttgtttggtagatcaccaacccagatttcaccagggatactaacctgttctgtgtcgcccgtgttatatacgcgcatggtatgcgcttcatacgtcgctcgccatgcggcaataccatccagataggtaacgaattgaagcgtgtcaccagcgttacacgggtttttaagacggatatttacaccatccagatctaccagttgtccggcgctcgcaccaggtgaaccgtaatcgctgtttgatgaattaaacccgttcttgtcgtcgatgtacagcaagttaccgcgatagtaaacttccagtgcgcggacgttgtacgagttaccagggccgaacacgttcaggaagtcagtttgtccctgagtcgcgatatacgtttctttcgctacggttgccagatccgaagttgtgattttgtcaacctgtttgttttcaacatattcccaacgtccaggagaacaataaacaagttcaacgtccatcaggtctttgtacagttctttgtaagtcggtgagcctttgatggtatcaccgcttgcagggacgatacggacgttgtttaccgcccacttaccccatacgtcacgtaagcgaataaccttgttataatcgcttacactgcctttagggaggtttaccgtaatacggttgttgctggtattcagcgcccacgattcaccgaaaataggggtcagcgtaggcgctgtgtgcgttttccacgcacccgctgggtgcgggatactcccgtcacccagtttattatataactcggtaaagttggcgttagtcttttgaccaccacgacgcagataatcacctgcgccgtcatcaaccacgttaccgataagaatttcttgtttcatgctgcgatccctgatttaatggtgtcaaccgctttaatcgagaatttaatgcgatcctcggttttggattgtacgtttgcgtaaacaatatcactcgcaccaacagtgaacgtaagcgtgtacatttcatcttcgctatttttgagaactgcgtattcagttgaatacacgcccttagcgacacggtcaacagacaaaagaatttcagccattttattgactgtgcctgtcatattctccgcatacacgagaattttcgccccactgaattcactataaccaaataaaggaattgcggtcggtgatgctttcagaatgagtttagtagtatctacaggcattgtttttgaaccaaacattgattcaacagaataatcccatgtagtaacggaaccttctttcttcacacaccagattttaatctgagtatatggagaggtcacgtaaagctgatcctgaacccctttgataccatcgccaacttgcggacggaatacaacaggacgatcaacagaaatgctaccgttactatttatgaaatagaacccttcgccgggtttacccgatggaagcacgaccgtaatcgggcctgttgaggtatccatatcatgcaatgaacccagttcgatcgggttgcctgaataataggttcgtggtagtttctggaaatatccggtcgcgtggagcagcattgtacccacaccatcattcgcagtcaataaacgcacatcaccaaacgcgttgtacatgttggtgatgatttcgttaagtttaacaccgccgtcatacagcgggtcaccagttgacgggttgccgatctgccccacgtcaattaattttttaccagtttgatatgccattatggttttccttagaattcgaaaataatactgacttcttcggtctgatcaggagaacgaataatcggttgacggttttccatgtagatcatttgccctgagtcaagttcaagctgttctttcgtgtaatactgccccgttgcttttacttctggatcggtcggttgcgcctttttcagtaacgggtttacaattacactaacctgacggaatccacggttgccaggtaaagatgcttgcgggaagaacagggaatccatgtacgcacggaatcgcattgagtgaaccttcattcggaacaccaaatcatacatatctggataccacttgatcacgttgtcataaccccagcgaaccggatcttcttcgagttcattcgggaacggaacaacgatatgttcatttgtacagcggttgataacaacatctggtggaattgtatacagatattcccagatatagccgtcgcccatgtcgataccgttcgcttccccgcgtggaggttcgatcgattcgtgggtcggtgtccaaatgccaccaatgcgcacacattcaactttacccgtgatactggagattgaacaagagccaatatcaggaacgtctacaacgcggtataccatccatcctttaccgtagtcagtacggttataaggcgcggagtttacaaccacgatgtcattaatgtaaaagatttttgggtttggatatcgagtatcgccccagtctttacgcggaacgattgcatcaatcatttcgcctggtactttcgtcatcccgatcatatgcgtccacatatcaacgataccatctgtatcatcgttcggataagggggagcgaattcagggtcggattcgttatccgcccattgttcggtacgcccgattgacatataaatcgagttatgatcgggggtgtccccgatcatttcgcgaaagttcatcatgttttccgtgcggaacttaccagttacgaccgcacggtagatgttttgttgagccattatgctacctttctctgagtcggtggattcggatcgcgaggattacccgcatcgtctttcaatcgtttttccactaagttacggaactgagagtatttaaccgctgaactatcgaacagaggactttgatcaaatcgacgcgcggacggcagtacaccattcagcggtttttcatcaatgtcatattgtggcggaacatcaaacggttgtcccgctttcgggtgcgggtcgtacaatgcttcaccagttacaaggtcaaatgtctggtttccgttaccgtccagacgggctacgcgatcaggccaatacttcggataaccgctatcgaagcgataatttcgaagaatgtcaatgatcgtttcactatgcgtcatagacaaaccggagttgatgaacaccgttagcatggtgatcccgataaagccaaagcctaccggatgtacgaatcgtaaaacgtcatccttataacgggacgctggcagattcgaacgaattttcatcacgtagtaagaacgcccacggttgaagtagtcgatcgagttgttcgccatttgcttaccacgcacaccacgcagaatagtacccgtgaagttagtcttttcagacttgacaacctgcccttcaaggaagttaccgatcacgttgtgcagcgttactgaccaacgtaattgaccgtcatcatactggcgttcgatatacgtcacgtttgctctcgctgttggtgtgtaaatcgtccggcctacaatgtcctggttgatatttgttgaatgaaccagaatatcatattccagagtgttcgaactttcgatttctacacttacatcttcgttatacaacagtttgaacaggaatttatagcttgcttcgatgcctttcgttgagtagaaatcactacaacgagattcaaagaaacgaaccacctgatcacgcttcgttttatccaggtagatattacggcggtttacttccgaccacagatattctacgctgttcttctcacgcggatatttgttcctgatcaggttcagcagcttgttatagtaggtgttttcacccagcgaaacgaactgcaaatagtattccccgaacttctcgaaatactgctgatccagatagctttgaggcgcaaagcgcgtaatcatatggcttaaatctgggtcaatcaaaccaggtgacagatccggttgatacggtttttcgcgttcctgctgaatcagatcggcaatcaataacgtattgtctggtttccagaaaatcgttaagttgtcgcgagcgcggtaactcagttcaaagaacccgatgatttctcctgaactcttatacagcaacacaccgttcgtatacttcgtgaatccggtaaacttaatgttgttaatgtaaatcgtaacatgtccgcgatcccatacctctttgttcacacgaagcgatgacgaagggccagcactatcggttacaaggctgtaggtgattttcggatacaccaccagaggacggttatcattagtgatccatgtgcgcacagagtcgcggaagaaccagctataattcgcctcgttgtaatattcctgcgcaccaaatttccaaacagtcgggtcgtcgatatgagcgcgaatcgtcgcaaagttaatcgcaaggctggcagtatagccaggacgcaaatcatattttacagcaccaaccagtgcagggttctcgatcaataattcaggatcgggaagtgtgcctggatatttgtagttcgctacggaaataaaaatctccgtgccgttcgttgacatattggtgtattcatgctggatataaaaacgttcttcctcggtgttcccatacaggcgcacaaaggttttcgtgttttcttgccattgatacacaccagcagcagcggacggaaccacgttagcgggttttgtaggatcttgcagagcggttttcacttcacccgttacgagtgcatagagaataccatccatcacatccattttcttgacaacgatcttatcatttccagggacaactgtatagctgtcagtatcgaaaatcttttctccgaacgttggagaactcggatcggtgtcgatcggtgtctgtttcagtgcgatacgacgcacaacgtttttagcaaccacatagagccagtcatcggaacatgccattgcttctgcatatttcgatacgttaccaggcagtttagcaaatgtgttgtatgagtccacatcgaaatcaaggccagtctggttccccagtttggcaaacgtaacatcatcagcagagaatcgcacatcgtccgcagaccagcgaatatccgttgaggtgcgcccgtagaagatacgatcgtaacccagtacataggttgtgtttcggctttggtacgcaacagagcgcgatacagggtttcctacgcggtcgttaaacgccttgtagtaatgccatgtttgtcctttgtcgtttgacaccttcgccatgttctgaaaacgttcaaacaggtacaataaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattaaagttaacgtagttctgattattttttgcgaatttctcgtttatgaatgcatcgcttggcgtaaattcacgcatggttgaatatgcgtaagcgttaagggtaaacgtccagagttcatctgtataaacccagtcagacggttcaaagcccttgtgcgtaaccatgacgcggaacttgtaaaaattgttgggctgaacatcggaagaaaaccattcgtttacataagcataacccaactggaaccaggttaaatcttcatctggaatagttacaccacctaccccgcgagtttctgccatttccacgacatagtaaaaatccatgccgacgctatcccacttcaaataaacgaagttagcagccagtttatcaacgcgcaaactggtaattgacggcgctttaatcatatgtttctccaaatttgcgttttacttatatcccatatttagcaaacaaaaaacccctgccaaatgacaggggttgtaaattattgactgattggattcatcgtcaacgttgtatattgaggacgtagatcgttttcaaatacaatcagagaaccatcacgggtgaaaatgttctcttccagaggtgtaccagtcagttcgatgtaagcagcgctgaatcgctcggatggaacgttcaggacaccaagatcgaaactaatgaaatcattaaaatgttccacatagccgacttcgtaatatttatcacgatcggttactccaggatatttatcaaaatcgttttctgtataggctgcgataccgatatcaccgtttttgaatggcccgataaccattttcgcgagtccggtcgtggtgttcatatctgttgacgcatagcgcacatcatacgaatcaccagcagcatttgtgtacttgaacccattcgaaacaacagaacgtgatttcacctggtttaagaagtgaataccagacatcggggcgctgtaatagttatccagttcacgcaatagctgaatagtcgcagaagaaccaatgatcgacacgtccgcgttatcaacataagtcaacatcttggatttactgaaagatttgttgaaaatttcaacgttatctgtgtagtatctgtcaatttcattgattacttgaccacgcaaccattcctcagactcgatcaacttactgatatcatacgttactttaacgctttgtacaatatacaggtagttcgggtcaaggatcgacggcgtaatagtcgccaggttatacttcgccagatagttttgcatgtcctctttttgaacagaggttaagcgcaaccctgatttcggtttaacagcgatgaacgcatagccaggtttttctttatcagtaaagcactgaaccgcctgaataacagaaccgaaacggtgagacaggaacgattcataatccgatgcagtaacacaacggcgctgtgtctcacgcataataggcgcgagttcacgaatacgttcgatatcttccggttcaccaccaccatcagcgcctacatagtccgctgaatcagtcgggttttcaacaatacttgtaatgctgatatttgtcaatgtatccacataaacaaagttttccgcaccattggcttcttcgccattggttgaaatatattcaattacaatagtcgaaccgtttgcaggtttcaagcccccgatgtaatccgcagtcagagcaccacctgcgacctgttggctggtttcaccttcaccaaagtaaacttcggtatgtccatccacagtttcacgcatgtaaaaaattgttgatgcgcctgttgcgtttacgatactttcgtttgtccagtcatcccattgagcaccgttgacagtaacgcgaacctggctacggtcgatgttcggatctcgaaccagaatcgtagaaccatcatagatgacttctgtacggactaaacgcccctgtacgatgttcagcatcgaaacatagttattgtctttgtcacgaacgatcaccacgtcatcagatacgacgaacgggaaactgtttgtttctttcactgtaccgatgaatttcgtgccgcgcggaatacggatcgatgttgggttcagtgggtttttcgcagtgatcaggatcgaagtatttgcagcggtgcgggagtccggcatatagcccaaatcctgagcctgttgaacaacagaactacgcaatgcagcggtacgaataaacgattcgaacagtgcggtgttactcatttgctgaatgtacagtgtacagtatgataacagatccacaagtacgttcatgcgcgagccggagaaatcataatccttgaattcgtcctgacctcggagccagttgattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacaataatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaactggttaatctgagccattacaggcagttttttgagttcagccattgccatgctgtaggtgtctttcatcccatcttgcagagtagcaatctgtgctttgattccctcatatgcggccttagtcgcattcacagcagcgttagcggcatcaagtgcagcctgataagcagcggttgttgcttccgttacaggttcccacatccagtttaggtactgatcgaacttgcgtttaatcgaatccctttcctgtgtctgtgctttcagggtgttgaatagttcttgtccctgatcatacagtgcggagatctgcgcataggatgcatcaatgaacgctttcactttcgcttgtgcttgctgatacagatccattgctgtaaaccctgggaagttaccgcccagaatcacatcaagaggtttaatctgtttcatgatgttacggatagccagcaccgcagaccaaagcgggtttggtgtttctggaggcattgaccagatctgcatcatacgcccgtacaaatccaccagagcaacgcaaccgttttggaacatcgtcaaacaccagtcaaataacgcgctacaagcgtctacaaggtcgcgagcgccagccttgacatattcaacggtgtagttgtaagaactgtctatagccccgtagattgcgtttatgacgctttcatacgtctgtgcgccggagtcaatcagagcctggaaagaatctttcagggattgaaccgaactatcaccaaacaccagatcgtaaatgttgattgcaacacccaggatcgcaacagtcgggaggaagttattaatcagactccatgccccgcccacgatattaaacgcagagctaatgatctgccggaataccttcattgcggtttgccatgcttgctgtgacaatgccagagcacccgctgtgatttcttccatcccaatcgaaagcccgtcaaacatcgtcgcaatgcccttaccgttcttaatcgtacccgtcagcatatcaaaagccagcttgaacgttttacgagtctcgttccacgcagacagcatagcatcactgatatttgtatacgggaaccctacggtcgccggaatacagcccaatccagaacgagcagaaaataatctggcttcactcggtagcgccccatacgttgacgggagagcaggaggaaccggaggaatgctggtatctgcgttcgtgtttactgacatccctgtatatttgcactggtgcgcgggggattcgtcgtgtttcatgtacgcaatacgattaccattccagtaataatcaatgctggtaaacgcgcctgtagtctgattgtatacctgtcggattcgctgatcgcaacgggggccagaagtcagcaaataaccaccggagttttccaccttgtacatcgcgagttcgccagggttcttgaacagattcgcttttgacagatccgccccataccagtcattacccgcgagcttagtagccccgatagattcgatataggcatcaatatccgcttgagtggcgaaataataaccaatcttcgtaaccaaaatgtcagtagaaactccagggcttccatctggatttgtgggtacgtttggagagttcaccaccggaagcggatcgcttttctgcccgaaaggggaactcgtatacaggtgagttccgatcgggatgatttcggtcgcccattctaccccaacagcggggtaattttctgtgtgtccctgccagataacgcgtcggtaatatccagcagggatctcagcatcgcaaggatgctgaaaattttgcataatcccatcaatgatggtttcataatccatgatcatgattaacctacctggactgttccgccagtgatcttagtcagtgcgccggaatcaatgaaagtattattcgatgctcgcatgttgatattacgtgcgccaatatccaaatcttgctcaatatcaatcagagcattttttgcggtaattgttgcatcctcagttacggcaacggttgcattctgtttaacgttagccattaaattctgattcacgtttacggttgcatctttttcaacggttaattctgcgttgcctttaatcagccccacatattcaccttcaacggtttgattcacgttaccgcgcacgaactcggtcacgttaccatcaacggtctgttgaacgttacccatattgtaaatgaacgcatcaccctcgataacaacctgcaaattacccttaacgtttaatttacggccttgcatgacgatttgataatcatcaccaacgattttaacaacacgggttccatcagggcgaatttcttcgtatgatcctgctgggtgaacacggttgtaacgttcaaagcctggtgtatcgtcgaattcctgaatgtgtccagaacgggtttcgaataccatgttgtatggatattcagcattgtatgcggatttaggttcctcgaacattacgcgagtatcaccaggaacaaaaggatcttctggatttgatgcagccaacacaacagcattgtatgcagcactcaatgaacgcccttctggatctggaacctgaacaccgtatgattcgaggttgcccgtcagcacgattttagatacgcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttcgattgccatttgacgaggacggtttaacgtcacgtatacttctcgaacgtttgaagtgttgctgatcccctgccggacttttgccaaatcctgagcaaacagcgttgaaacttcttctgctgtgatcgttccattggttacttctcgaccaactgctttactgatcgcggcattgatcttcgcagtatcacgggttttctccatgataagcaaatgcccgatcccgatagtcggataaccttcactatcaatataccattttgtgcggataccttcatcctgtttaagcatggtttcgatagtgaacccgccagtatcaggacggttatcttctgggatctcgtcaagtgggcgatcatctggattgacagctaacgaactgttagcatcacgaataatcacgctcgaagaaccgcgcccctctgcgccaccacgagccagtacgttgacatcgttacctacataacgaggatactcaccaaacgggtcacagaagcctttctgggtgtccggtttctctcggtactcacccgcaaaggttcccagtataacgccgtcctggtgccatttatcgcgccagtaaccgataacaaaactaccgcgcgtgataccagtcggggaaaaaccaacaccagaaatagcggcgctgcgaatatcctgaataggcatcatccacggcaattcctcaaccggaataccgatagtttcagatttttgtttctgtgccggatgctcaccgaatacacgcacctgaacacgccccaatagacgaggatcatcgacttcttcgaccaccccctcaaagaaaggggagtatttatttccaccgtatttcataggtttgccttttccatttccttgatataatcacttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccggaattcgtagggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaactggtggaaagaatgagaacaacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgatagaaacccgcatgtgaaacgctggaacagtgaagaggttgtgatcccttatttcagcaacgcagacggaaagcgacggcgctacttcatggatttctatgttgaaatggataacggtgtgacctacctttgggaagtcaaaccgatgaaagaaacgttgcccccacctaagccagcgaacaacaacgttcacaacaaaaagaaatttgttgatgcgttgtatacttatgctgtaaacattgacaaatggaaagccgcgaatgcagcagcaaaacaaaagggctgggagttcaagatcatcacagaggacacgttgaaacgtgtgttcggatggaaagggcaataaataccctaaacggagggaattatgagctttatttttgagttcgagatcatcgcagaagaagacaagccaaaaccgccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctacaagcagcagattgatgatgaaatcgaacgccgtacagcagaaaccgaagcccgacgcaaacgtaacgactatcgcaaaaaacacgcggttgatatcgtaaacgatttccgaaacagtttgaagaaaatgactgttggtgtaaccgctgcgaaacgtcagaaggattcgaccgattggtttggtgatttcatcaaaaccagcattaagacgcacagggttgcgaaaccagcaacgggtcgcttgtatacgttcatctacgatgcgaaatacaaagacaccctgccatactgggatcggttcccgctgatcattttcctgggttcaggacgttcgaaagcgggtaacttggttctttacgggctgaacttgcactatgcgccaccgcgagcacgtcaagagtttttagaagaactcctgaaacgtggctacggatcaacagatcgactttctaacaaaaccagactgaaaatcaactggaacaacgtgaagggaatgcgcggggctgatcaaatgatcaaagcctatctgccagcccatctacgttcaccacttgcagagatcgccccaaaagattgggcgaaagcagtttggttgcctacacaggctttccagtccaaaggaaaaccatacagcgcgaagaaagtttggaacagatattaacaaaaaagccccaaccgaaaggaaggggctttatttttacaggatactcacgatttccgcgagtttgccaggggttgcgccaggtcgaaccttcatcgcatctttcaggtttttatcaaccatcttttctgcttctttttcgttaaacccacgtttcaccaacacagcaataactttttcgcgaatacctttagcggcttcgttcaaatcttctgattcagctagaaccagtttagacagaacatcacctttgtattcctgggtaaagcgtttacccgataccagacgaggcttaccagaggcatctacaaccgtaaacacggcgtattcgcctgtagctttggttttggtacgtccggtatacagcaagcacatatcgttacttgggagcttgtacacctttcctttcaccaatgcttcatccagaggcagatcaatctcgaaatcttccgccaactgattgtacagatccaggttttcttcggcttctttgtacagggaagcgcctttgaatttcagtggcttgtcaaatttcaggtcatcagcaggatcaccgctgtagaatgaaacagtgcctttcgcccagtcaatatacgctgcctgagtcttgccagtggttttacctttcaggcggacaacacctttaccgaagtaagcgagatcgtgggagtctggcgcatacacatcgtaatcagcaccatgtgcaaaatgcaggaaaccgatctgaccttttgcagcgttaccacggtcaaccagatcaacggtcttagcaaattttttgttctgaacagattcagaaagtagttctttgaatgatttcatgttttcaatctcttttgaaagtataggtatagtatacctatttattgaatagatcaactaaaaattagatcgcgagcgaagcgagttccgtcaagcgaagcgaagacggatagttaacgattgtataaaaagtatacggaaatgtactgttttctctatatataaaatataaatattataaacagtacatcgtacataacactcacttcgttcgtgtgttcgcttcgctcacggtcttgatctaaatatctataaaatggagatcatcatgaatacaactgctatgatcctgaaccagatttcacctactaacttcatgttagatattcctgacaatgattatgtaaaagggttgaaactacaagttcagggtgttacactacctgctatcaacattccaattacggatgtcccactgaacccaatgattcgagggaagatcccaggatctgcaatggagttcgatccactgactattcgttttgctgttgatgaagaactgcgatcgtatcttggggtttacctttggatgctcggtactgtcgattttaacaccttcgattccgtgcgttggagtgaaccacaacaggcaatggctttgcatatcctggataactcgcagtcaaaaactgtagcgacatttcgcttctatggcgcttggccctccaacctcggagagcttgagcttatgtataccaatgattcggatgaagccgtatcctgtatgacgatgttcaacttcgctcacatggaaattgagatcgacggacgggtgatcgtgcctactccacggaaaacgcaaaaatgatttatggtatttgtggtaaaaagcgaacgggtaaagataccgttgctcaaatggttgtgcataacttccgcaatgttgaagttatcgcgttagccgacgaaatcaaagctatcctgaaacgttctatggaacatcacgataacacgcaattgcgagcgctggcagcgaagaacccattctatgagggtgatcgtgaagccccgctggtgatgtccaataacgatgcatacacgctgttttctagcggtatcaaaaaattaagttctcgcgggttcttcatgagtaacgcagatgttatcgctcataaaatttgcgaagaaaacacccagccctggacgattcgccgtttgatgcaggtgttcgggactgatattgtttgtaaagtagatccgtctatctggacttcaattgcgcttcaaaaaatgttgaaatcctacgcggatcactttatcattaccgatgtgcgtcaaccgcacgaatataaatacctgagcaagttcgggactcgctttgtgttccttgaacgtgaaactggtattgaagataatcattcaacggagaaaggtttgacacctggcttgagtgattatacaatcctaaataatggtacgttagacgatttgaaacgcaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccagatttgcggtcttctggaaatcgacggttcgcagggtgtatcccctgatgccctgatcggcgcgatcaaagcacttctgccagcaacagtagaaatcgctggtgataatgaagcgattgatgcatcaaaagcataattaacgcttaggcgtttaaccactgggggcgaaagcccctttttcatttggagtacacatgaaaagttttattgaagtagcgaaacccgtagttgatccggggatctatatgtgtgcgaagttcgatcaggcttcctgtgaagcgctcgcgaaggtgcaaaaacttctgggtgtagagaatcctgtttccgctgcaaaactgcatacaacgattgtgtatagccgtaagacggttgatctgttccctgcctccggtatctctgaacctgcccgactggttgacgtggagaagtgggaaacgaagtatggcaatacaatcgtcggtgttctggaatctgactatctccatagtcgttttaaagatgcaatggatgctggagcaacttacgattatgacgattacaaaccacacgtaacgctcgcgtatgattcacatatcgaagatatcagcggagttaaaagactgttgacactgcccgtagatttgactattatcgaggaagatgctgaaccgttggatcttgataagaaagtcgaagacatcacggagcacatcgaacatcgcggcgataagtgggttgtactaaaccatgaccgcacgaaagaacttggtgaatatgattcgaaagaggctgcggaaaaacgcctacgccagatcgaatactttaaacataatgggtgatttatgaacagaacacgactgatgtctcgtatcaatgatgtacggaaagaaataaacgacttgtttaatattgttcttggtgatttctataccgtcaaggtatctgcaacaagagaccatattgcggatcgtttcattgaccgttctgcgtctatcaagaaagatttcgaactgtatcgagatatcttgattagtcttgcgaaacattattcgtgtaacgttctataccatgcagttaaaacgaaaggtggcggcgcacaagagcttattgcttaccgtcgcgttaatggtaaggtttttgcgtgtgtttgtaccgtccagttgtttgatggtgaagaaaagccagtgattgcgttacgcttacgcacggtgatccctgagtacgaagcaaacattaccacgcgcaacgcaattaacgtgaactacgtaccgcctaaaatcaagtttgaatatgacggataccgtcgcgttatgtctcgcctggatcgtctgattgcttctccagattgtccacctcaactacgcatgttgaaaaatatttgaaaaagcccttgcattcgtgcaagggcttttgttatattaggggtgtcgaaacaaaggaggcaatcatgaaactttactggctggtgttctcaaacgggtttgtgatgaaaggtagtgttcactgtgcgaaagcatattgtgaatggaacaaatgttctttccgcgtattgagcgttgcttcttctcaacctatgggtgactactgatgactggcgatcgtatcgttgataaaactttgttgttgactatggtctatattctggtaaaatacctggtatagagaaaagggaggggattatgagaaacttactgaacattgcagaactcttttgctacggtgtcgcggtttacgtcctgtttcatggtgacggtgcgggatactggatcatgtttggcggtggcttgttcctctctttcatcaagaaattctataagtgagaaatatattatgcgttcaaatataccttcaaacgtgtttactgtaatcaagccaaacgaattgaccattgctgacgttggagcgctggttacacaatttggtcgttctaccacactgggtcaattgtatagtgctgtcagatcgaaatacccgtataaatgccctaagtgtgatggaaaaggatacagtgttaaaaccttcaacacttacccttctgggttgcctgattatggatgggttgaccagatggaagatttcaaaatcgtttgtgatgtttgcgacggacaaggttacaccaaagatcaacttatcgccaaacctgttaaagtggaatatgtcaaagcatgaaaatcatcgatcttgtaaaagcggctaactcaatgttattgagtgaacattacgccgaatattgcgagcaataccctgttcccctggaacgtgcaattgctcaatccggttatgacggtatcagcgaaataaccgttgaaaacctgaaaaccttcatcgtgtttgctaacacgttctggatgtatctaccggataacccagggattcgccagcctactttcttcacgctgtgcatgttctgcgaaacgtatctcccagactgcgaggattacgaagaatattatggctaaagtatccttgttgcagttcgatcctaagctgggtttcgctttctacgcgcacggttttgccgacagcgccgaaatgatgttcaaaatggcgttcgggattgaccctgcaacgcttgatcagcaagtgctggcagacatcaacgaaacccgtacactgtattattaccgtttcgctgacggaacaaatatgatacaataccaatcgaccctcgataaactcaaaactgaactgaaagaaataggtgaattatgactttccaatctgaacatgacctgcaacttgctcaaatgatcaaagagcaaaacgtataccgcgatattaaactgtttgaagcgaacgaagatacacgtcgcgtgttctgggtcgaaatgtatcgtcgcgctatcaatgatagtcgtggacataccgaagcgaaaaaacgtgcagataatgcgcttgccgcatatgacgaacagtttacctctaaaggggtataatatggaattgtctgctggtattctctttctgaataacggcagcattctaatgggtcacgctaccgaaacgccccactgggatatcccaaaggggcatgttgaaaaaggcgaagcccatattgatgctgctattcgtgaatgcttcgaagaaactggttttgaagtgttcccagaccaactgatcagcctgggtgttttggactatacaagcaagaaaaaacttgcattgtttgtctataaaggcgatacttaccccgaagccgaaaaatgtttctgtgcgtcaaccttcgttaagaatggtcgaaccattacagaaatggacggtttcaaatatgttccttatagcgaaatccgcgatcatgcgcgtaaaactatgggacaccttctgactaaaattgtgggatatacatcatgagcaaaccaactacttttcaaatctgtcaaatgattctcgttgctaccgcaacccgtgccgctgaacctatcgcatacagttcgtgggattctgaattcgcaatcaagcatattcgcgaccttcctaatcgcctgatcgggtcacctgatttttctcccgtcgatcctaacgagttgacactggaagaaatgaaaaatttgggttttcgtaagtggagcagtgaatctgatttgatgctgatcccgttatatctgttgccgtatctgaaagagggtatcaccgtaaccgatatttccgacaatcaatactacttcttccgtgacggtgcagataacgatcatcgtatgggtcttctggcattcggtgttgtcccaaaggcataacatgaaaatcgttgatttcaatactctgtccgatatggggctgatctggaaaatcaacaaagaaatattgcacccgctggggctggcgttaacccgcgatccttctggtatatcagtaggtgcaattgtttctgatgatggtgcttgggaatacccagaaacctctgattttcaaaacatcgcaaaacttaataaagtttatgctatgcaagccgaaggaaagctgttagaattcctgcaacaacatacgaaataggggctaacgcccctctgaggattatattatgaatggtaaacgtgtagtcgtaatcggcaaatcaaaacataacgatgtcggtactcacctgatcattaacaacgaccgtggtgattggtacggcgcaacaaatgtaatcagtggttatgcgactatcgtagaaaaagatgctgtgcgtatagcaacccctgctgatcctggttattacggaacacgtgacgagttcgaaagtgaaaaggatcaagagatcgcagaaatgaaaacacaggttcataatgcgcgtgtttttgctgctatgtgtttcactgttgcggttgctgtaactggtttgttctggatggtggtttatcatggctgatgaaatcgtagcccgtaaccggattcgtgaacagataactttcagaagtcgcgaacatgcgatcatggttggaagttatatccactggtggaaaaacaatgatctggatctgaatccatcctatcagcgcccctatgtgtggacgcagaaagaacaagatgaattcctgactacgttgatcactggtttcccgtgtggtattatcgcgattgctgttgatagtgaattcaacgaatctcattgggtagaagtaatcgacgggaaacaacgcctgacgactatcatcaaagtctacgagggtgagattgggattcctatgccggatggttcccgtctgttctgggacgatatgcaacgacatgaacaacgagcctttgaaaacctgtcattacctgccctggggctggatgaatgtaataaaaaggatcgtcttgaattcttcatcaaactgaacttcgctggtgtgcctcaatcacaagagcacatgaaacgagtcattgaaatgtataaggcaacaaaatgaaaccaattagtttagcaggatctgcaaccccgtttgttactggtaaatggtactacagaaagcgcctgagtcgcttacatgaatacaccctaaaggctaaagggatttactatcctcaagtcatgcaggtacactgtgatgctgctggtaacgtgcgttctgttctcagtccttcggaaaatggtgaattgcgagttcttaatcgcgatattcctaaagaatactatattctttacgaagagttcacaccagtaactacagaaaatctgcgtttcgaacttggtaaacgctaccggattgctaaccgtggggctattgattccctgtgtaatctggatctgggtcgctatggacataacacctcgttacgtcgcttcctttctcatggtagccgccgtatgcgtgaccgtaacgtcatttatatccacaccgctactaaagacggttgtgcgttgaaaatactgggtagtgaccatgcaagccctattcagcgttcttttgattcgttgatccctggttggttgttgatgttcctggaagaagtaggaaccgacagagaaccaattgaaagagatccggtcgaaactatggtttcacagattgaaagtctcgaagacaacacgcgccgccaggtgaatcaggatgattatatcgaccttgattttgcgagtgttcatgatgaaaacgaatttcctgatgataatggtgttctagtcagtaaggaagattccgaacttctcgaagcggtgaagtttttaatcgaacatgcaaatgttgattacggttctcgtgcgatcattcgtctatccgctgatggatacacttatggtgttgatgatgcaaaaacattggtttcatgggctgcaaaacgcagacaggaattgatgcgatatagcgatgaactgttttctaaaatcaacgacttacaagcattaatcaaaaaattaccaaaataattcaaaaagcctcttgcaatgcagggggcttttttgtatattacacacatcgaaacgaaacacagaaaggggattcaaaaatgggtatttcaagcgcggttgcttctaaacgtctgtctaaagttgttggttgtgaagtcctggaatattccagctatctcactgggttctctttcggtgtgaaaactgaactggaagcgtacaaagccgcttacgtttatcgtaacatgccacgggttgacgtgtactacacggaatctatgggttactggatggttgctgtttacaaagaagcaaactgatgaactttcacgaacgcaaggcagcacgaaccgattattacatacggttcgtgtatggctggaaattacggaaatgtgttgcatgtaatgggtctgggcgatatgataaccacggatcgccaaaatgtagttcatgcaacggtactggaaaagaacgttataaacctgtgagggatatattatgcaacatgtgaatctgaatccgaaaatgaagaaatatctggatcgtcgtcatgataaccagaccagtaaggatcaggaactggcgttcaatattgaaaccgcaaaactccttactaaaatgtttcgcagattcccaaacaaggtaacgcataccagtacccatatgcgcgtagaactggctgataaacgttgtatcatggttaagctggcttacgggttatcggaagatggttacaacctggtgatgggttggacatcaatgatcggtaactacgttgaacagaacgatatcgagtttaacatgatgcgtggggatctgttccagtgtccggtagacacgatccatatcggtagcctttacgctatccttcgctcacaatatgaattatgggatatgaaatgattttagatgaagaattcgaaatgctgaatcgtgctattcagcaagtaaaacctgttatcggtgacaagtgggatggtacgaatcaaccaggttcgattacgggtaacgttaactacggttgcggtagcaacatgaagaaacgcgcgtttaccattattgggcctaaagcgttacaggcggtacaagaggatctgtggttgcaatccctgatacaatacatggtttcgtttgatcctgataccactgaacgcctccttaaagagattgtacttctacacaaggagaacgataaacttgctggagaacgcgatcactggaaagcaaatcatgaatgcgaagtgtcacgcgcccgtgtactcaaacagcgccctgatatgcctttggagcgcatcaaagcatatgaccgtatggttgagttggaaaaggaaaacgaagccttaaaacagcgtatagccagcctggagaacgtcgaaatgactcgtgtcatgatcgatatggcttcacagcgtggacatgagcaaacccagatgttgcatgaaattctgcgatatatgaaagcacacttcaaagatccggggtattactaatgtccttgttcaatagagagtgtaatcacgttgcgcggggctggaatggtggaacaccttacgcctttatgaagtattatgttatggatgggatcgaccgcatacatggtgatatgtatgcaacatgccacaaatgcgggaaagaattcttgatgtgtaaaacgcatcttgatcatgcgatccgtaagctggcagaacatccaatttctcgtgctgaaatccttcgaatcctcgaagaaacaaaatagcactttttgttaaagaaaccccttgcctatggtgaggggttttgttatattacacacatcgaaacgaaacagacaaaaaggaaatcatcatgaaacttgttcgcgaagcaatcaaactgggtaacgaatacaacggcaaatggtacttcatcatttacgacgacaacgcagaaaaactggaaaaagttgaagatgcattacgtgcaatggaaactggtgcttctgttggtggtaaagtgatgacctgggaaaactactgcgacggttgcccttgctacaacgatggtttcggttctggtttctgggttgagattgaagatgttccggcgttcaaagccgcctggaaaatcgctaagaaaatggcataaggggaataacatgaaacacattttcagcaactacctgaacatcaaattcaaaactgacggcgtgaatgtctggtggtggtcaagcaatatcggtcaatggttccctgaattcactgttaccgccgaatccctggagcgttctgttgcaaatggaaatgcttctgtaattagcacgaattgctaaaactcgataaccctgatctgttattgtacacacatcgaaacgaaggaggatatcatggaaatcatctacaaaagccggaactacaaaaaagaagatgttgcagcagtttacatcaagtaccggaacgtgaaatgtgagtatagcgggatctggggttacgaaatcgttgttgaagaagtaaacgccgacaacaaaaccatttgcagtttcaccactaacaccgatagtcctctgttcactactgaacagcttgaacaggcttatgaactgcgcaaccaggcttttaacgcggtacgtatcaaatgagattccgtccttatatcgaattccttcgcggtatcagtgagatcctgaaccgcgaaattaaacccagtccgttagccgttgagctttatcgactggacgcaacccccgaagatgcagcaaaagattatggaaatgaactatgactactgaaattgatattgttgttgaacaacttgttcttgaagatcgtaaaataacactttcctattattcggaagatgggtgtgaatcgtgggatgttacgttcgaaggttctgattttggaatgggagtttcctttagtaatgaagaaaaagcccgtgaaaaatataaagaatattgtgttctttacggaaaataaaatcgcttgcgctgggtgtgggatgatgttatcttacacccatagaaatgaaaccggagattgttatgttaacttttgaagagtacaaagcaaagcgtgaccagttaagcaactggcacagggagatcggcagggaattgagcgcttaccctaaaaatgaaatgggtatgacgatcgaatcaatccgcaatacgccggaatacaaagcgaaacgtgctttatgcaacaaagttttccaacagcttcgcatccttaacgggaagtacattaaactgtacaaaaaagaactggctgacgaacgtaaactgaaacggagtgtaaaatgatgcagcacgaaataaaaacagagattgataaacgcatcttcctggaaaagaataagacggtaacgctgatgcattactccaccaaaaacgggtctagtgagttctggcgtgttaacattgacagcaaagatcagggaacatcaatcccgttcgatagcgaaaaacttgctcgtgctgttttccaatcccacgttaaattttgagaactatatcatggatattattgaccgcgcacaaactgtaatgaaagccccttcgctgatgatttaccagcagggtaatatgcgctttgctcgctctaagtggtacaactataatttcaatgttgacactggcgaattcgctcgttggggtacaacctttgcaagcgatccgacatacgcacctttccccgaaattctcgatatcgagatcaccacgaaatgcaatggccccgctggtaagctgtgtggtttctgttacaagtctaacaaccctaacggctacaatatggatctggaatcattcaaatctatcattgataaaatgccctggttgactcaatgcgccctcggtgctgatgcacagggacaaacaaaccctgatatgttcgatatgatggcctatgcgcgttctaaaggcattgttcctaaccttaccattgctgatgtatcaaaagacgttgcagcgcgtttagcggcggttgctggggctgttgcggtatcggtttataaacacgctggcttcgatgtcgctttcgactcagtagcgaacctggcagaagcaggacaacagcaaattaaccttcacttcatggttagctcgaaaacctacgatgatgcgtttaacgttgttgatgctgtgaagaatgatccgcgcctgaaacaagtaaacgcgatcgtgttcctgggactgaaacaaaagggacgcggtaagaactgggataccgttacccgcgaacagtataaaaaacttgttgaatattgcctcgattctggtgtaggatttggattcgatagctgttcagcccctgcattcgttgaagcgatggagggacacccgaacttcgaacagtacaagcagtatgcggaagattgcgaagcgacaatgtttagctcgtatatcaacgagaaaggcgaattcttcccgtgctcatttaccgaacgttgggtcgagggtggttgggccgaaggtctgaacgtcctggaagcagatgactttatcaaagatatctgggaacatcagaaaaccaaacagttccgtaaagaactgatcggcaacaaggaccataacggttgtcgtaactgtccggcttatgcggtatgtggtaaagatatgcgcgtacacaaagcccctgaaaccgatgtatatgcagtggagttaaaatgattattacatcagaaataaaatcgtatatgcgtttatatgcagaccactttgtatacaatagtaattcagaggtggaatgtgttaactatcctgttaacgtagagcacgttttatggattcagaccgacgctaaaattccttgtattaacaaaacatggaaacctgcgattacgtttcatttagcacataatcagtcggtaacgtgggctggatatgaatgtgaagaagaacgcgatgctgttgttgaatacatcatcggttatatgaatactctcaaatatggtggatgatatgatttatcaatcctttgacgattcaactacaagaatccgtcctgttccgataactattgacattccggcagaaaagcgtacactggaatcgttgattgaaaaatatagtgggatgaccatttgttctgctaccgcgataatggcaatgtcagaacgcgatgctatcgtatttgaatgtgatatgaaaggttatcacactcccgaagatatgcagatgattgattatctctggaaaatcagaaatactgttgttcgcaaaatccttgcggaaaaagagtgtgaggaagaatgcagcagaatcaaaagtaaatggggtgtgttatgaccgaaatactcgatgaactgatgtatgtgtatcgtgaacgttgtaacaacgggcgtattactgaaccgaaagcaaaagcgattatcgaaagatattggtctaaactgagagaacatgacgcaagttcaaaactgctcaatagtctgatggttctgaaacttctgatcgcttctggtgatgatatgccgtgcgatacaaacagcgcggaagagtttcaaaaagcgtatcgttcctggggtgtaatttactcccgctcgctgggttcgtatgactctattatgtggaacctaatgcacctggataaacttatttgggaagtgctcgaagaagagggtattgtatgaatctttctcatgaattaagcggggcaatccgcactattgaaatgatgcttgataaacttagcgcgaaagaagaattttgtgtaagtgatatcgaagcgaatttagttgaatggcgtggtgctctttatggagcaacaaagggcaatgatcctctgttcgctgaatacgatgtgtataacgtcaagatctggaacactgaatatcgtttcaagtggcctggtgatgcttacggacacatccaaacgttttacataactggtggtatggtgtttgctaccagtatcggggctagtgaacttccaataaacccagatagtaaagtaacgacaccgaaccctttcagacatactacgatttgtgttggtatgacagaggatttttcaaaaaattatacgggctggattgaagcccataacaccaacttaaaaagagtgtgattatgtttaaagttattggatgtgtattactggttgtggttctcgttttattgcaatcaagctgtaccgacgaacaagaagcacaacgtatcctggaagcgcaagggtattcgaatattcagttcacaggatatagctggttctcgtgttccgaaaaagacacatacgcaaccggatttacggctacgggcgtaaacggtaaaccgatcgctggtgctgtgtgctctggaatgtttttcaaaaatagcacgattcgtttcgaataagtgttgacatgaatccccagtatgataatatctctctcgtagacaacgaaacggattaaaggggattcaaaatgagcttactgaacgaaattctggaaatggttgaagcgaataaagaagcaatgaaagagaaagatggttgggtagttgtttctgactgcttcaaaccgagcctctggactccggtttatatcaacgaagcaggtaatgaagaacgtggtttctacgaggctgcaatcttcgaaaccgctgaacaggcttgcgatttctggtcttacctgagcggtgacaagcctttcaccaaatacggtgtttgtcagtgcaaagacatttaatcccagccccgaaaggggcttttttgtaggtgaaatatgaccaaagcagaaagaattattaaccatcttcaaaccggattcccgtaccagggagatctacagcgcgatatcatcgaactgttatcccagcatgacgggatggaagcggagataaaggaattgactcaccctgacgtgaacgtattcgcttcactgatggatgatgtgatcgctatcgactcggacgaactgatctgtatcgagacaacgaacccagaagataagacgatcctgaaacaagcgtatgagcggatcgagggattacacgatcgcctgttccagttaactttcccaaataaaaacgatagaccttgttgacatcaaaccagattatgataatctgtatatgaaaactaattgtgaggaatatattatgaacgcttttgaaaaacgtgctgtcctgaaagatatcaaacctggcgcaatcctgtacgaagtaatcagtatcactggtgaaaaggcacagatgggtcgaaaacatatcatcactggcttcccgcgtgaacatcgtgggctggggctgtttgttaacggaatcactgtgtatgatgattgggaaaataaaggtcaattctctctggatgatcgtaacgtaactgggcgcaaccattataatttccatgcgttgttccgtagcgaagcagatgcgcaagcatatgttgaacaaatcaataacgacaaacttcttcctgatgacaaacaggaaagtgttgaaatgacgattcgctggaaacgcgatcgcgcggaagatgcaatttggggttacatgtaaaacgttgcgcctcttaaaccgtaaataccctgtgtagcccatagggtattttcataaagaggtatgtatgtttaaatttagtcagaaaagcctgaacaacctgcaaggcgtgaagccggaactggttaaggtggtaaaacgtgctctggaactctcacctgttgatttcggtgtacgcgaaggtctgcgcaccgtagagcaacagcgcgaaaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctgatgaactgggtgtaaaactgcgttacggtatcaactggaagaacgatccaaatcttcctattgaaacgaaatttatcgacgcaccacacgttgaacttgcataaggcgacaacatgatttcacaattctatgttgacgctgtaaagcagtcacgtaacctgcaccttgcgcgaatcattgatgggcgttgggggcaagaatgcggcggtgtgtctattttcgaaactgcgctggatatgggccggatgtcgggtaaaaccaaagcggctttcgatatcatcaagcagtcgaaagggacactgaatatctacgttgcgccgacaaagcaaatgggtatttgtgctgcggcagaacatggaatggataagggcgctgattcgtctttcattctgtcgaaacgtcaagatctgacttccattttccgtggacaaacgatcaagtatcaggcaatcaacctgattttcgatgaatgcgacatgacgatcgacgaacggtttgaactggcaaaaacactgaccttgtgtatgcgttcaagtcatcttcacccgttcccatatatccatattatccgtttgggtatgtaatgaaaagtcatggttattcatcaagaaccatacaggaagagattcaagggattgagtctcttctgagttatgtagatgttgatacatctacgggaaaagtgtattggaaaattcagcgcggccctatgtctcctggaagtgaagccggaagcaagaacgagtattcccaaattcattttaaaggttctatgtatttgcgacaccgaatagtgttttacgttgagaatggttatcttcctcctatcgtagatcatgtgtatggtgttgaaaatggagatacagcaagaaatctacagaaagcgacgaaccaacaaaacgcgatgaaaaagaaatgtaattcaaacagcagtacggggttgaaaggtgtttcttatcacaaagcaaatgggaagtataaagcgcagataaacatagatggaaaaagaaaatttttggggtattataccactccagaagaagcaaaagccgtttatgaccggaaagcgaaagaggttttcggcacattttttaacgaaaccacataaggttaatgtatgtcaaaatacgtattagacaccaatgttttgattagtaacccatattcaatctattcttacatcgaacctgacagcgaaatcattatcaccgctgcaacgatggaagaactggatcacctgaaaagcaaagagcgaaccgctcatgaagcacgactggcgatccggcttttgtccaaagcaatcctgggacaaaattatgaagcaattacccaaacaggggtttcgttaaacttatcgaacccagcagtaccggaaagcgtaacactgaaaatcgtcgattatgacggcaccgaagaattccctctggataaacaggatgcgcggatcattgcaacttgtattcagcagggcgcaactctggtgactcgtgacattaacatgctgttgatcgcgatgtctaaaggttgttcggttcttcaatacactggcgatgactcgctgaaagatagtgatgtgttgtattcaggttatatcgacctgcctctgttctgggaaactgttgaagtcctggagtatgtcgggcctgttgccgttataacgtattcatcgcttcctgacgcggatttctaccctaaccaatacattctatcgtgtggtgagattgtagggcgtgtggtgaatgctggagagtttcagcttgaagtgttgcctattaagcacgaacaggcgttaaagcgtaagctgatgaaaacaatccagcctcgcgatgctctgcaagcgtcattcgttgatgctattctggacaaaaacaatgacgttgtgaccatcatgggcgcggcgggttcaggtaaaaccatgctggctgttgctggtgcaatgcacatggtaaacgcgggacacttcgcaaacctgatgtatgtcaaggcagatagccctctgtcgggcgaaatcgggttcttacctggtactcttggcgaaaaactgcgtcctgctgtagaaccatgtattacgagcctgaacattctgtttaaggatcaaccggaagttgacaagtacgttgaaggacttctggaaaaaggtgtggtgcagttccctagcctgtattacttccgtgggcgttcaatcggacatccagatccaggtaaaggttccgtgctgattgttgacgaatgtcaaaacttgagcaaccatgaaataaaatccattatttcccgttgcggtgagaacacacttctgatactatgcgggaacattaagcagattgacaacccgcgaaacactgcggttaacaacggctttgtgtatgctgttgaaaaacttaaagaatatgaccatgctagtcacataatcctgaatactgtgtatcgtggacgcctggctgcattcgtcgaagacaacttttaatcaaaggggcttcggccccttttttgtgaggtatacatgatcaatattattgtttcgccaaagctgattactgtttgcgaattttgtcgaactgggttagaatacgaactcgacgacattcagcgcaagacagaaaccatctataacgggttttatagtcctgctgattatatcgtgaagaagttcattacctgcccgaaatgtggtagtaaagtaaatttaaatctgaactgaggttattatggtacaagttgttagcagacctacagaaaaggaagttacttgttcgtgcggagtggttcttcggtatcatccttctgaggcgaaagtaaaagagatatcttcggaagggtcatatttctttaatatggaaacgatattgtatatcgattgtcctgtttgtcataaacatgttcgtgtggggaataattatggtacaagttgttaaaatgcaaccaaaagaagtcatctgtcggaaatgcgaaacacatctttcctacgatgctactgacgtgcgcgaagaaacgcatactgattacactggcggtcgtgacacctacagaatgatcacctgtcctatctgtcataataaaattgtggtgaaatgattgcataaataataaggtgagggtatcattgccctctcttgttacaaaaggtattaaacaatgaagaaaattattttagcgaccagcattttcttatgctctttttctggtcacgcaacgactgatccgcttggaaaatttattgaagaacttcctgctgtaaagtcaacattaccgctacaacaagcaacagtgatcaagaaagcaccagccaatgcccctgcatatgtcaaggaattggatgaaattacaccaaagcagaaaaaggttttggagtatgctttcagagttggaaacgactatgatctaaaaactgcaaagcctgttgaaacggaaaaatcgaaacgtttgggatatcatttagcggctattgcctggatcgagtctcgcgcatgtgagaacaccggaaagggcaaaaaaggtcatcatgcttatggctgttggcaagtcactgtaaacagtgcttccgcacggatggataaatcatattccaaacgcgtagtaatcaataagctcgaatcccttcggggaggttctaagtttgccattcatgaactggaatactggcttgattaccacaaaggcgacttgaaaaaggcgctcgcgagttacaatgctggcttcaagtatactaagaaagaagcccgtgagtatgctcgcatggttaaccataccgcgaaactgttagaagaaaagcaaattatttgatcaaaagcccttgcatttttgcaggggcttttttattatatgtgcatcaattattgaggattaaatcatgagtacatcacatcgagttattgtcggaaaatgcggtctcattaaacgaaacgcattgagtgttatccaatcagttctatccgaactcaaaaatcaacctaatgttaaaattctccagatcactgttgataaagacagtatgaaagcatttaacatttacttcgaatacggtgaagaaaagcgcaaactgtttgtgtatgaaagcgatgatgtgtatcgcaatatagaagactatccgatcgaatgtgacctatacttcaatctgaatgtatggggtagccacatagagatcatgaacatcgtgaaatctggcattcgtaaagcggtacgcgctgggggaatttacgaatgtgttaacgatgcaatcgaagaccgctttgtttacgtgttgggagagtaatcgtgaaaaaacttgcgctgctgttgactttagtttctggtttcgcttatgcggatatttcagacaaccgcctttctgaactttgcgaccatcgcgacattaaagatacttcggtatgttaccaggtgatcgcggaacaactggacgctgcttatgtctggggagaagaaaacgcgcatttagtcaaacgtcaaaagctggctaaacagcgtgagtttttgcagtctgagccgatgatgaacctctgtacccgcgcaccaaacaaggaacgttgtgaaaaacttcgtacttacctggtggatgaatataacgctggaataggattatattgatgctaggactaattattttttacggaatggttattgctgttggaattatcatctggtactgtttaatgaagccaggagaacgttcattacctgaatacaatgatgatcttgaaccgtggcaacgatgggatgaacacatacaatgagcataggtctacaatttactatactgatcagtgttgtgattttaatggggctggtcattgggatcggctatagaatgggtaataaagaatgattcagtcagacaaagaaaagctctatcacaagatcgagcaatttgctaaagcaagggatcgtttccttgacggtgaagccaaagcatcacaagaagcgatggattggtgggatgatatcgttgcttttgtcgatgatttaatcgacgtagaacgcaaagaggcgagagaatgagacatcaagaagaaaaggtgttaaaacataagctgaaagaactgggagaactttaccaggactacgcagcagaagacgatccagattcacgcaacctgaacatgacatatatcaataacatggttgatgacattatcgcgttcgttgaaaaagaagttgaagacgcggtagaagatgctattgcagaggaacgttctaaacatggctaaactgtattatcactacgcatcaatgaacgctggtaaaagtgcgcgactacttacagacgcatacaactacaaagaacgcggtatgaacgttgtgatctacaagcctatgcttgatactcgcacatcacacactgttgcttctcgtgtcgggttaagcgcaacatgcgaattgattgcacctaatatggatctgttttgggatatccaacgccggaataacatttcgtgcatctttgttgatgaagcacagtttctttcaaagagaaacgttttcgacctctgtcgtgttgtcgatgaactcgaaattcctgttatgtgctacgggttgcgcacagactttcagttgaatctgttcgagggttcttactggttgcttgcctgggctgacgagatccgagaacttcggggaatgtgtcattgtggacgtaaagcaactacggtcgcacgtatcgacgcacaaggaaatttcgtaaccgaaggggcgcaagtcgaaatcggggcagaagacaaatacgtttcgctgtgtcgtaagcattatcatgaaaaagtgcttgataaagttggcgtagactgttaaggtgtaatcagacaacaaaggagatatctatgagccgtacttaccgtaacaaatatgttcctgtccgttccaaagaatcaattgagaaaattgaagaatataaagcctatgcagcatattactctgctaatggttgtgatcctaatggtgggcgctggttctctacgaattgccagttgaaagtaggttgtatgtatatgcgtttcgataaaaacgttacgcgcgacggtaacaaggcacatggtgatatttccgctatgctcaacatcgcaaagaaacgtattgattcaaaagttcgtgaaaagatgcgtcaggaattgcgccggatgaaagctggtatgattggttgggatgaaaatgtcgaaaacgccaacaagatccgcgctcatgaacgtggtttatgctggtatgacataacgtaattatttttagactgatttgacataaggggcttttagccccttttttgctataaatatatacaggaatggatctattgttgatccgtaagcacttagagaattgctatgaacattaaacgcatatcaaaagcgctgatgtttggtttgttaatcttgtctccagcatcacaagccgacgaccgttctgttgtcgcgaaagaattcgactactacatcaatgcagcgctacaggtgtatctagacaccatccctcccagcgtaaataccagtgaacttttctataattacatggaacgaaaatggcagcagaaacagtgtaaatccgaacctgaatgcaaacgcttagggcttagggtagcaactgaatttgcttctattcaccgttcataagggatgaaagatgcagacgtttaacgaagttgtcgatcgcgataatgcaagtaaaatagatgcctttattggcagatgcctgatgtccgttacgtatatgcacagcgcacactttgctactggttcatattcgcaacacaaggcatacgagggtttttacgaagatatgcaggatttagttgataaattcaccgagatccatataggcattacaggacgttataaacccgtattaaaagttgaaaatatgcttgacacggtagcgtatctccgtaaaatagtcaccgaagccgaagaaatctatgattcagtagacagttcattgaagaacatcctggacgagataaaaggcttgtgctatcaaacgatttacaagctgacaaaactttcttaaaaagagtttgacaagcgaaaaagtgatgatagaataactatcgaattgaaacataaacccaaatggaaataatgatgaacttaaacaatatcgtaaacaacccaatcgtaaacaacccaaagaaaaccactctgatcgctctgggcgtaatcgctgctctgtggctggttccgaactcgtacacgatagttcaggacggtacggtaaaaactcaaaccttcatgggtaaagtttcaccgaaacctgttctgcctggtttccacctggtaaacccactggctgatttcgaggtgttcaacaccaaagacatcgcaatgaagtttgacaagttgcaggttccgtcccaggataaattcaaatccactgtggatatgaccgtgatgttgcagttcgatggtaacaaagccccgatcaaccgtatcaacgcgggtaatcaggatcaggcgcttgataagtacgtgaccgaaaaacttctgtctaccgtccgtgagttcggtaaatctgtaccaaaagcacaggatctgtataacgcagaagttcaaagccagctacagaccgcgatccagcaggaagttgaagagtatgcccgtccttacggttacaccgtgaaacaggtattcttgcaggatatcgacctgccagaagcgatcaagaagcaggttgaaaacacgaaaattcgtgaagaacaggtgaacgcagagaaagcagaactggcacgtaaagagcaaatcgctcaacagaaagttgtgcaatccgttgctgaccgcgaatcccgcgccaacgatgcacaggctaacgaacgtgatgctgatgcccgtctgtatgcggctaagaaagaagccgaagcaaacgccattctgcaacgcacaatcaccccagaaatgatccgctggaaagaacttgatgttcagcagaccatcgcggacaaatatcagggcgatgtacctcagactgtcatgggttcggattacgctggtaaagtgattttcgattctcgtaaataagggtttaaagccccctctcctgggggcttgattcttaaaacgagaatactataatgaacataaaacaggctatactaactatcttcatttcgtcattcttcggctttattggcggtttgcttggtgtattgattattgcgtctgttttatgattaccctttaaacgtggagcacgttatgaaatacaaatttgataaagctgtcgtaattggcagattccaacccttccataatggtcatgcagcgatggtgcgtaaagcacttgaagagtcgaagaccgtttacatccttctgggttcagcttacgcttaccctaacgttttaaacccgctgacggcaaccgaacgggaacgcatgatcactagctggttactgtctgagttcaaatacgaagatgtatcccgtgtgcaattcaaacctattccagactacctttacaatgaagaaaaatggaaaacctctgttcgtacagcaatcgaagaaaccaaaggcgataatatcgcgatctacggttacgaaaaggatgctgattcgtactggcttaaagcgttcggatggactcatgttcctgtagaaccggttaaagttgatggtaaagatttgtctgctaccgatctgcgtccgaccatctttttacataaaaacgggtgggatgaaaaaatcgcacgatacgcaccacgatctactgtgaattatattgattcctggatgatgaccgatacattctggcgtttgtattacgagttcgaaaaatgggaagacgaactggagaagttcaaaaactacccatacccagacgcgttaaactgctgcacgggtgatagcgtggttgtgtgtaacaatcaccttctggtaattcgtcgtaagtttgcaccaggtaaaggcgcgttggccctgccaggtggacacaaaaacgcaaacgaaacattcctggattgtgcgatccgtgaattgctcgaagaggttcggatcaaggttcctgaaaaggttattcgtggttcaatccgcaattcgatgttgttcgaccatccgaagcgttctgtacacttctcaaaaccgactgtggcgcagtacatcaagttagaaccgaacaatgatggaagtctgccccgcatcatgggaggcgctgacgatgcagcagaggcgttctggatgccaatgcacgaagtcaaacagaaacgtggtgagttcttcgatgaccactatcagattatcgtagcgtttacgggactctgataaaaagattaaaaagcccttgcgttcgcgtgagggcttttgctatattagggacatcgaaacgaaggaggtaattatgagcaagaaatcagaagtagccgaaatcaaaaaacttgatgatggtaaaatcgcggtacgttggaaaggcaatcgcaaattcaatgtgattgaagatcccgaagtcgctgctttcctggtgttcatgattacccagaaagatacattcgttcctgatccaaacaatataaggctggctgattaatgaaacacccttactgtttggtaagtcgtccgatttgtgcgggtggcttacctgttaactgttggcagttgattgaaaaaggtgacgcgttcctgaataagcgcggtgataaagtgtttgtgtatggtgttgactctatcgaaaacgaaacgatggttatcaccgatgaaaaaacaagtgaaaaatatacgttgacttctgatcatgattgccgtaactttaacgtgtactggaaatctgatgaagaatttgagaggaaatcattatgaacaaaactgcatttatcaaaacagaagaatcgaaagttgtccgtcgcgctctgatcccaggtgatagcgtctatatcaatcactcgaaatctcgtggattcaaagaatcgttcaccgttcaatctgttgcaaaagacactcaaagtggcgtaccgattactgtgtatgtgtttgcttccgacacacgtactaaaaccgcatcaactatcatcgctaaagtcggttctggtgatgaacatatgttgatttccgatagtgtgtattctgtgaacattcatagcattgatagccgcgatgtctctgcaaaagatacaacggtcgttgttgatggtgatcatgtattatcgttcgcgctcaatactcgcgaaaaggtagaacgtcctgttgctgttggtgatattctgaaaacagaacgtcgcacataccaggttgaatacatcgctaaagatggttctttagtgtgtcgcatgtactcccgcaaagataaagattcttatcagggtatggctattattgacggtgttgaccgttctctgatgtctgcactgtatacgaaggtgacgtttaaatgaaacatgccagaagtgttttgatgggtgatgttatcgacatcaacgggaatgattactacgttgcggaaatcaacacaaagggtaatcgtgagatcctggaactggatattgtgaaatctgcgatgggtaaatcacttactatcgaactggtgcataatacgaaaactggtgagaatgtcactactccggtattgtctaaacttcctgtgttttattgtgaaaagaaaaagtgttggaaaatgaaatgactgatttaagagatttgtctgatgtgaaagtgggtgataccctgtacgatcctggcgtaagtcaatacaacaatcgaaaaactgcgaatcctcgcgtgttccatgtaatcaaggttgctcgtcaatacttgtacgcatccccgaataataagaatgctgatttaaaagattggaacgttgagaaagtcgatcgtaagtgcgggttaacttctggtactggcggtggatggggtggattctacatgtatcgcagcaaaacagtatatgatgaaattcaatatcgtgttatgctgtctgagaaaattcgaaaagaattcggttctcatagtgttcgtgttcccgaaatcgcgacttttcaactgaaagatattgcaaagatgttaggtattgatacatcggagagtgaagaatgaaaattgtaatggaaactgtgttcggttctcacctgtatggactaaacacaccgacaagcgacaaagactataaagggatctttctcccgcatccacgcgatattctgctgggtaaagccccgaagactatcgacacgagcacgggcgataaaagttctaaaaacaccgtagacgacatcgaccgtcagttgtatagtctgcctaagttcattagccttgcatgtgatggtgataccgtagcgctcgatatgcttcatgctgatgatagtaagctgatcgctaactccgaaatctggcagtatatccgcgctaaccgttggcgtttctacactacagaattaactggcctgttcggttatgttcgtaagcaagccgcaaaatatggtgtgaaaggttctcgcctggctgcactgcgcgaagttgtcgatgtactgaaagaaaccgaaacgatcggtggtattcaggaattcacgccagatatgaaacgctatacgcgtgaagtgaaagtgtctgacatcaaggatcgtttccctacaaacgagttctgccgattcgttaccgacacgacaatgaaatctggttgtcaggacttctatgaagtgctggggcgtaaattccagttcacgatcaaagccgatgaaatgcgtaagtctgtgtataaactctgggatgaatacggagaacgcgcacgacaagcagaagccaacaacgggatcgactggaaagcattaagtcacgcgttgcgcggtggtatgcagttgatccagatttacaaagatggtgatatcgtttatcctctgcctgatagcgcattcctgaaactggttaaagctggcggcgtaccgttcgcaaccgtacaggaaaaactggaagaagttatgggcgaagtcgaacgccttgcagcgatttcaacatatccgaaagaagttgatcgcgagttctggaacgatttcatcgaacgcatatacagcgatcatgttgtggggtattacaaatgatgtatcctaaattgtccggcgctgaaattgatgttctgtataaactttacggatacgcaactaaagtgctagacttagatttcaatgacgtacccagcaaatcagggcgtgattccctgattcaaaaaggttacgctcgaagagtaacgggttatcacgataattcgaaagcatggttgctgattaccccactggggattgacgcataccgacacggtattaaaacggagtggcactaatgactgatgttattttgaacgttaaagatgttgtactgggcgataccaaaaacccagacgcagttacactggaacaggctgttgttcagatcatgcgcgatagcctccgactggaagttactgaacgtaccgaaagcaattacacgggcgggattgatggtcgccagttgtacgaagatagcaaacacgttaatgtaaccctatgggcggacattgacgaaaactcatacaaaatcgacgagattgattttgacgtatgaaaataattgacctctgcgctggtgtgggcggggttcgattaggatttgataaggcgttcggcggtgtcgaatgccttttaacgtctgaaatcgacaagttcgcacagcaaacatatatcgaaaactggggcgatgataacctacagggtgatctattcgccattgatgaaaacaaagtacctgatcatgatatcctgctcgcggggttcccgtgtcaggcgttcagtaaagccggattgaaactgggctttgatgatgtacgcggtacggtgttcttcgaaatcctccgcattatacgcgctaaaaagccccgtgtgttgttctttgagaacgtgcctgaactgctaacccatgacaaggggaagacgtttaaaacgatttacgggcttctggaggccgaaggatataacgtattctatcaacgcctgaacacaaaggatttcggactaccccaaagacgggaacgcgtgtttattgtctgcttcctggatgatgtattcttttcgtttccggttcccccgcgtacccctacacgcgtaggcgacatcctcgaagatgctgatgattcgttcaccctgtcagataacgcatggaagggctttagagagcgtaaggaacgaaataaggcaaacggtaagggtttcggttatcaggccgtcacaagcgattctacgcacactgggactatcacccagcagtattacaaggacggcgttcaatgtctggtgttgcaggaaggaaagaaccccagaagacttactccccgtgagtgttttcgtttgcaagggttcccagattcatttatcataccggatagtaaaaaacaggcatatcgtcaagcgggaaattcagtttcaatacccgtgattgaagccatagcgaaacaaattaggaaagtattatgagaaatcaaccagaaatcccgatcgataccgttgttgaatggcattacaaccactgggataatgatgaatggtctgccagccagggcgtattgaagtatcataaaggaaacttcatcctgatcgaactcgaaggtaagccaaccgtgctggacggtaaagatttggtaatgcgtccgtacaaagaaagaccggaaacaaaattcttcaaaaaagtgtttgcatccagtagttgatagtggtatcttagctttaccaaaacgaaactgaaaaggaacataccatgacttttaatgacctgtttaacggatgtactggcgctggtgcgaaatttaatctactgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgcgttcgcagagtctattcgtggtgtgttcggacactgattaatcaagccccgaaaggggctttttcgtgaggaaattattatgatttacactgttgaatgtttggttgattatgaacctggtaatctgatctgcgcgtctgataccgttatggactgcatcgacgcggtgaacaatcacgaaaccttcccgtatgttgcggataatctgcatttcactgcgtggaaagacggcaagaaagttgcggttgcttctttagtaggaaacagagtaggcgatacaataggcgctaacggctatgaacctaaccctgtgacatacgaagaagtcattggtaaaatggaggcggtatgaaggttaaaaacgccgaacgctgggagaataccaacgaaatgttcttcattcgttgcaaccgtaagcctctcaaatgcgggtatgacgacatagacgaagccctgagcaagtttaacgaaatcatccgttcatccgtctaccgtagcggggaacatcctggcgacctgtgggaactggtagcaaaagatccttacagtaacatcgtcctgaaatctgaaacaaaaggtaaagtatcgtgaaaatttatactgttgaaagtttaagcgaagattactatacatttagtgatttggtcggttctaccgtatcgctggaacgtgcgattgaaatggctaaaccttttgactgggtaagtatcactgaatgcgacggctttactggagaacgtctgcgcatagtaacactgagcaacgaaaaagccattgcgaacgcaaccaaagaaaacttacaatttgaggatgtaaaatgaaaatccgttctggttttgtgagcaacagttcatcaagtagtttcatcgtccggttcccgaaagatccgactaatatcgacaacctgcgcgaaatgatgggtgattgcgttccgaactgcggttactacaatcctccgttaacagcggaagaagtggtcaatcatgttcaccgtgacttaggcggtcatctgggtaatagctttgaatcgttctacgacgataaacgctatgactgggaaaccgaagaaagcgcagaaacccgctaccgttcaaaccctcaaattgcgcttgcgtatgacgggcgagactggtacgatctggacacagaagagaaagacgctctgatcaaaatgtggttgtatgaagagtacaacacgaagtatggcaatcaggacggcgtgtttatctatgaattcacgtactccgatgaatgcggcccgatcggaactcaactggaacatggaaacatcttccgtaaccttgaacacacatcaaagagtcatcactgatggataagttaaaaaccgaagtctgtgttgttatgcctcgctatgcattaggggattcgatcccctttagccaggatcgccccgcaccgtttgatgtattttctttgcgaaaatatcttgaacgttttgaactgaacgagtatactctccaaatcgttcgggtatggaatccggtaatgtatgcgcttgcgtttgacattgcagaatccaaactcactacgatggatgaatacgttgaactcctggcgcgtaagttcgggtgtgatcgtacagtcgaagcagtaagcaataaagttaacgaaattttagaaaaattcaaatacgagaaaatttaaatgtcaataacaaatatcgaattcaaaaacgctgtatcgaagccaaccccgacaaaccacgttttcgtgtgtgacgtatccggttcaatgtataacgaactgcctaagatccgtaaacacctgaaagcaaatctggcgagtctggttaaacaggatgacaccgtttcgatcctgtacttctccagcaaaggcgattacggcacggtgttccgtggtgagaaggttagcaatgtctctgacctgtctaacatctgcgcggctatcgaccgttacctgaaacctactggttgtactggcttcgttgagccgttgaatctggctgcggaaatcgctaccgatctgcaatccgaaaacggcaacctgaacagcctgatcttcctgacagacggttatgataactgctggcgtaccgatgacatcctgaaagcgtgtgcggttctgccactgactttcaacagtatcgcgttcctggaatacggttattacgtgaatcgtcctctgctggaaaaaatggcagaagcaaccaacgcattacacaaattcgttgaaggtttcgacgcatacgaaccagcatttgccgaaatcatcactgcgcaaacttctgcacgtatcgaagtcaaagttgctgacgctacccatgcgatctacctggacgaagggcgcgtgtatgtcctgaacgctgcaaacggtgttgtgctggttccagaacacatcaaaaacatctgggcgctgggtgacaacgcgatcaatgatgttgacggcttcgatccaaacatcgccagtgaacagcaagttctgtatgtcgtgctttatcatgcactacacacaatgaaccctgatctggcatggaaagtgcttcaaaagctgggtgatgtccgtctgatcaaagcgtatgacaactgctttaccaaacaggactactccaacgcaaaagacctgattgcacaggctgttgtagatccgtcacagcgttttgttgatggtattgattacaacatggttccagacgaaaacgcgttcactctggttgatgcgctcgaactgctggcacaaactgacacagtgatcgacctgtcttctgagcactgggcgtacaaccgcacaggccgtcagactgtacagaaagaagatgatacactggatcaactgtctgaacagatcgcaaacgctgcaaccccagaagaacgtaaagcactggcggcgcaaatggtagcgcatgaagtatgggttccgaagttcacccagactacaaccaaagtatcggttaaacatctggtgggtaacagttcccgtcctaacatttccatcaacacggatctggaagggtatgtgactatcccagaaagcaaacagaaagaattcggtctgccggaaaaaatcgaaactaagcaggtgcgtaacttcaccatcgttaaagatggtatcgtgaacgttaaagttctgccgctggaaaccgatattccgacactgaaaaaccttcgtgcttctggcctgactatcaagccgctcgaaaaaatcggtgatgatcgtatgtctgttctggtagactttacctctctgcctctggttaaccgtggcatgactcgcgggttaagcggtaaagagttcgtgactgataacgtgcgtctggaaatcctgaaaggccgtcagaaggttatgaagttcttccgtgacaacgcgatcggactgcgcaacgcagaagggctgaaacagcgctttggtgaggctgcgggtgaatggctgtctgaacagggtattcgtgattacgggttctctccgaaggttgagcgcacagaatcgactgatgtttacatgtcgaaagaactgaacgtgaaaatcaagggggtttcctcccttcctgctgtagcggctaccgtcgcgaagcgtgaagaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgctcgtttaagtcgcgtaatgtacggtgttgtagtagcacatgcatggttcgcggatctggacttcgaagaaaccaaagtttctatcgctgcgaaagatattcttccgaaagaagataatattccgtccgatttctggaaagtctgggaaaccacatcattcgaatgtgaaattgtcctggaagaaaaagaagtcaaaatctaacaatgtccgcccccgaaagggggcatattgaggaaaatactatgtcacgtaacgtattctggggtgaagttgtaaaaggcgatatcctgtacctgtccgaaccacaagcctatcgtgaaaacaacgaaaagaaccacgcatacgcgcctatgctgccggatttcgtggttgttgatgatgtatttgtcggtgaaaatggctggcagatcgatttagtcgggttcccttacaaaaagggtgcaatccttctcgaactggaagaccataatttcttcgcccatgttggcaatatcggagatcatggtgaattcggtatcgaagatatccgcgaaaacccgtatgtattcagcaactactacaaggtcggcggacacctgcgcagtgataacaaaactgttctgtatctggatggtcttctgtctggaatgcataatttcagcatcgagaagccaggcaacagcgcagaactctaccgcctgtttgagaagtacaatcatcaagatggtaaactgttgccgtcagaaatggcttacattgtcaaccgtctgatcatgggactacacaaaacattcctgattcactttgacggtgatgtacaacaggcgatggaaactgtgatcaccatcctgaaagaaaaatcacgctgcatggataccctgtcaaaatgactctattctttatcattgcattgggtgtgtttattctgggcgctgcgatttcattcatggcgttcgataagcgcgaatatcaaatggttgtcattggccttatcgtggcaagtatcccgctggtgttgtcatacaacctgtatcatgagaaaatcgcggagaacgcgaaatatgaggcaagacgatgaagattcgttctgggttcgtgagcaatagctcaagcagtagtttcattatcgggataggacttgtccgccctggtaaagaacaggaagttgcaaagatttacggtgagtcaaacgttgaatctctgatggatatgtttgatgatactcgtcctcgctgggatttacctcaaatacacgatgacggcacaatcacactggaagcgttcggatgtaatagcgtagaaataacccgcatctgggacaagttgaaagaactgaatctggatgatgttaaaatcgttcacttcaatgagtgcggcgacgaaccggaatacgacgaggaaaccggaagttataactatgactggtatgacgacgcggacgcattcgggccggaactcgaaaagaaatacaatctcctgagagataaccgcgaactgttcattgaaggtgatgttcgttgcggtggtggttatgacggctaaacgattggtgatctgttatcgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaactggaaagcgaattcagtgatgaagctggggaaatggctgctgtagcgggtgaatctgaaatgcttacagctaccgaaagcatggatgatgcatttgatcgcatcaagaaacaccagaaagaaaacgaaggtcgggatattcagtacatgctatcgttctggctggatggtgaaatcttctgtcatgctgctattgctgaggatactccggtcgatatgtgtcgtgaagaaatcgtgaagtacgtcaaatcttttatgcattaattaaatgagaattgaaaaatggcttatgtatctaaaaaaattgaaataatttcgtcgatgatgggtaaaactctggaagagatcgaccggattgggaagaactttaaagatgaagttttccgtttgcctgaacgtgaaataaatttaatcccgtatttcaacacggttaaaattctgatcgatcctagttttggtctaacggcaactcattacattgtcggtaatgctccatatatgttcgtgttcagaaaatctaagttgattgcgtatttcgatcgcgcgaatcttggacatgttcgggcaatcatcgaccggatcgaccgttatgaagtagggaattacacggaacaaaccagacgcactacatacggaaagattacgagtatgctggaacaaaccaaacaattcgacggagccaacatcgaattgattgatgatctgctaaaaaggatcaacaagttcaaagaagcgtttgacgtaaagaaaaccgcgcttgctgaaccagaaacggtgaaagcgccaaccctggcatctttcgaagaaccagaaaccattccagtaaacacagcgttgaaatacatcatcgaaatcgaaccaaccgatcttgatgcaacatgtaaagcattgaattctatagggattaatttcactctctataataaattcagttaatccaaaaaagcccttgcgttcgcgtgagggctttgttatattacacatatcgaaacggaacagccaaaaggaacgagaacatgaaagctaaaatggtgaagttcgtaaaagactggagaaaaggcgcagtaatcggtgagagctacgtaatcgtagacatcgaaagcaacctgctcgaaggtgcgaacgttttagaagttcctcgttacggtatggttgaagccgctgataaagcaaaagaactgaacggttacgttctccacatcatcgaagcaatcgagaaggaattagcatgaacagcgtttatctgattgaagaaaccattatccagccaaacggcggagtgtatgaaaagaatatcgtgtgtgctgccctggatgaacaagaggcagatcacaaagtgaaatatttaaatgaaaatgctgttgtatgtcagacgtattccggttatagtgttgcatatgcttggaaagcggttagtttagaaacccaaccatcttggttaatcaacctgaaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcgggggtcgtgaagtcgaatgtggtaatttcatgcaagcacttgcgcagttcattgatactgcgatcactcagattgaaaaacagggctgcatcgaacgccgttacgcgaacaagatcggaatgattgaatattccaacttctgcttcgaagtcgaagaagtgcgttacgacactatggacgaagtatatgaatatgtgcttcgtggtgaggaagtgattaagtcctacaacgggacgaaggttatcaataaccgctctttcatcaccccgttcgaattgcgatatcaacagctaatgggctggatcgtgatggaataagaaaagcccctttcggggctttttgttatgaggatgatagctggagtttgattctttctacttcttccggttcatcaatgatgctgtagtaaatcgtcacggtgattgcgttttcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggttacgtcattgttccagtcttttgttaagttgggatcgatatcgctatacagtaagcgaaggttaacacccattttatccaaccacctttagaaacgcctctaagcctctcagtgcaacgatatgctcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcgggtaactcttcctttccggtgcggtgtggttcgactgaaatcttgatctcattgccgtacagcttttcttcgtattcatccaccatgatatgatgacgattgagcacaaacttaatcagttccccgcattcagggcatttgatttggagatctacagtctctttgttgatactgtcgaacagagccataatgtaaacataatcgcgctgatgcttgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagcaatgcaacgtaaattgaacgttccatcgggcttccattcattataggttcaatctgtacggtattcttatttaacaaatagttggttttgaagaactcattcagttctgatttgttgaacaggattttgtacagtgtcaataagtcgctgaactcaatatcacgcacggtaacatgacaggacttgcgtaacagtttaacgatattttccatatcttcaatagacaccagatccaggatcgcgttctttgtatcctcgtctaatgcattccattcgtatctttcgccgtcctgcttgacatactggatacattcaaggaataattgttcactgttgttacgatgtttcgggaatttgaatcccagagtaagcgaatcatcaagggcatattcattttgcaaaacgtaatcagttacatgcatgaatgcttctgattgtccgctgcttcctttgattcggatctttattgcgttcttaccgaacgatacacaatacaccttagtgaaaatgttttcctgttcggtgcgggaataacccggatacagaatatctaaaatttcatccagcatttcttgctgttctgtgagcgtcttcccttccatgtccgcgcttgtgagtaagaaactcaactgatcgcgcacggtaaacatagggaatcgcttcactccaccagggagttttacgcggattatatcaatcattttaacctcaaaaggggctttcgccccttattgtcctgtaaccacaccacgaacggcaattgctgtaccttcgataagtgattgtttgaatccgtcccaaccttctttatctgcttcaacaagccagcctgttttataagcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgagacatcatcacgaatagctgataaccattcgttgaatactttcaggttacgcgcttctgaatccacacggaacgttagcgataattcaccattctccggtcgggtgaatcggatctggggtacaccgccattatacacgtattcataacccagtgttttaccaggcaactgaacaccaacgatgctcaaccccatattatacatcattttgtcacggaattctgttagcatctgtccgtaaacactatcaccaaacagggaagtaattaaacgagggcttaacgcccccatgattttactgaaacctgttttgttcagggacataatagctttatcaaccgtatagctgaatagcttgcttacgccccctgtaatagcgttcatgaactcgttcgggttattcgcgttaatggaactcatagtaccatctattaaagtatcgcggatactcccgatcgtgctgtcgagaatgcgtgatgctggactggttgcgaatacaacactaaacaagttgcttcgctgaaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccgaacgtggaatgagggaaccgcaaactgtcgcctgtctggaagtcacgaataaaccacacaggaggcgatttaataacttcaacgttcgatacgaagtcaacaatctgatccccgatgctgccgttgaaatcgcttgctgtcgtctggtttgttgatggtgcaaaaacgtttgcaaccttcgaagcgctggaattatacgcttgtttaaccagtccggctaattctgctggagtaccgcccgaagtagtaccataacccagcaccgtgaacaggtaatagattttaatcagttccagcaggtcataacggctttcgataacgaatgtattgtaatacatctttgtgcgcttatcagagccttgaaacgctgctttagtaccgatgtcgattgcttccctacggtctgccagaataccaccagaaacggattctacagcgccccagataacgtttgataccgcacgggataaacctttagcaacaatactatcggttgcatcctgataacggtgtgagttcacttcgttatcgttcaggcttcgcggtaaaagtatttgacaaatggggttaagtgtacccatagtacgggtattcaaaacctgtttgtatcgaacgttcccagtgttagcactaaggatctgttgcgcgttctgtgctgcctgacgtaatgagcggtagttgtctttactgcctggtgcaagtccacccgtgaaatcatatgctgtgaacagcaagccgttattatacaggcttgatgcattataagcgttatcaatacctgctgcacgttgggaaggaaattccgctgttacgatcggttgagtcaacgcgtttttagttgttgcagcacccccagaggggatgccagcatttttgatttcagcaaatgattgtacagtgtcttgcaatactgtaattttcatttaaatttcctttaagctaatgcaatcaatggtttacggtcagttcgttgtactgaatgctgaaccgtgttgtttactgttttgttgttgacctgaacgctgttaggcgttgtaggctgaacaggtgatttcacaggttccggttgcttgtcaatacttgcactgctttccggtactgcggcgatcttgttctgccactggtcaagcattgagcggaatcgttcgctatcgtcttcgtcaagtttcttggagttgtttttctcttcgagtgattcaagaattttctccattgctttcttgtcttcgttggtgatattttctttatcaagaatctgatcaccacgatcgaaatcattttccgctttcggcttctcagccttttgtgctgcttcgatctgtttggtttcgtccacgcgcttacggttagcggtattctctttatcaacctcagcttttaacagtgcggggttttcctgcaatgctttcagttctttcttcttctcttcggtgatcttttcttcgatagccacacgatcgcgcatctgttccaattgcttagacaatgctttctgtgcgtctgtttgttgtccgaaactatatgagaatgcgccctgggtagccttaacctgttcgacaaccttagaacgtgcctcaaccactttatcattctgatcctggatctcctgctgtttcagcagaatcagatcatcgggatcaatttcaagaccgtatttttgtttgtcgcgcagtgctgatactttcattccgcgtccggcgttggtaatcgtttcagatccggtatattcacccagagcgtaaatcagattaccgataccttccgtgattgcggttttgatggtatcgcccagaaccttaaacggttcaaggaacaagtttttcagcgattcgcccaaattactcatatcgaagttttgcagaccttcgttgattttctcagcaagggttttgatattcccgaagtatgaaccaaacaaatctttcgaggcttcaccctctgcaagaatatcctggaaccacttctgaacaaccttactcagtacgtcgatcgcaaatacgatactaccgataatcagagtccattttgcaaacttcgccagcgcttcgagagaataaccgataaagcgagccagaagaccggatgtattatccttgattgcacccagcaaagacaatactttcttgctgaatttcttctcgtctttatccttatcgcggatcttcttcttgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgctggcccaacaaaatcgggcaactgttcagcaagtggttgctgatcctgttcgtattgttcctggaagccagcgaatttctctttgaaacgatcctcaaaggatttcacactgtctttgatgtccagtgtattcagcgcggtttcaagggtgttatcattgatatcctttaactcacgcattgaatctttatctaacgttgcctggatcttacgaacagtcggttgcgcctgtggttttggtggattctgcatccggcgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttgttgaagaccaatcgaaggttatcaaaagtatgttcatacttagcttcgctgattttcatatcatccagattaataccgatctctttcagtatcgccattgccttatcgtcattatgataatgcaggtgaatcaaaaggaattcggtttctgctgcggttaattcgcgcggttgaatctctttgatgatatactcaagcaactgcattgggtctttcattgctttaatctgggtgaaatgacgataacccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcgtcgtgtcggttaaattatatccaacatatgaaaagttcgctgataacgtctatcttgaattgttacctgcccttgtctcaatgagtgagaaaaccatcattaacggtacttctgaaacattgatgcagatctatgataaccagttaatctatcagttgacagaaaaaccgattattcaggtatccttccagtataacgaaacgttagaacagcattactacggtgttctgtattcaaacgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataacgatatgaagttgatcacgccgcatatcgacgcatcaaacgtgcgtattcctccggcttgcctgagcgggacgtatgaaaccgtgtttgattacatccgtgacaacgggcagagcgtagattcgtctgacttctgttatctgtgggaagatggttccggtatctttatgaaaagcaatacggagatcctcgcacaaaccccgttaaaggcttacaagttcaacgtaagtaacccgtttttaggtgacgctttggtattcacgaaaggtgaatacattacccataaggataacactaccctgttaggggatgcaagtttctttagtttctcgatgacggataaaaaactgtatagtgatatccttgcgagtaccgatattgaaaacgcatggatcaccatgaacagaaacgcggtatatgagaacaacttccagaacccagacaaacagggtcaaccgttccaggctgtgaagtgtcagacgttatccagctatgaaaaacgtattcggtttgatatcaatcagggtcgaatggatgttaaagtgggggcattgattgaggtgttaggggatgaatattcagggaagtatctgatcgttgaatgtatccgcgatgtatcaaaagatttccacctgcaaacattggaatgtgtacaggtggcagcggctacgaatgacaccagcaaaaccagtgaggcttaggccgtagtttcttcatgatagcccatgaacaggtcgaacacgttgttcttgttctgtttacgggctttcttgatattctcgtagttctcgcgaggcatatcgatcatgaagcacttctgacgcgctgtagcgttctctgtgagcgcgaacagttcatcttcggtgtaatccttgtttttgtccagatcgagaatgacgcattgccaggtgtcttcatcactggtttgctgcatcatcaccagcgcggcgtttttgaaccccagattatgagcaagcatttcatgaacgaattcgcgatcgtcgtcttcataacggatttcttgcccttcccaacggatcaggcggatagttttacttggttctgatttcataatttattcctgctcatgatttcacgcaaacgcttcgtcggttctggtggattcttaatgatttcctgaatctgattccagacttcttccgaaacttctttcctttccatgataacattattcgggttatcacagcattttccaaccataacacaacgcccacaattaaggcagattgtgtccggtatcgttggagcattatcaaggaagcgaccgaaatcaatatctttcagcgcttccgcaacccgtgcttcaacggcttctttactcatatcaaccatttttcgcctcgttcatccaatcgcggaatttccacaatttgttctgtgctgcgatgtagctttcttcacggaaattagaagcgcaatagatcagagtcgggaactgaacttcgttattgcttggcttctcgtcaaacacatacacctgaatgttgttgcgagttaaacgcggtgcgttcatgccagcaatcagagccagaaaatccgctttcttagttaagtgagccattgacataatcttttcctctttccgtgttgtttcgatgtgggtaatgtatcactacactacccaggaagcaagcattattttcatttttcttctttgaagcaaagttctacttcaacgttgactaaacagattgcgatatcccatgaatctgcaactgggtcatatactgctttgtcttcgtctgcaacaggcagagcaacaacccaaccatcaacaacacgtttaacccgaagtctttcgaataatgctaccgcttcgcccaaagactcaccaccattcgccagcttttcaaaacgcgcacggtctgccaggttgattactttgccttcgagttctttagtgatttgcatgggatgttccttttgtctgtttcgtttcgatgtgtgtaatatacaaaaagcccctcacatatgcaaggggcttctttagcaaaaagtgctatttaaaacagatcagcgaagataacgtgaatgtcatccggttcggtcttatcgcgtcgaatcttcttgatgattggcaggaagaaactgaactcaggttcgcccttcttacgcgttttcgatttctggagtccgtcaacttccatttcgacgatagcgccgatatagtcatctttgttcgccataatgtattcgcgatccagttcaccacgttcttctaacgggatgtacacgcggttaataccgtcttcatcgtatcggtagtccgtatcagtcagaccggaacctgtgttcgttctggcttctcctgataagtcctcaaccacaaacccgccaaccttatgaggttctttggtgtgttcgtacacgtcgatgattcgcagttcgatcggggttttgttcttcaacttcacctgatccgcaacgcgtgaatccttccatttgaaatcaacgtttttcaggattgaaccctctttaccgtcattgcggtaattgttgtaatcctttttcgcttccgcatagttctgcaccaggatagaagggatcagcttgaccgatgttacaccagagccagccagcgcaccttccaggatagagaaacgatcgcaatatggttgaacactcggagcatcgccatagtatacttcatacggtacgatatcccagacaacataaacgatattgcgctgttcttcgtcgctgatagtacctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaacgctgtttgaaggaacgacagcagttttttcagcagggacataaatcagttctccatcaagtacaacatcataacccagatattcacgaatctttttcagatccttgtccagattcaccaaaccttcatactcatttcccgcgcgggttgctttgcggatctgattctctaacagatcggacatacaacgcgcaccatcggctttaagctgcgagtaagcagggaagcgaatacgttttaaggctttctcgctaaacggcgtagcgaggcactgaggctgttctggaatgagtttcttccatacgcggttcggtaacgttgtacccgcaccacattccagatcgcggttaatgatacggcgaagaacttcgcgatcattctcgttcactgatgatacgatatccagcaaacgatcacgggctgcgttgcccgtatattttcgcgttgccaaatcagacatcaaatccgcgatagcattcgatagcggggttgtgcctggcttaccgtccacctgcgggaacttcttaatgtgaaacataatctgtttcgtgtacgtaatgcggaaaatctcttttagcagatcattacctgcattacgtttcaggatcgcttccttctctgaaattttcagagtcgaagcgagttcatttagaatctgtaagatcatttaagtacctttcattatgtgtaaaggaaacgagtgctttggccttatatgcttcacttgcttcctcggcagaatcataaaatcctaaccacttagtcactccatgtaaagtgattttggcgctatatttttgcgatttcttgttgaatgacacgcccttaaacccaacggtattatttttattccgtgtgcggttttgttgatttgttacctgattggactcccttagattagaaatcatatcaccgcattcaacaccgtgaacatggtcaaccatcactggaagataaccattaacgtaataaaatatcacccgtgaccggatgtacatcgcattttcgaattttattcgcgtatatccacttgatttatgaaaagaacctgcttcacttccagcaggaattttattacttctcttttccaaccagaaacattttccggtttctggttctactcgaatacattgtagtaggttttctataccttgcgtttcttcatcaagagttctcaattgctttttcaatttcatgccagttattcactttagtatgaggtacactcggttcactacgttcgccacgcaacatatggaataacggcaactgactgatgacgttatgacactcattcaagtttactgcaaggtcatcaatgaaacatactaaacgatcgccatattttgctttggcttccaggtaacgatgtactttcgtttcgccgtgaccgacaacacaaacctctttgaatgcagaagggaacagcgtgttcaggtttgcaatacggttaaggcttgccgtaggagtggttcccagcgccgtgacagccacgaaatcatatttgactttcagacggttgatcacaattaacgcatcgtcatacgcgcttagatagcgaataaacgaactgttgttgtattcttccatgagaattttcgccagttggtgatcacacccaaagatttcagtcatatcacggaacttttcatccgtaaccatatccagcgcgatatcggtcggcatgttgtgtttagacaaaaagaacgggaggccgctttgccattttacggcgatcccgtcaatgtcggtaagaataactggtttcaagatataacctcataacggtcgaagaaaagggaacttttaaacgcttgtatatcagcgaggaattgatcacgctcgaatgtacgatagtaatcaaattcgatgcacaacatatcatcgtttgttacaccaatgccaacgacatcttgatgatatttctttgcctgttgcagaacgaaaggatcgagatccgaacagtcgaaataaattacgtaactcattatcaacccttgtacatataaacagcgtcgaagcctggaacatccatttcgactttatcgaacacaatatctttcagcttacatttttcaacgtagctgttgatcacgttcatgttgtttgcgccgatggtaacgtaatacacacccgctttgtagataacacccataatcagggtagaactcaaagcgccctgtgcgtggagtaatgccaacgggttaatcgcgcctttgaacaggaacgcgcattctactctttcatcataatctttcataatatctctcagtcaaaaaatagtgcgaatacgaaccacaccccgaagaaaggccagaatagcacaatcaacggaaaaatggtatgttttaaaatccgtgttgctggtgtgtgataaccgttatgactaacaccaaaacaccaggaaaaccttgcagcacagaataaaccaacagcaaggtataacaggataccgaccacaatcaagaaaatcataacagatcccttaatctggttaagttgcgtacaaactcacgttcagtgagtaccgtttcattcatcttattctttcccattgaatgagtcaaggtactttttccggttgcagccagcgcacggcggaaaccgtcattcaggaaaagagcattgtacgcgttttcaatcaggatttgatacgcttctgattcacggtgaatcggcatacccttccagtatagggtatgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtaaacggatgcggggcgaagttgctcaatgcgcatgatgggtatgaatcaccactaccaatattcataataactctcttaacgtatggtctacatagaaattcattgattacatcaatctcttcggagattgttctttctgttttccccgtataccttcatacaccgactcgattaaaagatctttttcgaatgaccgtaacattatgaacaccacccgccccgcaagtgctggttttcagagtttcggctttacgcgcacccagaaccagagttttaacaggagtcacaggagcagcgataaccacaacagcagcccaacgtgcgccaacagctttatcagtacccaggtcgattacagcagaggtatttttaccagcagccagaacatacgcacgggcttcacgacgagtgttgaagcaaaccagttctttcatgttgtaagttttcataatgtcatcctcaaagttaagttgtcttgcctacgtggttaaagatacaagaaagcctgattcagtgcaagcattattttgcataaaaacgaaaaaagccgctacctttcggcaacggcttgatttttaatacttttcgtcaggctggaacaccgcacgacacgcccacatagaggcttctttcagtcggtctttcgccagttggatttgatggacacgttcaagcatcgcatcgagttcttctgtggtgaatgaatcggtatctgataccgcgtaatcgcttgaatactcttcatccagttctttgaagatttcgcccagggcaatttcagcggccttgatgcggtttactttgtcgatcttttctttcgagtggggcttatagccctgtacgtcttcaatcgccattatatactctctgtaaaggttcgggcgataacgtcgcgctgttgttcaggagtcagtgaattgaaacgcactgcatagccggacacacggatcgttaactgcgggtatttttctggatgcttcacagcgtcttccagagtttcacggcgcaacacgtttacgtttaagtgttgtccaccttccactttaacagtgggttgaaattcaatatcgacttcacgttttgcgaatggagcaacgcgagctttaccgatcactgaatccatttcgagggttttggataccaacacacgaacatcattaccttcttccaggtagattgtaccagtgtgtaaaccttctaaaatctgatatgctttcattgtattacctttctacgacataataacgtaacgggttgatatggaacgccagcattgcacgatccagcccgttagggtcagttacttcctgtttcagtttccacccgcaatacacgcgtaagcagaactgaacctttccgactttaagccacggtttgaagacataaagcccccatgccgaatcattccacatcaacagataaccgtgacgtgatggatcggaaccaccttctgttttcgggttgcccttccaggcgaagtctgattgtgcttcacgccctaagacgtgataagcgaagttgtacgccttgttacgccacaaccagcctacacgttgcgcatacacacccagatcgcctaagtgataccggatgttagcccaacgccggatatgtccaccatcaccatcgatcgggttatcgaatgtttccatccaacggaaccctttaggtaagtgtccggtttcttcactgtagaacggaaccacaaaaggagccagcagaatagccagaacacccgaaagaatatccaggggaaccagtacaagccagcttgcgtatttcaaaaagcgcatatgcttctccagaaaaaaggctatccgaagatagcctgttgattaacgaactgcgttgatatacttatacgcttctgcgaattcttcttccagagcttcatttgtgaacggaatatcgttcgatttgaagccaccgctgataagatactggataataaacacagcagtatcaatagaaatcaactggtgatttgttggttcgatgtcagtacggcgaaccacgtttacgatcgaccagtcaaagaatatacaatgacattctttcttgctgttcgcctgtggtgatgcaaagaacccattcacagaatacgcttccagtgcattacggaacatattttcgaaatcatcaatttctttggtaaacattttcatcaatttaccgttgatttctttttcagttggcgtagcaacgatttcgcgaatctgtggggttaattcaaacagcttttgaagacctttcatatttttctcttttaaatttcatacgcggagtcgatgcaagattgttcaagattaccaggtgaatcttcaatcagtggttctgttttaccacaaacatctgatgcatacggatcatcatcaacataacattcattgaattttaattttctgcggtaatcatctttatgtaactgcattttccattctctgaatgtcatcccatatctttctcgaaattgaactggcgtcatattcttgaagatattgattgtttttcctgttgatggatcgtatttggtattttcacgaaattgcatatagacctcattaaatttatgggctggaagtttctttacttcaccccgcattccggggaacctattaccggataccaacagagcctatcgcatacgataaggttgcatattccgaaccatttaacggcattgcgctacgcacccgaattggagcaggtgaagggactcgaaccctcaacaatctggatggaaaccagatattctaccaattgaactacacctgcgaattttttagaactgcttgcgataaatttcgcgaaccagcgggtcaacatctttcgcgtatttacatacgtcttcgaactggacgatgtacgccatgacttcatcggcacgggatttcagtttaccctgatgcgcgtcaatgatcattgctgccattacgtcaatacgcgcgggggcttccagaatttcgcctttgtcgaacagttttttggacttgctgacagtatcagcgataattgcttgaattgatttagccattttagatctcgtagattgcctggattgctttgtaatgtgcggaaacgtattttgtttccttctcttttgcttctttttcggaaatgtaacccgcaaccagatcagggtcaggaacattcgccatgtgagcgcttggcagtgggatatatttacccatgattcgttctgccgcttctgctggaacgtctacgcctacagaaacaactttaccataaaaaggttgttccccgtgctggcgtacaccaaccacgataccagattcagatttgatttcggaaccctgcggacgcgcagtagcttcgatgatcacatattcgccggatgcttttactttcagttcagacatttctttactcattgttgttaaacactactttggaaaagtcgataaacgattctaactcttcccgtttaatttgttccacgacacagccatatttttgcaagcgtgaaatccattcatcattaccacgatcgtatttatcgagataatacaccgatgtaatcgccccgctagcaacataccattcgatatgtttcgcgcagttagggcaaggcgatgtagttgtgtaaagtgctgcgtctttgagtataacacctcttgtgtgcgcactcaatagcgctttcatttctgcatgaatttcgttatcgtttgaccatgctgaatgttcaggacgatcaaccgctttcagtttaccgtcatcattcaccatatgattgttgcatgagttgcaacgacaatcaaggtcaaccgtattattttcgccccacgcgacgacacgaccaccaatcgcgataatagcacctacacgattcgaaatacattgagaacgttgactccgatcgattgctctcaacatattcattactttgaatttcattaacggtcatccatatatttcagaatgtctttgatgaaatcgttatcagggttgacgatgtgatacgtagtacctgaacgtgtcaccacttcaacaaacgatttgttcgccggaatcgcgtattcaacaaccggacttgttgcaatgtcctgttgaggatcgttatcaaccaacccaaacacacaaccataacgaagcatcgttggttcagtacagaaccatgcctgatggatctttctgattttgtcactcataatactgccgcccatgttacgaatttagttaccggattccactgaatcccgaactgctgttcaacgatgttacgttgactcagaatacccagaaggaaggagaactgaccatcgcggacaatcttcactgtataaccagcaggaattttatcagcaatgcgctggcctaactggttgagtttcagttgtagttcaacaggattctcaactttaacacgatcacccagttcaaccatcacattttcattttcacgaataaccataatattctcctttgtttgtgcgggtatcttatcacacccgcacccactgtcaactgttttttagaagtcgccgtaatcaacctggaaacacgggataccgttcattcgccacatcccgactggtgtatccctgtcgtccactgcaagaacaggataatacttatcgagaatcttttcaacaagtatttgctcttttacgtggaaatcgtgacgatgatcaccttcttctcgcatgtagataccatcgctcaggtcaacatcgtatccgatcaggcttgcagcggtatcatgtgcgcactgtgcagtaccctcacgcccagacacaacaacacaggcataaccagcggccttatacatcctgaacagttcttgaacaggagggttaggcggatcgttgatcacctttgtgaagtcatacgggctgcgttgtccaactttggtcagtgtcccgtcaacgtcgaagataacacatttcggcttgctcggatctgcatagctcatagccggaacccagccacggagtttacggtactgttcgaacatcgcccagacacgggaaacaggtagagcattcacaccgcgtttatggttgcgtttcaggagttctacgatatcggcatcaatccattcgatatggaaatcagcattgaactctttcgcgatctctcgccacacatcatgatctttttggtgtaaatgggtattgtgaacgataacgttcttcccactcgccagggcattacgaactgtatcttcttgcacacggcaaacaaacagttctttctcttcggtgaagcgatagccagtgagatcaccgccagcacagtaaagggttttgcggatatcgtcacgggaaacagtcagcgtgttccccagttgacgtgctttttctttcgcccatgtagttttcccgctacctggtacacctacagtaataaacagattcattacacaatctcatattcaatcagttctttgttatgctcattcgttagattgagccacatatcacggttccagtcattttcgatccagagaccttctttgtccttcttcgcatcataaacctttccttcggttatgtcacggaaaaatgacttgattattttgacttgcatttctcagggtatcccacggtacacagaatgttatccgtctggtctttctgacgcttaacgtcattcatccagctacggaagattaacgaatcgggatatgaaagggcaacgtatgggtttccgtcataaggcatgacaaggtattttttaccgtcaatctctcggacttctgcaaccactttccatttcacattaaccggattcaccttagcggggagtgtaggcaaaatcttttctggcggcttctccgcgcacccaaccaacagaacgcccagaacaagggctaacgttgcaattttcatttgtcgtactccgccatatactcttcgaaggacttgttgatcttgatttcgatcagtcctggttttttaaacagcagatctttacgtccggcatccttgaccaactgctgatccttacctttttgttcgacatagatcaccgtattggtgttgtttgtctctttgacttttttgatatcagcctgtaactctttgatatctttagccaattggtcattttcacttttcagtgtgattgtcatgtacaaaagccctgccaaagacagggctacaatgacaggccacaccaaagaagttaactttggaaaggctggtaatgtcatttatattcttccggtataaactgttcgtagttcttcgccattaatgcaacgatgttatcgaccagcttttgcttatcggtatcatcgaaataacgcatcataggcccgaagatgatacgaccgtcaggggttaagtcagcgctcagggcgatcgcgtagtctttgcgtgatttgcctttcgtgtcttcgattgcctggaatgcttttgcagtcagacgattgagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcggtgaaggtttacataccagttggttttcgctttcacaaaacctttatcagttttgatcacgtaaccctcgaaaccttctttcgtgtaggcttcggtaatgaacgcatccagatcggtgatttcgattttctcgcgctcaaccaggaacggacgtaatacaccatctgcgaagatatcctgataatcgacatattcgcccgtgtcgttattacggatgttcaggatcaccactgctggttcctgatagccaattacaatacggtttgtcggtgcgacgtattccatgttgactgtgaaaccatcgttaaccagttcggtcaggcgatcgaacaatgcgcggttagtctggatcacgctcatagcgtccatagcctgttcagattgaacggatgctttagacttaacacccagatagccggaatcacagaaggtggagatcagggaaccatcttccttaatcatcacatccactacggtttcaccaatcgtcacaggagaggctttcagtgcttcccatgcctttacctcagcatagttgaaaaacttctccatagggcgactggcgagttttacgggggtatccccatccattacaaacatgatgccgcgacattccagcgcaccaggttttaaccagtcggaatagctcgccatgcgatagttaaagatgcgaacattggtttgcatcacagttttttgatcaatgaagtagaagcattcgctttcgttacacagtttcatcaactggttgaataaggttttctgatttttggttagatttgtcatagtgctgtttgttccattcaggattgatttttcggatcatgtttatttcaaaatcatgatatgtgtcttcatcgtgtgttgtcacgataagatttacacgcttacgttttttgattgccatttccagacgtgcggttttcaaaatgttactggggtttgcttcccgccagtatttcgaattgcggtatgtgtctaaccgcttccacaaatcacgacattttccaacatacactatccgaccgtcgatttcaataaaatacacacaatgccggaattcgccacatttaacaaaactccgatctatccttttgtctgaacccagacgcaaaggaaatattacaccaaacgttacatcgtccattatatatccaacttattcacctttccggtcaacacattgacgcagtgagcaatataatcaccgtgacacggtaagggtttgcaactacagcctaaccgcttcccgtccagttctttcagttcgtcgattgtgatcacgccagttcgaatcaagttttggaaatacgggatgaagttaagaatgttttcaccccgtgttcccttgtaaaagggattgccgaacttcgtacctctttgaatatcgacatcccaatcacttttatacttgtttacgacgcgacaatcaagcgtatttttgtcgccattttgcataggcttcgtcgctgatctcagtgttgaggttgccaaccaggtaagaacttacttcaacctcttgcggggctacctgtacgttgtcagacttcaaccatttgttcatccacggatacgggttcggcgttggtttaaatggagactgcaagccaaccgcgcgcatacgctgatccgtcaggtgttcaatataggcgatcgtacttttcagggatacgccgtctacatcaccgatagagaacaggtgttcagcccattctttttcctgttcgtacacttccaggaaaatttgtgtcgcttcctcttcgtactggtaagcgatttccgccatttctgggtcatctttacccatctgccagagtcggatcttgctttgagtgcctttctggtgaagtgcttcatcacgggcaatcagacgcatgatcttcgcgttaccttccatcttgccttgttcggcaaagttgaatgtgaaggtaaacgacacgtagaagcggatcgcttccagagcgttgacagcgtgcatacacaggtacagagcaaccttacatttacgcatttgctctttgcgtttcttctcgtactctgcgatcgattcgtctgggtatccgtgggacgttaacatttcgattttgagcacaatatttttcagttcatgacattctgcgatcagatcatcgtagtattttgtcatggaagcagaacgtttcatgatcgcttcgttgcgcagaattttatcgaactctttcgacgggtcgatgtgtaaattgcgctgaatgtgtgtatagctgcggctatgaattgtttcactgaacgcccatgtttcgatccacgtttccattgagacatcggaagcgatagggaggaacgccaggttcgggccgcgcccctgaatggtatccagcagggtttgatattgcaggtttgaatcgaaaatgattttttcgtgttccggcattttcgcgtactgcatacggtcgatagacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttataaaaagcccccgaaggggcattgaatcaaattttgcaaccttcgcaatcttccgcttcttcctcacctgcaccgtcgcgggtgttgtggtagtacagcgttttgatgccgaaatagtttgcatacagcagatcttcaaggatgatttcagatttcactttaccatctgggaagttagccggatcatagtttgtgtttgcagagatagcctgatcaacaaacttctgcataaccgctacatgagacagataacctttgtttccacgttttgccattgtccagagataatcatagaagtcaatctgattattctggtttggtactacctgattgaatgaaccttctttcgaagatttcacactcacagggccgcgtgggggttcaatcccgttggttgagttacttacctgcgagctactttcacaaggcattaaagcagaaagcgttgagttacgcaagccatgttttttgatttcaccgcgtaaccattcccaatcgcagttatacacaggtgatgccagttcatcaacgtttttgcagtaccagtcaataggcaacagcccttgtgcatatttcgtttcgtggaacagtccacatgcaccgcgttcctgtgcgagttccatagaggcaaccagcaggttaaattgaaacgcttccatcaactcatgaacgtttccggcgtatgcttcggagtagtcacaatagttgcttgccagccatgatgcatagttggtgataccgacgcccagagaacggcgctgtttggctttcagagccgctgcaacagggtagttctggtaatccaacaggttatccagtgcgcgtactgcgatgcgtgtaagggctgggaattcgcttatatcggcattatcgagaacgatcgccataagcgtacacagtccaatttcgccagccagtttatcatcgtcatccagtggtgaagttgggatcgcgatttcacagcacaggttcgacatacgaaccggaacagagaaactaccctgctggtttacgtgatgactgttgaaaatgtagttgcgtccggtctgtgcgcgttcctgaacaagcaactggaacagatctaccgctttgatgcgtttcttgcgtaccgttgggtctttttcaagactggtatacagttcttcaaactcagtctgatccgcttgatagaacgcgtcatacaggcgatcgttcgcaacgtcagggctgaacagagtgatgtaatcgttattgattaaacgcttatacatcaaatcgttaagctgtacgccataatccaggtgacgaatacggttttcttcaacgccacggttatttttcagaaccaacaggttttcaacttcaagatgccagatcggataatacagggttgctgcaccaccacgaacaccgccctgggaacaggatttaaccgccgtctgaatgtgtttccagaacgggataacgcctgtatgtactgcttcaccaccacggatttttgaacccatagcgcgaatgtgtccggcgttgacaccaataccagcacgttgagagatatacttcacgatcgcggacgtaacagcgttcagagaacccagagaatcacccgattcgattacaacacaactggagaactgacgcgtaggagtacgcacacccgccataataggcgtaggcaatgacagtttacgatccgaaatcgcgttatagaagtcaaccacatgactgattttatcagcgtgtttttcgtcctgatgcagacacatcgcgatcagcatgaatgcatactgtggtgtttcgtagatgtcgccggacgtgcgatcctgcaacagatatttcccgatcaactgctgaacgccagcatacgaaaattcaaaatctttatcgtgattgattttcgattccagataatcaatctccgctggagtccattttgccaggatttctttatcgtatttcccagcgagaaccatattagcgatgtggtcgtagaacggaatcgggtcaaactgtccgtaaacggttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgccccctttgtttatactgccatagctgcttttagcgagccgtggtgattatagtctttcaaatggatggagtcaaagaattcttgatccaaatcaagtaagctatttaccttcggcattacgagcgtcggaagtggaagcggtgcgcgttccggcttcaacaactctttcgcttgttctactgcgtttttgtagatatggacatcaccgccagtccaaaccagatcgcccacttcatacccgcaaatatcagcgataatatgcgtcaggagagcgtaggaggcgatattgaacggcaaccctaagaagacatcaactgaacgctgataccactgtagagacagtttgccgttgattacgacgaactgaaagaaacagtgacacggacgcaacgccatatcatccagatcaacagggttccaggcagaaacgatgatcccgcgatcgtctggtgtggttttcagttgttcgatgatttttgcaatctgatcgacaccagtgtaaaaaccttcttcaccaaacgagcgccattgatgcccgtagatcggccccagataaccattcgtataacccagcgctttagcctgattttcgtagttatcgtcccagatcgtccgcttatcgctatcttcgccccacgtcattttacgcagtgtttccacgttggtagaaccggacaggaaccattgtaattcatgcttacacggtttgaagaatagctgtttgctggtagtcgctgggaaaccttctgcgaggttccaacgtgcttgcatcccgaagatgcgcagtgtaccaacaccagtacgatcggttgattccgtaccgtgtgttagaacggtgttgacgatatcaagatattgtttcattttatgcctttttcgtatgtcgatcgacgataatttttctgacgcgttcgtttgattcgatctgctgaattttgaaatcagtcagttcatatttcagaaccgcttcacagaattcaggaaccgtgaacgaaacatcacgtttaaaagctggtgcattgaaagtgtgatgtccgtaaatgtgcgtcacaaccacttcgtcaaccagtgtattattgattgcttccagaagcaaccccttaccgccaatgagacacacatcacgatctggatgcgttgctttcatcacgtcgattgcagcagacaacccgccgccgtggatgacataatcagcaatatcgccttttttggttttgaggaaactaccagaaccagacagaacacaatggattcgcccttgcaatttaccaggcagagaagtaaaagtgttcgcacccatgatcaggacgctatctgcggtttctgctttgaagttctgtaaatcctctttgcagtgtccccacggtaaaccctgttcataaccgaaagcatagtccatttcgtacatatcatgaccaacggcgaaaactgcttttactttgctcatagcgcgatccacattttgttgtcttcaatagtcacgatgtagcccatagcttcaaccatgacgcgcaatttgtctttacaggcttcattgtacccgcgaatcttttcaaattcaacagaaaagatactcaatccgttaacatgagcgttaatgattttggattccagatcgaacaccatcacatctaacggactccactcaacagaatgaagtttttcgcgggttaacagggttgtgtgctttggtagtttcattggggtacagtttgccatagccattgttccattttacgtaaatcttcctctaacggagtgaaaccaaaggattcttcgatcacaccgtcttcccatacatcaatttccagaatttccgttaccggagggtttgacatcacatgatcacgacacgcagccatagcggtcataatggaatttgttactgtcagggtatttccctgaaccgatacctgaataatcatactttcacccattctttatctttagtccatgcggttttcaaggtaaaacgctggcggtaatgcatacccaaacttgggggatgcagcgaattgataccttcgacggcgatccgcattgcttcgaacttctcgcgatcaataaactgccctggtagaactggcattctcacacagtcccattcgtaagtatcgctgatctctttactggcattaaccagaatttcagcaatgtcaaaatctgtaggtgcgaaccatcccagattgataaacacgcgtttttgcgtaccttctttcaggttttcaaagtgcgcccatgttggacaactcatagtattttcctcataaaaaaaggaactgcttttcaacagttcccagtataacacagtgatttagtatttcaagcgccaaagagcgattgcttcatcaactgcttttttaatttcttccggcgtgtctttgcgtccggctttaaccagggcagagagcatagaacgaatggttgcattcatctgtgacttctcacgatccatctgtgcctgatgcgccttatcaaccgctggggcttctttcttcgctgcctgtggtttcgtaggctgtgcgcctaactcgtccttagcttgcgtttcagtgcgtttctgttcggcttctttcttcacatgaggtgcggagaatttaccagccttgaagttatcacgcataccttccaggatcttacgggctgtgtaccagtcagcaacaccacgaagttgtttcagggtatcaaccagcaaaccgatacttgcgcctttgctatcctcgtcaatgtcgatatctttcaaccattccacatgtttctgaccggagtgcatgaaatcaaagctgctgaaactccagaaacctttgcggttgctgatctcgcgtttgaagtggaaagtcaaacccgcgccgttatcaaactcaccgtagttactgcggaatgttgcccctgcttgtttcagtgcgttgaaatagtcatctttattgatgcggttaacggtgcgttttggtttctcttccggcgctggtgctgctgcttgctgtgcggtacgtttaacaaaagatgctgaacgatgccccgctgcaaactctgcgttcatccggtcgattaccgctgcgatgccgcttgcgtctggtttcactttctgcatttctttgaaagtgtcgatgatcatatccagacatgcaccgtcttcatcttccagcatagtacctttcagacgttcagcaggtttgaatttgttcacagttgggtcaacaacatactggaacacatacgcgcctttacgcatgaatacgtgacggtagaagtgaactttatattgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcacggcttgccattttgtgtttcttcgtaccaaccagaaccagagtattaactgatacgctacccagtgcggacgcgtccggcgctgctaaaccttgaccgttaggcggttgacaagagaaagagaagtcaaagaacgcatcaccagaagtgaaacgataggttgcgtgaacagtgtgaccgcgaacttcgctgattgtctgggtataggttgttggttgtccggtgaatttcgtgaaatattccgcaaattcttgcgcgttgaatttagtgctgaaatagtttttcgccagcacgaaatacgctgcaaatttttcttcccacgctttcttgtttgctgcgtgttctgcgcgaacatcactgaaagttttaccagcgctgtttgttttggttacaacgtcatacgcctggttgattttctgcatgagttcagtgctaccaccacggtcggggtgattgcgcagagaagcacgtttaaagagctttgacagttcagctttagattcgtcgccagtagcgcccaaaatcttcaatgcttcgctgtgtgacatttgttcgttaatcattttccgttcctcaaaataaaaacccgtgcaactcagtacacgggcgactttaaggtatttatgttttactgtcaatagattttttcgaggaaccacaccgaagatttattattcttgatgcgggtcaattcaatggggttatctttgaatgcttcctcaacatctgccattgtaactacatgtttttcttccaatagttcattatggagataaaacctctccacttcgggagaggtctttaaatcaaattcacgttctaacatgagatcgccatatctttgattgatggttttgtgaaccgtccaaccttagacatgatgatgtggcggtcgaagtcctgcggatcaagatcctggtgactgattacaataacgttaccatctacagaatccagcagggatttaatcgcgaatgaaccctctttatcaagtggtccatcaaacacttcatcaagtaccagcagagacagatccacgcctgatactttacttgtcacgtcacgccatgtgaacagaatagacaagttgatgcgagcgcgttcgccttgactgaatgacgcataactgaaatcatcgcgccccagtgatttgatcgattcgttgaactcgtcatctaaagtgaactgataatcagcacccaacagatccagataatatgctatctgtttgttgaagtacggaatataacgcttaacgatactcgctttaacgccggaatctttcaacatatccgtaacaataccacgaatatatttttccttgacgtagccttgtcgtttttcgttcagttctgcttcctgctgttgcaactgcttcacgggttcttcatcaatgactacttccgcgcttgcctgttccatgatcgcctgtgcgcgtttagcattggcaacttcgttttgcagagtacctttcagggcttcatatttggttttcagggcattgagtgcgcgttgctgttgcagcaagtcattcatgatcccttgtaactcgtcctgtttggttttgatcagggttaaacgttgtgtacccgctttgatgttctctgcgatctccgccatacgctcaggagtgggtttaatcgcttgcttacaggccggacactcaccgcctttctgatacatcacctccagctttttaaactgttctacagtcattgagagccgcgaataaccgtcacggagtttgttgatatcttccgtccggtcttctccagtgatcaccgattccgcaatctccgcttgcaactgcataagctgtgctttgatgttctttgcggtttctacgtggctatcgtagatctctttgtatcgggcgttgttctggttcgctttcgctcgctgttcgtcaatgaagcgctgatgtgttgcgatctgctgctggatgtgattaccctgcattgagagcgtatccaactgctgattaacaccgcgaatgtatgacttgttcagcttatccatttcactgatgacggacagagacagcaaatcttcaaccagtttccggcgttctggggttttcagttccatgaatggggtgtaacccgctgtacccagaacgataacctgtttgaagcccacaaggttgatgttcagcatagattcaagctgtgcctgataatcacctgctgcggagtcttccggcaacttctcaccgttcttccagatctcgaacaccttcggcttttgtccgcgcaccactttgtacgagtctttcccgtattcgatttccagttcaaccaggcatttctttttgttgacgctgttcaccaactgcccgacttttagatcgcggaatgacttaccgaacagggcataggttaacgcctcgatcagtgtcgatttaccgccaccgtttttccccgtgatcagggttttctttgccgtatcaaattccagttcgatcggggtgttcccgaccgacagaatattttgatacttaatttttttgaagtttagtttcatttaaaatccgttcacataattcagtgatcatttgaacaactgatgaatcaatactatatgatagagtatcgtcgtccagtgtatcaagcatgaatattgaccatgttcgtgatgaatgccatgcacccttcatgatggtcaaacaaactgcgctggtttcccctgcttcgtcggatgtggaaatgatgtgtttcattcccaacatacgcaacaggtgagaatatcggggattcgccccgaaatattcatcataacggctatgcacttgacacctccgcgtatagttcgctgatcagcttattcacttcctctttttcatcgtcggtgatctgcatgttggcgatatactcagtgataagaccacgaacggttttgatttcaaagtcggtatcgacatccgaatctgtttgaactttgtctatgatattaatttcataggcaatttcttcaattttggtttggaactttgcaagcccctgatcaatttcactgacaatcagacgcaccgcgcagttgcggaactgttcgagatcaacatctttctgtgctggatacatgatccggcgatggtgacacacagggttagcgatgaaagtcaattcaggcttgcccgtgaacacatagaatccgcgtgtttcgtcttcgtcgtttgcgctcatagtcagaggcgtaccgatataaaacacgttatcaccctcgttagcgtggtgatagtgtccagagtaaacacgatcgtacttcttcaagaaatcaggttccagcccatgatcggctttgctgttcttgtagaaatagtaaccagacagttcgaagtgtcccaaacaaaagttagctttcgattgtttgatgtagtcaaaaatacgctggctgttttcctgacaaatccacgggatcaggtcaatcgaatttccgccacctaaatcaaccgtggtcggttcgtcgatgacattaaagcattcgtattgacttagtatctcgcgtggcgcgttggggcgtattttgtccttaaattggcaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactctacgatctgtttgaataccgcatacaggttttcttcgttccaggggttatcctggcgaagtccggcatgggtatccccaattaaaacatagttcatataaacctcaaaacccccgaaggggtttatttgccgtatttttcagaagccatgatgaacaggtctttcaactgctggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgctttgttcttccgcatgaacttttgcgctttgcgtagggcttcctgttcaatgcgtgtacccttgatggagtccagttcttcttcacgaagatccagcgctgatttttggtgtacttcgtcgattacttcatgctgcacgttcatagtaagtgatctccatgatcattgtttcggcgtttattacatagtccagacgaccttctgttatctggaagtctggatctcgtacatctgtagggtcgatgataatcggaatccctaagctctgcaactctaatttcacaaggtaaggaagcagatcaatttcgtcgttagcatctgctaaaattttgttcaggtcaattttaattttcatagaaacatttccaatgttggcgattcgtccacaacctcgattttatctttgggttttttcgcggactcttcatactgattaagtttgtcatggatatcctgaatgaaagtttcatcggctatcgtggtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcgtcaaagttatgaaggccggaaatcgttgccgaaattccatcatcgatcatatccattttccagtcttcggaataacggttgaagttgtatcgacgtgccaaaccgtgagcaatgttcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatag

SEQ ID NO: 41-43 - skipped (3 entries)

SEQ ID NO: 44 - DNA, 43536 bp, Unknown
  source: /note="Description of Unknown: Mcoc3cB Bacteriophage Sequence"
cccagtctaggcgagcagatctatacctggacctgaaatttattagactcacgcgagcccctccctcaccctcaacgacgccaattgcccccataggggggtacctagcgtcaatttagggggggggcactgagttggcctgctagtgcgcaccagagggcctcagcgggcctgtgctgcgttctagggctatcgctagtgctaccctatgcctgtccttgtgcgttcactagggcgcttcctgtgcgctctcagtgcgtgctatgaggcgctagggctatccctgtgcgctccctgtgggccatagggacgtgctctgccttgcttattttgtgcctgtccagcggggccagtagtggggccatagtgggccagctagtgcgctgtagtgctgtccctagtgctatccctagtatgcactaggctatccactggctatccttagtgctttacattgcgcggattctgtgctacgctgcgcgctccccactagggcgcacatccactatcccagcgctatccctttgctcttactttcattcgaaagctattatgaaatgaagtaaccggagtaggaggggtttagggcactatatacactactactcactagtactcactagtaatgccctgtatgaccgaccgtagggagggaagcattaactacgctacactacgttccttcacttacgttacgtcactacgctacgctctatgcagtactatgcagtatggttagtagtggttagagtacccctagagctatccctagtgtggttctaagtgcagctctaagtatttgccctgcttaccctttttgctcttagtgataaaaagttgaaaatattacttgcttcttttggttcaatggggctatagttcaatcaccgggaggcgctgaggtgctgaacggagccgagccgggaggctccgccggattaaggctagatagtgtgaagggttagacactcgataaaaagagttgacaccgcgaagaacataagctagattgaatcccaaagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttccgattaactgagtaacttagatagcaagcagtaagctgatttgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccccaccgataacgtgccgcttactgtgaagcccagcaaacaagggttgagcggtgagcacagggtgaggggaaagcaaaaacaaaagggcggcagtaaacagcctagtgggtggcctgctgttaactcccaatttgggcactaattacagcctatagcatcctatggggtgctatgtggagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactgtgcgtcttgactacaaacaagctgacaagcaggaccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggcagtggcctagtagcaagcctatagcgtcctacggggcgctatgtgaatgcaactggcgtatgaggtttcatatgaaagcaatactggtctatccgggccatgaactctggcccgtgtggtgcaatcgggtatacgcagaatacaactacactgtggtcatattctctgacaaagacactaatcaggaatcccctttagaatttgtggatacctacaccgaaatggctgcccgcactgtgctggacgccgtgaatcttggcattatcaacgactggagacaactttatggttaacgtgttcaacatcattgtgaccagcgctatgctggtgctgggcaacgacgtaaacaacccggtgccctattgcacagtgcagttgcagcaaccggcggcgcaggaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtaaggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgcctgcgctttaatgtacgaggtgtagtatgaagtatgacgtgtaccgagagacctgtagcggtctgtattatctcatccctttagagggggcaattaatgagcgccgcatacttttaacctctgcgggattaatgcggagcagttaccgagcaggtgacgttatcacctctccggcttttgtgttggtgtcacgaaactgcgttcctaagagaagcctatgctaacagtagacgaaacagcgctgctatgctggcgtctgctggaaacgcagggcaagtgcggctgcacttgggaaacattcaaagaggttcctaatgaactcaagcaaatcataccggtcgagcgtagactcctccgtgttcgtaggcaggactctacggtggtgctcaccacgtaccgcgagtatacagagtctgccgcgcggcagttgcaagagcacattaagttcgatgtggttgcagcactgctacggtacggatatcgtggagcctatacaagatttagggcggctgtgcgctcgtattataagcaaagacagctcgctgcgtggtatgcgcgctgacttggcagttaacgacgaactcattgaatctattcaggagcaaattaaaatgcaagagactatcaaagaaactgtcacagcacctatcgaatggaaagtagtgttgccggaaggtgcaaacacactgccaattaaatgttcgatgtattccagcggtgattactggaccccgttccaggacttgcaaatgcaaggttctgaccaccctcacaatgagggtccgctgcaggcgcttatgggtctccgcactgtcagcgcttacacccctggcttagaggtgactataggcgggatactgcaccctgagtaccgcgaagtaatgatgactcgcggcccgttgcaaaaggtagacctgtaccggtctggaactttctacgaactcttttccccggcgcgaatcaccatcgacagcaagttctgggaacgccgccgcgacttctatgagggcgatgatgtagtggttgagcgcgtagttgctagtgtagaagagttcaccggttacaaggtgcacaagcaggccgtgcagttattcgagcgcattatgcttgcaccagaagagcggcagcgccaggagtacactggctacgattacggacgccacctccgcgatggcaacgccgctgcgctgctcatgaagttgcacggcttcgtagtgtctagattcgccgtgcctttgggctttggtttccgcaacggtgagcccatcgtgatgctggggcagccgcggatgcataaggacttcgccgcagttaatgagtaccgttgcgtagagatgcgcgtcggtaagtggctcgctaactactacggaaacggggtagacttccgcgatgctatcgaggacctcaaggctatgaacgtagaccatacaacgtacctgtgcaagaccgagcaggaatggtacgacgcctacgagaatggcccgggtagctgcatgagcgggtactcatttaagcatagccctgtgcggacgtacgccaccaccagccacgggttgccggataacgggttgcgcctattcatccagtataccggggagcttttcggggacgacttcgaagtgctggcacgagcaatcgtaaaacctgaaaccaaagagtacgtccgtgcttacggcaacgctgcggatgcaatcctgcgggggcatgggtacaccagaaacactgaatgtctcgagggggtaatgctggcacgcataccgcacccaacctgcaacggcgcagtgctgatgccatatctcgatagcagccagtgtggcgtagacgaagaaggcagtgacgcctttgtaatacgtgacgactacgagtacgaggcgcaagactcagaagggtacatctacgtcggcacagaatctgctcggtgctgctgctgcggggggcgctactccgttgatgatatgcacgaaaccgccgattatgaaatggtctgcgacggctgcgtcgaagatggggactttgtatatgtagttggccgagaagggctgcataatcgctggagctgcacttggtctgattaccacgacgcctatgtatatgacgcggacattgagcactgttcggtagagggggtagtgcatgaccaagaagaactggtgtatgcacaggaccgacaggtgcttattgagcacgcagaagaacaccctgtgcacgggttgattctcactgagtatgcagccgattgcttgggggagaagtatctgggcaacgacgatgaagacatagaggaggcagcttaatgttcttgaatccgcatgggattgatatgcagctgctcttgcagatactgcaaacgcaccggcctagctggggcagcactaagtggtttgagccgctgcttatgcaggcgctgggtagtggtatgcactacgtaaaggacaagcacgggaactacttcgtgctggtcggggactccgaacaaagtgacgtagcgtttacgtcgcacctcgacacagtggcgcgcccaaccagcgctgcaccggacgtcggctgcactaacaagggcgtgctgttcgtaaagaatccgcaacaagctgactgcttgggggcggactgcggtgctggtatctacctgatgctggagatgctgaggcggggtgtgcacggacgctactgcttcttcgtggacgaagaggttggctgcgagggtagcgctgcatcggttaaggatgactctggattttggactggggtcaaggctatgatcagcttcgaccgccgcggcgacggtatcattacgcatcaaaggtatatgcgctgctgctctgacacctttgccaagaccctagcagagcgcctgggacgcacggagcagcacttacagaagggggtgtacactgactcagccgagttcgttggcatcatccctgagtgcaccaacgtaggtgtagggtacatgcacgagcacaccccggatgaggtactggacctgaacatcctggggcaagtgcttgagcgtgtactacaagatggcacgttctcgcaccttccgattgagcgggatcctagggtagtagaaccagaccaatggctctctgcaccaacgctcagtttacggcagccgtgggacatgccgcctgctgaggacccgcagttactggcagcgttccgagaggtatcacaactttctaagcagcaactgattagctgggtgcaggagaatccagagaaggcgacggagtacataatggtgttctccgattacggctttaaagaagaactgattgaactaggcacccgagtcgtagaagactggggcggatacgataatattgtggagggttgattatgtctaagtttaaagttggtgataaagttgttcgcaaagcacacaaaaacaattcgtcgctcaagtcgtacctaggggattttgcttactacgtaattacagatatagctacaagcggccactggctgcagttggataactttacagatggaggagccgacccctacccgtggtacgccgataacttcgagctgtatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatggaaatcaaacggaaggagaaagcaaatgcctagtaccataaactatagtaccttgcctgatgccctcagaacggcagttccatttacctggggtgcaaagatttactgggccataaaatctcctggtggggatatgttctacctgcatgacggggcaccggtgctgttgaacgagcaccagattcttaggcaacccgacttgacttacgccactaccctggaaattaagtaatggaccagccctggcttagagcgtgcaagcgcctggccgtagggcagagggctcgctttcggtgctgcggcagggacgccgccggggtgctctacaataacccggatgcctgggaatactattgccaccgctgcaagcaggtgggcaaggagcacaagcagtaccagcgcatacagttacaggaagagccgagggtgcagccctctgcacctgcagatgcaatttgcattagccaagcgcctgcggaaacgcagagttttatttacggattcctgatcacaaagggaatcatgcctgaaatggtgggggatgcagaatggagcaaagagaaacagcggataatcttccgtgtcggaagcgctgctctgggtcgtgcagttcatgctcgacagcaaccgaagtgggtaatgtacggccaaccaataccattcgctgccgcggcacctgccgtagcaccggatgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccctggataatgaccaagcgggacactccggcgcggccatgatacggcgcgcgctgcgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacccctgcatagaaaggtgtattgctcggcgaacgatatatctccggagagcatagcggggctagttgtgcgccataagtgtgacaacccgagatgtattaatcccgagcatttagaattaggtacggtcaaggataacgtccatgactgtattgcccggggtagggctagacgtggagtttctaaaggggagcagaatgggtactccaagctaacagcgcagcaggtggactatatcaggaagacctacaggcggtacagcagggaacacggcacaccggccatagctgctagccttggtgtaagtgtgtcagcagtgcacgatgtattgaaagctaaaacttggaggctctaattggacctaatagttgttcgtgcaatgtgcacgcagaaggtgtggaaccgactgcgtgaacagatacccaagtccatgctcgcgccggatacgtcgaacctactagactgggtggggttgtactggaacacgtacccggagcaccaggaagtgcagtgggatgcgatgcagagcatgctcaacctccgggccggtcacttatcccgggaagagagggtaatcatggacgagcttatgcggggagtacaggccgtaccgcaggattctgtggtggggattgtccagaccctgaacgagctggcctacagcggggaggtagccgcgctgacgcaacgctatcaggatggggaggaagttgattacctgctggaaatgaagcacctccagcgcaagtacggggacggtgctgctgttcatgattcgctgcttgaatgggagagcggtagtgttgacgaaatacttgccgcgactgacgagagcggtggtcttaaactgggcgtgttcgagcaactcgctagcaacatccgaggtctacgtggcggggactgtatcgcagtggctgcccctgtggactctggtaaaactagtctgcttgctgctattgctgtggattttgctgagcaaatgcagcagcagccggaagtgtacggggaccgccctatcctctggcttgttaacgagggtccggcgacgcgcacagtgccgcgggtatatcaagcggcgctgcactggactctggctgagattaaggaccggcacagtaagcaagagttcgtgccagcctacctcaagaaagtaggcagggctgaccggattcgtgtcaaggctgcgcactccttgacgatggcccagatatccacgctcatggaggagatgcgccccgcggtaatcatcatcgacatggtggctaacatccgtggtggcactatggagaccgagcaccagaacctcgaggcgaaatggcaggagctgcgtatccttgggtgcgagaacgactgcgctattgtaggcactatgcagctttcactcgaaggttacaacatgctgttcccgccgctcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgctgatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagtggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgacaggttgtattgaccacggacagaggggaagcacttgccgaggaaagggcgctgggtatggccgctccagatttgacgggaagacaactggcggccaccgcaaagcatactgtatagcccacaacttgaagctgagcgatatcgcaggacttgtagtccggcattcgtgcgacaatcctcggtgcataaatccggagcacctgctactagggactcctagcgataatatgcaggaccgaaataaaggtgcgcgtaatttgctgggcagccgcaaccctgctgccagacttaccccagaagacgtgcacagcatacgagaagcatacgctggcggtgagacccagatatctatagcgagacgcttcgggacaagtcaaggatacatatctaatatcataaaggggagggtatggaatgagcagaagcatcctgataacggattatgagacgcaaaaccacccatattacggtagtgttgcttccccgtactgtccggataattacatcgtagaatcagcgtggcgtattgaccgcacgcacgatgacggtacggtagaagtaggccccgtagagagtgtacggtataacagtcgcgcgcactttgaagcggcacctgtatcagaatggctcccaataccagctgactgttggctgattgtggctcacaacgccgcatatgagattagctggttcctaacctttgcgcgcgccgagtttgaggccttcctaaagcggggaggtcgcgtattctgtacgatgcattctgaatacatcgcctcggactttcagagcatgtatccgtcgctggacgagacggctcctaagtacggtggtacgcacaaagtagacggggttaagcttctgtgggagcagggtgtgctaacctcccagattgacccgatgctactgcacgactacctggttaacggggacatcccgaacacggccctgtgcttctacggccagtgcgctacgttcgcccagcgcaatcagatgcagtacgtgtgggagcgcatggatgccttgctggcttgggcgtactgcgaatggttcggcctgttcgtgaatatgccgattgctcgcaagaaccaagaagagcaggagcagcgcatcctggagattaagcaggagctgcagcagtacatcccgaaggacttgccggagacgctggatttcaacttcggttcggacttccatatgtctgcactggtgtacggcggacctatcaagtaccgcaagaaggttccatatttccccccgcagtatgtcaaggcagactattggcaagtcggggacacttgggttgccgtggacgacatgcccgcgccacccggtgcaaccacgtacaagtccggtaagaacaaggggctgccaaaagtattccgccttgatacagaggaggagaaacttaagtgggaggatgacctttacttctgtccgggcctagtggacatccaggagcttccggaagttatccgggagaagtacgcagagcgcggagagttccggcaggcgcgtaccctgcatgacggcacgccagtatacagcaccagcactgacgcaatggaggcactggctcgccaagggttcgagttctgtaagttggtaaacgagctggcggcgcttgagaaggacactggtacttactatttgcgggaagttctggatgcaaacggagaagtcaaagagcggaagggaatgctacagtacgtaatccctgaacgtcctgatggttccggaatcatacaccaccgcctgaatacctgtgccaccgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcctgctacaggcaggtacggatatgcactgttaccgcctagctttccgtgaaggattaccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtgcacgatgcgctgtacctggacagcgccaacccagaggttggacgtgaggcgagcttgctggttaagcagtgcatggaggacgcacctaagcgtatccaccagctctggcctaactacggtatcattggtgaggtcccgttcccagcagaggctgagatgggtacgagtatgtacagtaaggagaaggtagaatgagtataaagtcaggcagtgttgtggagttgatggatcttgggcctgagccgatagacccgaggtatgcagcatacttcaccccaggtacaaggcacacggttatattcttcgacccggttactggtgagatagaactaagttaccctggactgttagtaagtaggcccggggacggcgtcaccttcttccccggggagtacaagcttatcgaagagtagtgataggtgtacccttgggtggtgtagggggttagggtagcatggaaatatgctagggtcaactaaataattaaataaaattatttgttgactttggcttgattctgtgattcccctagaattaatgtgatacgagtaggaacaacacaagagaggcaataatggcacgtgttagcctaataaaactattcaccaaagagcagcaccaggcaatcctgggccagtacctagacaacgctctggctgctcagtactacaaccaagagctggataatcgcggggatgtggacacggacattagtgtatctcgtcagcttgtgcgctattggcgcagcatcttcatggataacaagggcagcaaggcaagggctaataatgctttgatgcaagcccgcaaactaatccagccctccccaacggatgacattggggatacgtttgtaccggaaacctgtcgacgtattctcgttatcggggacctgcacgagccgtacacacatccggacgcgtacgactttttgcgcactgtacgggacgagtactgcccagacattgttgtgcagataggcgatgagacggatgggcacgccattagctttcacgacagcagtccggagttggatagtgctggggtggagttagagaaggccaagcttggcctggagcggctgcataacctgtttcctaacctgctcctgtgcgactctaaccacggctctcttgtctaccgcagagccaaagctcatggactccctgtacagttcattaagaagtaccgggacatcctgttcccagagcatggggcccccgggtggagttggggcgatgcttgggatttgaatactccactgggtattgtgcgattccaacatcaagtatctggggaccttctgctcaacgcagcccatgaacgtaagtccatggtgattggacacttccatgggaagttagatatacagtatgccgctagcagcactgccctgtactttggtgcgcactgcggttgtttaatcgacaacaagagtctggcctttgcttatggtaagttgtcaagaagcaagccgattctagggtgtatggtgattacagatggatgcccgcaaatcatccccatgttacttgacgattccgggaaatgggtagggagaagcaaatgaatttgctagacgcaaccgtcacccgagtgggtgcgcccgtatgggatgagcaataccaggtgtatcgtgtaaccctggagtatgactgctgggggcacaaatctgagacagagcggtggtataaagatgaatcctcagctctgagtttaaaagttggcgacataatcaaaacctaattaggggtaccaatgaaaatgggaatctgttctgtactgggtcttatctttataaccttgaaactgaccggggttatcgcctggtcctggctgtgggtgctgcttccgttctacggcggtgtagctttgctgttggcaatcctggcggcaggcggtgtggcggcagccgcggctgcaggcattaagtccgcacttaagaatcgctaggcctgtcctgcatctgcacgtaaatatcatttgaactaaacgagagggtatatgcacgctacttctctgccgcaatatttgcggtatgaccccgaatcggggaaattgcataggcctgacggttccgaggctgtgggttacattaaggatggttacagggtagtaagtgtgaagggtaggcaatactttgcacatcgactggccttcgccttaatgtgcggacgttggccgaacgttatagaccacgtaaacagaaaccgtacagataatcggtgggtcaatttaagggaggccaataaagcagtaaacgcgaagaatgcaggattgcggaaggattcccggtcggggtatcgtggagtgtcttatcgtaaaagcaatggtaagtggcgtgcctacatacaaacagatggggtacaataccacctaggattctacgctaccgcagaagaggcccacttagcaaggcaggcagttatctctcagcatcacaaacacttttctaacgaggtataaattatatgactactaatgtactggcatccttgaacgctctggtagacgcagcaatcgaaacccaagatgtagatatgcgggaaacctcacagggcggtgcgtatgaggatgtactgcttccgaagggcgaatactacggctacttcgccgagtacgtagaaatcggtaagcgcctaccaactaagggcggtaagcctactggtaagcctgcagtggctaacgtgcgcatcggtattgtggtgtacggtcctaacggtgaagtgaagcgtatccgcccgtacccgatggctatcagtaactttgagcgagcaggcttcaagaagttcttcgacaagctcaactacgacaatagcattaagcatgcagcacagcgtctggggcaggccttcaccttcccgattgatgagcacaccagtgctgcgggcaagaagtctaacatcgtggacctgtccggtatccgcccgattccgaagttcgacccgaacaccggcgagcctatcaagatgccagccctggatgcctctgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcaccgcaagcacctgcagccccagctgctccagtggctcctgcggctcctgtagcgcccgctgcgcctgctgcacctcaagcctaatctaccctaacctaaactaatatggccccgcatggggccttagaggaagactatgaacatcatcaacattctcatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctagctctcacgcatacagggcaagccttctgggtcccgagattagtgcgcagcgttatcacttgaatcgccagtgcgccaagtcccggcgccgtgcatacgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggacatgttcctggtcggctgctcagaggcagtggcgtacctgacgcctgcaggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatatactgacaggtacagtgtggcctgcactggaggacccattcggatggattaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcatatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggagaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggcccgggcacgacgcaaagcacgggagactattaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggagttcttccagctcttccattcgaagagcgaggctgtttctgactcagtgaactctcctcggcactaccagttcttcccggacctggaggcaattgaggtgattgcacgcagtatgacgaaagagcagttctacggatactgcctggggaaccggctcaagtacagactgcgcgccgggaacaaggataagctggagcaggacattgccaagtccgacaagtactcagaactgtacgagcaacaccgaggtaagtgcattgacgcctagcgcatggtgccacgggatgtggcagaaagcagtagaacggggcgacgaaagctccgctaaagactatctggagatgtacaatctctgggtgagtcgcaatcagtagttagaagtaccggacataaccaaggagactaagcgcctatgattagcgccctgaatacggttgtagtacccgaggaagcactggtgaagcgccagctggagcttgaagagacctataagattcgcggaatcgagcgggcacgtaagctgattacggacgcactgcagaatggcgggattatgaacctgccgatgacgcagcgtatgctcacctcggcatatgaggtggctgctgccgctatcgatgagatgcgaaatgtcaaagccccgggcattggtggtaagtaccgacggttcctgcgcttagtccccttggacgtcctgaccactctgagcctgtgcacaatgtttgaggcgttcagcgtcgcccctggcgagtccgccagtcgccgtcagactgcacaggcggtaatgtccgcactgggcagaaacgtacagtcagagctactggctctgcagttacgcaacgtagcccctgcgtacatggaccgtgtgtatgagtacctcacagagcgccgtacgaagtcccctacgcacatcctacgtacgctccgcgccagtgccgagaacgtgcactatgggcacgagccttggaccaatgcccagaacatctccgtagggcgtctgctgtgtgccgcggtgtttgagacgggcctgttccagtggaagaactgtagcgggaatctgagcatgctctacccggctgacgacgttatggaggccttccagaaactggtagagtccgctgacactgtaaccatgaagccgcctatgctggtaccgccggtgcagcacactactctgtgggatggtggatacctcacccctatcgacaatcgcgggacctatcataactcgcacattgacagagctcgtctccgtgaagtagcggaagcatttaagtccgcggatggcattaaaaaagcgcttaataaggcacaggaaaccccgtaccgtattaataagcgcatactggaactggtgcaagaagcacgggccatgggtgttgggataggcatgccgcgctcagtaccggagccgaaaccggagtggtacttggatggtgttccaaaagagaactacacagaggaagagcttgaccgttttggtgagtggaagacgcgcatgtccctgtggtacagcgcagaccgtaagcgtgtgtcgcaactgcgcagccttttgactacgttagaaatggcagaggaattcaaagatgagaaagctctgtacttcccaacctgcgtggattggcggtaccggttgtacttcaagtcctcgctgcaccctcaaggttctgatttgcagaaagcccttcttgagtttggcagaggaaaacctctgggtgatcgcggcttattctggctcaaggtgcatgtcgccacatgctttggttatgacaagaccttattcgaagaccgcgcagcttgggttgatgcgaactttgcagagattgagcagcttacagtttcaccgtttgattgccctgctttcacctccgcggacagcccttggtgcctattggccgccgctatcgacctggttaatgctgtgcgttctggatgcccagaagagcatattagccgaatcccagttgctatggacgctacaaactcaggtgggcagcatctctcagcgctcctgagagaccctgtgggcgggcgtctgacgaacctgtactgggagggtaactataagaaagctgacctgtacatggacgtgaagcgccgtacggacgagaaggtgatactggacctggacaaggaggatttcgttatccagagcacgtactggagagagaacgaaatcacccgcagtatgaccaagcgccccagtatgacctatttctacagcgctacggtgcgcagctgcagcgactacatcttcgaaggtgcttgcgccgagggatacgagggtgccgagactaacagcctgtggaacctgtcgtgctacctggcgccgcgtatgcgtaccgctatcgaagaggcgaacccagctgctgcggcagttatggggtacttgcagaacctcgctagacgcgtaccggcaagccagcatctgcagtggtatacgccgctgggtgggcttgtaatgaaccgttacacgcagcgtgaagaagtgcgggtacgcattgactgcatgaacctcaccgtcatgcgggtgcataaccgggatttcaagacctgtaacaagcgcaaggcagcctctgggattgccccgaactttgtgcatagcctggacagtacgcacttgatgatggttctgtgtgccgcggaagggttggacatcgtgcctattcacgactcgctggctacacatgcagctgacgttgacgctatgcaccgacacatccgcgagcagtttgtgagcctatacgaagagcacgacctgcttggggatattactcgcgcggcagcagcagctggggcggacttgacggatttggatatgccagaagtaggttccctggacatccggcaagtgctggaatcgcctttcttcttctgctgataaatgaagttaccggagtaggaatgaagttaaaacacaccagtaaaacttccgattacactctcaaggttctgtataagtctgacgacattacagacgcagtgaagcaactgcacgaactgggccacggcattagtcggggcctggctccagagcagcactactggagagtgctgggaagtatattgggtaaacagtatatactaggagtctatgactcccaaggcggattagtcggtgctgtcagctactatccagaagctgtggaggactgtcattacgtagagcctgtgctgtatacagacttcttcgtactaaaaccggacaatggtgcggcggtgactgtgattatgcaggggatgcacgcgatagccaagtgcatgcgcgccgggcgtattgccattagccggagcacatcggataacacgtacaagacaacttatcatttagtgaggtcagaatgagtggtggtttaggtaaactgttaggtaaggccacggatatgctcggccttactgacaacgcaggattagaggcacagcagcgcttggcagagcagcaggccagcgcagctaaacaacaggctgccttagaggctaatagcgccgcagataacattgctgagattgacccagcaggggctgcctctgcatctgcagatgcaattacgtctgagcagaagaaacggcgacaagcagggcagagcaatcctctgggcctgtaagggggtagcttggaacaaaaagcaacattagcagaactctttaagaaggaccaggacgcgggtgtcttggatgcctctgagaagtttgcgcagtggacgctcagcactatctttacccgggacgattccctggacggtagacgcaggcccctggagcgtgattaccagagcacaggggcgcagctggtcaacactgcagccactaagattgtaggcgcgctgttcccgcaaggcactagcttcttccggttctccaagagttcggacctggacgagttcattagttcgctgggcagtgctgctacggcagaatctaagttggccgaggtcgagaacacggcgtcacagaaagtatttgagaaagacggttatgctgcgaagttgcaggctgtgaagctgctgctggttacaggtaacgcgttggagtatattgatgagcggacaggtaaatccatcgtctattcagtccgtaactttaccgttcgaagggatggaagcggtaacgtcctgcgactcattatcagagagcgcgcaagcgtccaggacctgccagagagtttccggaacaccttctaccgtgacaaagacccatacggcgacgttgatatctacactgcctcttgtcgcaaagttaagcggacagaggacggtgcagaggtagtaagctacgaggtgtaccaagaagcagacgggcaccgcattggagacagcagcacctatccggagctggagcttccctacaacgtgctggtgtggaaccttgttagcggcgaacactacgggcgcggcttggtagaggactacgccggggacttcgccagattatcggtactgtcggaagcgttgactaactacgaggttgagtctgcgaggttaatcccgctgattgacgcaagctctgggttagacgtggacgagttcgcaacgtcggagactggcgaggctgtgcaggtgggcggcggcggttccaacgggaacagcaaatcccccgtcactgcttacgagggtggctctgcccagaagattcagtggattgccagcaacattcagatgctcgaacagaaactgtcgcgtgcgtttatgtacaccggtaactcccggcaaggtgagcgcgtcacggcttacgagattcgccagaatgccaaagaggcggaagccgctatgggtggcgggttcagtattctgagcgacacatggctgcgtaagctggcgtacctgtacactgcactggtatatcctcgctttaagctgtacctcagcgaaggtgtagtgagcatcaacgttacggtgggtacctctgcactggctaaagccgcagcagcggataagctgctagaggcagcgcagtccatgcaactggctatcccggtgctggagcagattactccacgcttcaacaaggatgcgtgcgtagactggtacttcgacgcctacggtatcgtcagcgagccgttcatgtacacagaagagcagctgcaacagaagcaagaagttcaagatgcgtctgccgatgtatccgcaggtgcagcacaggaccaactccagggcttgacagcagcagacccaacagtagcaggtaagcagctgggcttattaccaagttaacaacaggggcatagatggataacgtagaaaacggtcagaacgtagaaactacacaggtagagaaccaaggcggccctaagattccgggcctaggtgctccccttaacgccccgaacaatcaaggcgtgcaggatgcgcccgcacctacccagcagcaacagggcaaagattcccctgaacctgctaagattcctctggatatcgaagccctaaaagcagccctggataagggtggcgatagcgctaaggagcagccccaggagctggctcagacaggcaatccgacgattgacgccggggtagctatgttgaagcaagtatctgggttaactgactctgatatggtgcgggcacttggtaaggccctggagtatcaggaccctaacctaatcgatacggccttcattaaggaacgtttcggcgagcacgctgcttacgcagagctgttggctaaggcgtacctggaagaccaggttggacaagccaccaaggcagtgcaggaagcttacgatattgtgggcgggaaggagaactgggaggtagcagcacagctgtttaattccaaggctcctgaacctctgcgtaacgcagctcgtgtactcgctaacgctggtgagcttaagcaggccgctgagttggtagcgggcttctgccgggatatgggtcttatcaagacacagaacccaatggtacggggcgtagccagcaacaacgcattatctgctgcggacttccgtgcagaatataccaaactccgtcaggaagcgggcaaccgtagcttggcatctccgcagttcagtcaacgttataatgatttgctcgcacgccgtgaggctggtaagcgcgtaggtctttaattttatttataaaggaaactaaggcatggctaacactatttataatggcaacctgactcgtccgcactggggcggcgcggcgtctgacgtagacattcacctggaagtgtatcagaacgaagtggatacccgcttccagtaccaggctctattcctgggactctccagccagcgctctatcagcggttctaacacctaccgtattgaccgcttgaacacctcctcggtgaagggtcgtcgctccggcgaggcgctggatagcaccccggttcgtaacgataagatgattatcgtggtggatacggtgctgtatatccgtaacctgattgactaccaggatgactggaccggtccggacttcctaaccgagatgggccagaacaacggctctgagttcgcagagaccttcgaccaggcgcacctgattcagctcatcaagggccgttcctgggttgctccggcgcacctgaaaccggcgttcaacgacggtatagaggtaggcgcagctatcctggttccgggtaccactaccgccacgcagctgacccaggctgagatggaggctaacgccatgaacatcaacctggcgcacaaggctggtattgatgagctcatcaagcgcaagaccccgctggcggatatggtcactctggtggatgtcgatacctattcgcgtctgctggagcatccgaagctcctgaacatcgaattcggtccgtccaacaacgacggttacaaagaccgtcgtgtagtgaagatgaacggcgtacctgtagtagagtgcaccgagttcccgaccgaggctggtacgcatccgctgggctctgcttacactgtcaccgcagacgacgcgctgtgccgtatggtgactttcagcaagtccaagaccctggtgactgttgaagctaagccgttcacctcccgtatctgggacgatacgcgcgagttcagcaacgtactggactgctacgcgatgtacaacataggcctgcgtcgtccggacaccgctgcagtgactaagttcaccttcaccaccaagtcctaattggaggttcaatggcagtaatcgctacgttcggtctggagactctccaggccaatgcagctcagcgggaggcggttaaggccgccaccgatgtagcgaagaacatccaggtggcctcggtcgagtctggccgcaaggctaccaagaaaacccgtaaggcggctgatgcagccgctgatactgcggaagagtaatacgcgcccctggtgccttcgggtgccaggggcttttttttttgtccctgtcttaaaggtccaaggggtctttaatagaggaacaaatatgagagaattagacgctgtgaacctgacgctggaagccctgggggagtcccgcgttatggacatcaacactagtaaccctagcgctggattagctcgctctgcacttgcacgtaaccgtcgtgggttgctcagcacaggattctggtttaacgtggtcgagcgtgaagttacgcccaccaccgacggcctgattaaggtgccgtggaaccagctggctgtatatgacgcctgctcagaatccaagtacggggtacgtgacgggaacctatacgacctggtagagcagaaccaatacttcgatgcgcctgtgcgtattcgtgtggtactggatttggcctttgaggacctgccggagcacgccgctatgtgggtggctaactacaccactgcgcaggtatacttaaatgacctgggcggtgacagcaactacgctaattacgcacaggaagctgagcggtacaagagcatggtgctgcgcgagcatctgcgcaatcagaagttcagcaccagcaagacccgttttgcacgcagaatccgccgcgctcgttttatggtctaaggagaggttatggcgcaatcattagaaggtactattcagagcttgctgcagggcgtttcccagcaggttccgagagagcgccaaccaggacaactgggggcgcagctgaatatgctcagcgacccggtttccggtatccgccgtagaccgccgggtgagattgtatgggaaagcacaatcgataaccctgggcttgactccctgttcactgaatacgtcgagcgtggcactgacggtaggcacctgctgattaacaccagcaacggtaactggtggttgctggctaagaatggaaagaccatccttaattccggcaacgacccgtacttcgttaccaccgtaggccagacctctttgcagaccgcaagcattgccggactgacttatatcctgaatacggagatggctcctagcacaaccgtggacaatactgggcgtatcgaccccagcaccacggggttcttctacgttaagtctgcagcattccagaaacgctggaacgtcacagttacctccgcaggggtagactactcaggggactacaccgccccagctgctggcagcaccagcggtaacgctgaggaggtatcaggtgcctacgttgctcagcagctgcgggactctcttgtagctaatggcatgcccgccgggaacgtgagcgtacgcggtgcgtacctgttcttctatggactgagcaactgcgtggtgtcctctgacgccggtgatacttacgctggggtatccaaccagtcccgtgtagatcaggagcaggacctgcctgcacagctcccagcgcaagctgacggagcaatgtgccgtgtaggtacagcctcgtctgagacagcgtggtatcagttcagctacagcacccgcacctggtctgaggtgggggcgtacggcagcatcaccaagattacgaacatgcccagagaacttgccgcggatgacaatattattgcgcgggattgggaagggcgcttagcaggcaacgacgataacaacggtaatccggggttcgtcgagaatggctacattactggcattgcagctttccagggtcgcctggttctgcttagcggcagctctgtggatatgtccgcctcgggcctgtatcagcgcttctaccgctctactgtgacgtcactgctggatacggaccgtatcagtattagctctgcgtctgcgcaggattctgtgtaccgtaccgctgtacagtttaacagggacctggtcctgtttgctaacagcatgcaggccgttgtgccgggttcagcagtgctcacccccactaacgcaagtattagcattaccagcacctatgagtgcgatagtcgcgttactccggtcatggcagggcagacagtaatttacccgaacaagcgcaacgacagctacgcgggtattcttgagttgatcccatcgccgtatacttcatcgcagtatactacacaggattctacggtgcacttaccgcggtatatcccaggcagggtattgcagatgcaaaactccagtgtcaccaatatggccttctcgcgcatgtctggggagcgtagtagcttgctggtctacgagttcatgtggggcggaagtgacggcgctaagatgcaggcggcgtggcataagtggtcgttcccgtatccaatcctgagcgtacaagcgctggaggatgaagtgttcttgtacatgcaagggcccagtcccagcaacaagcttttgattgtgtctatggacccgcgtgaaggttaccagctgggttcggagtatcgcgaagcgtactcggatttgcagaagcaagttcaagtacaggacggggtattcaccgttccggcagtactgcgtccagttgggtgggctgaccgctatgaggaagagcttatcctaacttacttgcccagtaaccctatgggacctactgaggttggcataaaggagattgccggggagaacaccctgcgggttgtacgcggtgtacctgatggcacctacgtaatcgggaggcgttaccgcagtacgttcacgctaactacacctattctgcgggaccagaatgacaagctcgtggggagtgggcacgtgcgcctgctgcgcctggatgtggcggtacgtaactctgggcacttcgatgtgcaggtactagacaccccacgggatgtcaactggggcggggaactgacaggtatcctgatgaactcaaaagagctgacgctcgggcaggtcctgcgtatggacctggctacgattaccgtgccatgccgtactaacgcagacacaaccgaggtgtcattatttactgagggttctatggaactgaatgtgctggatatctcgtacatcctgcgctacaaccaacgcagacggagaatttaatatgtggtggatggttgcggccatggccgctaagaccgttctggggcatggtgctcagattgaagtgtccaaggccaggaacaaggctgtgattcaacagacagccaaacagctaaacgacatcgcgctacagcgagcccagtccagggaccggactgaggtatctctgtttaacatccagcagcagaagctgcaggcacagagccaagtagggctgcaggcagcagcttccggtactatgggggcctctgttaaagacgccgtagccacagtgaacactgtagccggacgacaagaggccagcgtgcgtgaccagcaggcaactcaggaagagggtttccgtctaatgacggacaaggccgtggacagcggcctggctaacatggacatggaggacccctacgataacatgtttaactcgttgttgagtgtcggggcatctgccgttgggcagtacgctggtaacgctgcgtcgtctactgactctggtagctcaacacccggaagtggtgcagcagctactcagaacatggcgtcctcctatgatttatgggggagcaaaggtaacagctcagttcacacctggtaacttaagaggaatgtcaaatgcctgtgattcaacccagtagacaggggttaagtatcggaggagtgcaactgcagtccaacgatgttagcttaccgtcaacggtaagtgaggtgtctgttgatacctccaaagcaaaacgcctagctgccctgtcagggttcgtgcaggacttcggcgtagggtttgacgaagcagtaaaagaaaacgctgcagccgcaacggtgcgcggcgcaatggatgcccagggcgcagtagatgcaatggcttccaaagatgaggctgtacagaagcagaacatcttcgtacgcgaggcctatcaggatggctacgtatccgccgccgcgtacgactctctagccaagtggcgcacagatagcatcgcacgagctaagaaagctgctgagtctggtctgactgacgaggaattccagcagcaggagcaagagcacgtacagtcaatggcagacaagctcgggatgtatctcccggacatgtccaaacagtctgccacgaatatactgcagcagctccgtgctaccagcatggcgaactacacagccttccagaaaggcagagctgcgtttgccctggcgcaggctgaccgtgcactcgaccgcggccttagctcgtccagtgatgagttctatcagcgcctgcaggcgggacagggtgccgctgcgcagatgtctatcaagaccggtttagatagcatactggctgctgagcacttggataagagcaagaagctggaccgggccaagcagtatctggtcagcgtggcgcagcagacgcaggacccgatggtaataaaccagctgcaagagttagctaccaaggaactcggggttaactcagtggacgtcaacgcggcactgtatcaggagttcaagcgcgcaggtgctcagattgagacccaagcccgtttcgaaatctccgatgcaatccagtctcttgaagggcagactcctgagcagcaagagcagactatgcagcgtatccgtggtcgaatcattgagcagtcaaccaatggggtgctcagcgctggggccagcatggagttctggaacaaggcccagaccattcgcgagaaggcagcggacacccaggcattgcgcacagcaattactggaaacatgccaagctccaccctggcggggatgtacaagggcgacctgggtaaggcgcgcaacgagctgctcaaaagctttccggacaccccggaagggaacctgcagctgctggcatacgggagcaacagcaaggatgcgtgggcagtcaacgaagcgcacaagcgtatgtcttcggatatggcacgtacgctgactacgctggaccagctcggtgaggatggtgaggtttcccgcgagaacgtaaatagcatcaacttatgggcacaggcttatagcaccagtacggacttagggaagatggcgctgctgtctgaggtcccatctgagtggcgtggagtggtgcagaaagctgttacacaaaacccaaataatgccagtaacactatcttggacgaccttcgccgccaggcacgcaataaggccagtgggcgctacagcaatatccagagtaaccccacggacaagatggtggacccaagtggcacggccaactggtttagcttcttcggggatgcagatgcccagcgccaggaagctcgcgctgctatggaagaggagtaccgttatatgtataatcacaacccggaatcccttgtagggaaggacgctgacgacatcaatacgatgctaaaaggcaatatccaatcccgtaagttagagctggacattgctggggcacctaggcatgtgtatctgcccgcgggcacctctgtgcaatctatcatgggtgattataagggcgaccaagagcaattcaaggcctccctgcagcagcatatacagaaccaggttcagtatatgtcagaccacagcaacatagagcgtgtagtagtgcaggccgccactgcgggcaacgcaggtcagaacatgaccgtaaccgtgttcgacaagaagggcaccttccagacgatgtctgtgaaccttcgagacgttcagacgactgcgcaggctgcgtacgattcggcactggctggagatatgaagattggcagtgagcaagtaggagtgcgtcccgccaccttctacgaccacgacaacgggcgtgctgtcagcgtacaggtcaacggccgtaactcggtagggctggagccgtcgctgtttagcgacattctcgctaccactatgaagttcgaagggttccgggaaggcaaaggcaagggtagtgtaggtttcggtctgcacgttaactcgggcatgcccgtcccacagaaagtgaccattgacgacggtgtcggtatcctcaaatcctcactggagaagcagtacataccgaacgtgcagaagcaactcaagggacagggtttgactgcctccgacgaggcgttaaaggtcatggtggacctgaactatcacggcggtaacggtagctctggccccgtagcagaggcgatggcacaggtgcgcaaggctgctaagtccccggtgggggcgtatcagtaccctgtatctgaggcccagggtagggcttggcaagcgctgcggaataccgctgcgtacaagcaggcccaacctgagcgtaagaagtacctggaacaaaacctacgtgattggctctttgaagcaacgcactaaccagaggcccttcggggcctccccttatcaaaattcttttaggagatattatggctcagtttctgaaccgagaaccgaatccacaggaaaaggattctgctaagggcgcaacaattaaacctgcgcctgggcgcgtagattggaatgatgctggagataacggcctgaacgcgctggagcgtgcctccttactggcgcaggccaagaccccagctactacagccgcagagagctttgcatcgggtatgggcaacagcatcatcgctgcggctatacgtaaggcctctgctccggcatttgaccgagacctgaactttaatgccaagcagaccctgagtagcgacacccgagctaagctgtacgccccaaatcaggaagagattgagtacctacacgactcggtgtcggtcgaagattataactaccgcatgcagcagatgcttgagcagcgtgaccgtgaccgcttaatggctgacaacacagtggctgggttcgcgggtatgttggtaggcgactccccgttcatactggccctgatgcctgccgccggtattgctggccgcgcgggcttagctgcacgtaccgccatacgcgctgctgatgtaggtactgcattctatgcacaggaccaactgggccagtccgccgcggtaactgcactgatagcgggcgtagctgggttagaccagctctgggatatgtctagggctgctaaagctgccgctaaggctcgtactgggcgtgagcctatgttcgacccagaagcgcctacaactcgtacagcgagggatgctaatgttaccggagtaggagagggagaggaaattctcactaagacactggatgaaagcatcctagtatcgagaaacaataccgcctccgtgaacatgaaagcacagcacgtagttcagttcttgaagaagtctgaacacttgacagcaggccagaaggctattctggacacgctgggtgatgctgtaaacgacattgattttaaactggtagcaggctccgcaaaccgcagccgctacacttacgcacaacaagatttagctaggcgcggggaggtatctctacgcgcacctaagcgagctaatggcagcacctggactacagccggggacgcactgcgcgctatggatgcagacaccagcaaggtggccgtgcacgaactgattcatgccgccactgcgcgcgccgttgacagtaatcccgagattgctaagcgcctggaggaagtgcgcgctgttattgcagcagactccaccttgacgccgcgtatgcggtattacgcaagcaatgtgcacgagatgctggcaggcttaggcgacagccctgagtgggttgagcatctggcgcggacgaaatccccaaccggtaagagcatgctccgccaactgggtgagtacatcatgaacgccctgggcatcaaggccaaaggctctgccttggaggacgtcctggatgcgtatgaggacgccgttaagtggacagctaaggactacgcagaccaagcccagagcttccgtagcgaagccttccaggacctggcgggcagcactaccctcaacgaggctaagggtgcccaagctatgctggacggcgctaagaagaagctctccactatgtttgccctgtacgataacatcgcccaaggcaacgaagacttggctaagctgctagtgtcggatgcgtccgccgtagggggtcgtcgcccgtccgtagtggacttcaaacgcaaccttactttggagatggacgccagcgccagcgtagtggaagacgctatcctgggtgcgttgaaggataagggtgtaggtttctctgagcgcttcttccatcggagcaagttccgcgctgagcgggctgcactggaagaccgcctgagcaagtacctggatgctgcctacagtgctgatgtaaatggccgcgctgtgccggtgccggatgcagagattgctccactggttgacgcctatcgccgctctggctgggctagcaagtggcacgagcatatgctcaatgcaggtctagtggatgatggtgcgttggttaaatccgactactacttcccgcgtcagtacagctatgacaagatgcgtcaaggtatcgcacagggtaacactctggacgactaccgcgccctgttccggtccgccctgcgggacgtgtacccgagcatggagtcagaggtagtgcagcgtgttgccaaggagatggttgacggtatctataatggccgcgccgggcagtctggccctatgtggaagcagctgattaacggtatgggtaacgacgaggtcgttatggctatgcgtagcgctggtgtagatgagtctgcaatccagagtttcctggctggtaacgtacgcgaatccggtagcacatcccctgcgcggaatctgcgtcagcgtactcggttcaacatggacaaagagtatctggtgaacggtaagagcatgcgcatgcaggacctggtggatactgatgtagccaaggttatgcacgggtacactaaccgtatgtctgggcgtgtaggcatggcctatgcaggcgtacaggacctgggacagctcgctaagatgattgatgagtctaagcgcgcgctagcggattccgctaagtgggagaagaccgtcaatgacaccatcgactttatcctgggtggggcacctgctgacgctggacagcttccggatttgctgcgtgcagccgggaacatggctaacgccaccatgcttaagaactccggcctatatcagctgactgatactgctttggccatgaaggagttcggtatggctagagtgctgcgcagtatgcgtgaccagccttggttcaaggaaggtgccgtagctatcgagactccggatatggctgcccgtctagacactgtgctgcgtggtaatatccagaaggagatgcgcttccgctggttgaatacgtacgccgacgataacctggacctgacccgtcaggcctcctggttcaacgtcactcagaacgttgggcaggctgcacgtcacgtcaacggaatgagtatggtgcaccggctgcaggttaacctgaactccggcattgtggcggatgagcttacgcagatgttcaagggcgatgctgaggcgtttaagcgtctggagcgtttcgggcttacccgtgacgttgcggaccgcgctatcgctgccaacaaggctaacccgggcgccatgttccagccggacctgcagatgcaagttgaggttgtagggacgcgtatgatggactacctggtacagcagattcgtaccggcgagacctcgcactttgcgcagttcaatcctatcggcaaagtcattgtagggtaccagagcttcgcactggctgccactaacaagattctgcgtagagagctgaacgatgctgggtggattggtgtggcccacattatggcgtaccagttcccgttgatgctgctggctactatggccaagcatggcatggacggaaaggatgtagacacccagaaactcatcagtgaatccgtaacaggtatgagtgccatcggcggggtatccttactgcaggatattttcctgggagattctcctcgtcactcgttggcatctatgggttacgtcacagggctgctcggggccgtacaggacctggctaccggtaatatggatatcaagaccttcactaagcaggtaccgctaatccaggaattcgcacctacgcgagctatcatcaataacttcggagacgattaatatggcgttcagctggcaagagtcggtaaagcctgcaggtactcaggatatccagtgcgatatcgagtacctggataagtcctatattcacgtttacttagatggtgctgagactactgccttcacttggaccagctccaccaatattcgtctgaactcgccactgtctgcagagacaggggtgctcctaattcgtaagactgaacgagagtatctttacattgaattctctagcggtgctccgtttattgaaggcaacgtagatacccagaatacgcagttcctgcacctggctcaagagctagttgaggggcgttctattgagggcttctacggcgatatcagtatgcacggatatcgaatcacccacctaggagacccagtggacactgcggacgccactaacaagggttacgtcgattccggcgacgcccgtctggaccaaagggtggatgcggaagaggctgctagaaagtctgccgacgctatcctggatacccgagtaactaatctagagcaggcctttatatccgacagggtcactgtaagctacccttggtttacagtactggatacccccacagacaccgtgacgccgcccatcgcttttagtaaggccatagttgagctgaatgggcagggccaaatccccggctacagctttgtggtagtgggaaattcgttgctgtttgcggagacgctaccggccggtacgctcgtggcggctaggctgggcgcagatgtagaggcgggcgatgggtatgtaacccaggcagcttttgacaactggctggcctcagtaggcgaactggcgtacaagggcccggcaaacgctgtggcggatagtaccgacaccagcaacgttgccacccagctaaacgccctgttagcggagctgagaagtgctgggattatcaaaacttaaataattactggaggcacaatggcaggggcggctaaacgcagtcgcctctcggagctgcaccgcatgttcactgaggccttgattgaagaaatcaagcagtctaaggaagacgaggtgccgctccccgccgcagataaatcggttatcgccaagttcttgaaggacaacgacatcaccgcggatgcagattccgaggagatgcaggaccttcgtgacgagttcgatgatgaactagcggcgcgtagagaggcgcgtaagcaagaaattctaaataaagttggtggttcagactctgaggacttactagaaggaattgtctaatggtatcggtgaagaccgcgcgaagactgcgcatgctcaaccagaaacttactggttatagtgcgaatccgcgcagtattcccaaagaggagcgcgaggacatcgcgatgatgatggccgcggcgctaagtgacttccgggaattcgcatacataggtatgcggttcctgggttttacattgacggacatgcaggccgacattgcagagtacatgcagaagggccctaggaagcgcatggtggccgcacagcgtggtgaggctaagtctacactagctgcactgtacgccgtctggaggctcatccaggaccaatcctgtcgtatcctgattgtgtccggtgcagagaagcaggcctctgacgtagcgaacttaatcattcgtatgctagaaacctggcctctactgtgctacttaaaggccgaccctactcgtggggaccgtacttcattcgaaggctacgatgtcaactgcgacctgaaaccgctggataaatccgccagcgtagcctgtgtaggtatcactgcatccctgcaggggaagcgcgcggacctgctgattccggatgatatcgagaccactaagaacggtttaacgcaaacccagcgtgagcagctgctgatgatttctaaagacttcgcagctatctgtacgcacggggatacgctgtacctgggcacaccgcagaccaaggacagtatctataaaaccctgccgggacgcggcttcgaggtccgcgtgtggcccgggcgcattccgtctgttgaaatgggtgagcgatatggaagtacacttgctccttatatcctggagcttattgagcgcggctataaacgcaccggcttcggcgtcgacgggacgctaggcgagagcacggacaccggacgctatgacgaggatgcactgattgagaaggagctggacttcggtccggaaggcttccagctgcagtacatgctcgacactacgctgtccgaccaaatgcgtacgcgcatcaagctttcggatatgctggtttactctggtagccaggattcctcccctgagacgttctcctacatcgcggaccgccggtacctgtaccagcatgagcatgaggggattatgggccagcagatgtacttcccggcattctacggggacatgcacctgccgtaccagcataaggtgctggtggtggacccggctgggtgtggcggggacgaagtgtcttacgctgctggtggtgctgcgaactcgtacatccacctattctccgtaggcggcttccaaggaggtatcagcgaagagaacattgataaactgattgacctatgcgtagagttagatatcccggatatggttgtggagagcaacatggggcacggtaccgtgtctatgcttatcctgaaccgtctgcgggagcggcgtctcgccggtattggcgtaagggacctgaataactccacgcagaaagagcgtcgtatcattgacacaatcagcccagttactcgtcggcaccgcctggtagtgcacgagcgtgctatccacgacgacattagtacctgtatggcatactcccgcgatagacgttggctgtactccgcgttcgcgcagttgtccggcatcacgtacgaccgcggtagcctagctaaggacgaccgagcagacgtaatcgctatgatggtggctacgctgaacgggcacctggtggaagatgagaaagtggtggctgagcgtgagtctgagaagatggctcgggccttcattgagaacccgctggattgggcacagagcaaagtgtctaagggccttcggggtgtggctgctaggttgcagaaccgtggcagaggtaaacaacatagaggaagaagataatggcatttgcagaagcaacactggcacagcgccaggcagtacgtaatgcggcagtggcgcttgataaagcaacaaccttggcgcatgataccggcccactagatactctgggtcctgatgcagatgcagcaggggctgtagcagtggcggcactctctgctgcaggagcctctgacggtggtgctgtagtggtggttggtaacggcgcagaagtaactgcacctattacgttcaccaccgctcgggaggcgggggctaccgctactgtagcagcaactatcactgtagaagatggtgtaatcacagcaatctctgttgagtaaggagcaatactatggcaattgcaaaagcaaccccagcgcaacagcaggagctgctgcgccagctgaacattctcggtaaggacctgtatgctatgcttacgcagccgcaggacgtggcccagacgggtgctaccttcgataccaagattgctgcgctagaagccgcggtagccgcagtgaaggctgctagctaatgcgtaaactggtcgctgggttactgctcgcggttactctgactggttgctcggcgacctctgcactcaccggcttagttggttctaagccggatgtatctgctcaggttggtgccgaaaacaccaagcaaaccgttggcttgaataacaaggtggactccagcaccaccaacaaaaccgatgtatcagattctaacgtaggcactttggacacgtccagtaaggagcaggtgcaaactattagcaccggtacaatccaggcagggcgcctgcaggtggttaacaatgatagttacagtcttatcctcgccggattagctggggccagcattcctctggtcttcctagtggtcattctggtgattcgtaagctgttcaggaagaaggagcagcaggatgattaaggtaggggacgtagttggggcagacctcgctacccgggcaggtgcggcagttaccggcgctacggtatcaggaggttggttggcagagttaatgagctggaactggagcactatcagcttcatcactgcgacggtgtgcgcggtgctaaccctggcgtggaatgcgtattacaagagacgtacattcaagctcctagaggagcaggcacgtaaggggactattaaatatgagtttaaggactaaggttattgcggcccttacgggggccactatgcttggcggtgccattaccggggtggttcagcacaacgagggcctgagccttaccgcctacaaggatagcgccggggtccctactatctgctatggggagacaaagggcgtcaagatgggtcagagagccacgctgagcgattgtcagaagcaactgatacagtcagcaggggaacacgcaaaggcccttgacgggcttcctatgcagctctctgacgtatctctggtggggtctgtggacttcatttacaacgtaggcgtagctggcttcaacggcagtgctgtgaagcggcatctcaagagcctggattacgcagcggctggaaaggctgtactggactggcgctatattagcaagtaccagcagaagtcccctggcaccggttgggtgtacaagggcagcaaccgctggaccttcgactgctcccagtatattaatgggcagcgcaataaagtgtgctggggcctatgggagcgcaggcagtggcagagcaaagccatcgggaaccagtacaagaacgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgtccggattcttccggtaactatgcagccgctattgagcggatttccgctaaaggtgtaaaggtgctgcgagtacctgtggggtcttattatgttggagactgccaccttactaaccctatgctgtttataggtgatggcctagagggtgttaacccgcttggggctgtattcgttaaaccgagcacagccagcaagatgttctactttgacggtacgagcacccgtggaatgggcggcgggttccttagaatgcgactgcagggggctgtcagcagtgattcgggacttatggtggaggtaacatcctggagctattttggggcggaaaactctgcttttaataacttggcgggctctgcgctggtgttacgtgactgtatggagagccacatctccggaaacttattccgtaggatgggtgcctctaacggcagcgttatactcctcggggattacataggtattcctaataacaacgtcaataacctgcacattcagaataacacgttcggactgtgctcgggcgcatggattaagagtacagcaaacagtaacccggacctggtgtggattacggataataagtttgagtgggatagtgtaccatacggggctaacacagctgcacagcacgtactggactttggacagctgtcgcgctcttggattacccgtaatggttttgcgcacttccgcccggactccgaccataacctgtatgccgggtgtattcgtattaggtctggagctgttggccctattgttatttctgataacaaggcgtatggatgcgaaggggaattctggaccattgaaggtggttatgtagatgccttcgacaatgatgcgaacattgcagatgccagcagtgttctatcctggtcactgagtagtactagggcttgccgcatcaaccctccgcgcgtgtacagtgggaacatgaacgtagtgcgcggggatagtccgttcggccctgggtttatcgggcaggcgtacatgcgtggcgctgctgctgctagtcgtaccgctagggctggagccgctagtactgtagcactggatgttcccgcgggtcaggagatgcgtcggtaccagttgccgctgcaccttctcggggctatagtgcgcgtatccttgcgagtctacaacccgggcgctactggtaacataaccttagcggtgggtagtggcggctcctctgttgccgcggtaccggctggtccagggtggttcgatgtagacttttacttgggtaacagcctaacgggtgacggagatttgcgcttcaccaacagcactggaaacacacttagcctggatggtattacagtagagcgtgctcgttctgttccatttagctttgcgtggacccctggtgctgtcgctgccggtacgctggtatctagccctgtacagactctcccgtacggcattactcaagcccctgtcggtttgagttctccggtatttaacgggtctgttgatgggctgctaactggtgtcagtagctacagtgggtacagctcctacaaagttactctgtttaatcctggggctgcggcaattacccctggggctactcgggctcgcttggtgctgcacttctaacgcacagcgtaaagcccaggcccagtctaggcgagcagatctatacctggacctgaaatttattagactcacgcgagcccctccctcaccctcaacgacgccaattgcccccataggggggtacctagcgtcaatttaggggggggg

SEQ ID NO: 45 - DNA, 43855 bp, Unknown
  source: /note="Description of Unknown: MCoc7c Bacteriophage Sequence"
cgccgcggcggtcgaagctgatcatagccttgaccccagtccaaaatccagagtcatccttaaccgatgcagcgctaccctcgcagccaacctcttcgtccacgaagaagcagtagcgtccgtgcacaccccgccgcagcatctccagcatcaggtagataccagcaccgcagtccgcccccaagcagtcagcttgttgcggattctttacgaacagcacgcccttgttagtgcagccgacgtccggtgcagcgctggttgggcgcaccactgtgtcgaggtgcgacgtaaacgctacgtcactttgttcggagtccccgaccagcacgaagtagttcccgtgcttgtcctttacgtagtgcataccactacccagcgcctgcataagcagcggctcaaaccacttagtgctgccccagctaggccggtgcgtttgcagtatctgcaagagcagctgcatatcaatcccatgcggattcaagaacattaagctgcctcctctatttcttcatcgtcgttgcccagatacttctcccccaagcaatcggctgcatactcagtgagaatcaacccgtgcacagggtgttcttctgcgtgctcaataagcacctgtcggtcctgtgcatacaccagttcttcttggtcatgcactaccccctctaccgaacagtgctcaatgtccgcgtcatatacataggcgtcgtggtaatcagaccaagtgcagctccagcgattatgcagcccttctcggccaactacatatacaaagtccccatcttcgacgcagccgtcgcagaccatttcaccgtcggcggtttcgtgcatatcatcaatggagtagcgcccctcgcagcagcagcaccgagcagattcagtgcctacgtagatgtatccatcggcttcttgcgcctcgtactcgtagtcatcacggattacaaaggcgtcactgccttcttcatcaacaccgcactggctgctatcgaggtacggcatcagcactgcgccgttgtaggttgggtgcggtatgcgtgccagcattaccccctcgagacattcagtgtttctggtgtacccatgcccccgcaggattgcatccgcagcgttgccgtaagcacggacgtactctttggtttcaggttttacgattgctcgtgccagcacttcgaagtcgtccccgaaaagctccccggtatactggatgaataggcgcaacccgttatccggcaacccgtggctggtggtggcgtacgtccgcacagggctatgcttaaatgagtacccgctcatgcagctacccgggccattctcgtaggcgtcgtaccattcctgctcggtcttgcacaggtacgttgtagggtctacgttcatagccttgaggtcttcgatagcatcgcggaagtctaccccgtttccgtagtagttagcgagccacttaccgacgcgcatctctacgcaacggtactcattaactgcggcgaagtccttatgcatccgcggctgccccagcatcacgatgggctcaccgttgcggaaaccaaagcccaaaggcacggcgaatctagacactacgaagccgtgcaacttcatgagcagcgcagcggcgttgccatcgcggaggtggcgtccgtaatcgtagccagtgtactcctggcgctgccgctcttctggtgcaagcataatgcgctcgaataactgcacggcctgcttgtgcaccttgtaaccggtgaactcttctacactagcaactacgcgctcaaccactacatcatcgccctcatagaagtcgcggcggcgttcccagaacttgctgtcgatggtgattcgcgccggggaaaagagttcgtagaaagttccagaccggtgcaggtctaccttttgcaacgggccgcgagtcatcattacttcgcggtactcagggtgcagtatcccgcctatagtcacctctaagccaggggtgtaagcgctgacagtgcggagacccataagcgcctgcagcggaccctcattgtgagggtggtcagaaccttgcatttgcaagtcctggaacggggtccagtaatcaccgctggaatacatcgaacatttaattggcagtgtgtttgcaccttccggcaacactactttccattcgataggtgctgtgacagtttctttgatagtctcttgcattttaatttgctcctgaatagattcaatgagttcgtcgttaactgccaagtcagcgcgcataccacgcagcgagctgtctttgcttataatacgagcgcacagccgccctaaatcttgtataggctccacgatatccgtaccgtagcagtgctgcaaccacatcgaacttaatgtgctcttgcaactgccgcgcggcagactctgtatactcgcggtacgtggtgagcaccaccgtagagtcctgcctacgaacacggaggagtctacgctcgaccggtatgatttgcttgagttcattaggaacctctttgaatgtttcccaagtgcagccgcacttgccctgcgtttccagcagacgccagcatagcagcgctgtttcgtctactgttagcataggcttctcttaggaacgcagtttcgtgacaccaacacaaaagccggagaggtgataacgtcacctgctcggtaactgctccgcattaatcccgcagaggttaaaagtatgcggcgctcattaattgccccctctaaagggatgagataatacagaccgctataggtctctcggtacacgtcatacttcatactgcacctcgtacattaaagcgcaggcagtagcctcgcaaggtcatacccaggcgctgcgcttgcttctcgtagtgctggcgcagcgctgccttcgcgctgtactctcgcgccagtccttcgattgttggttgctgcctacacatcagcagcgtctcaggattctttccgtgcataccttacctcaaatatcgttgttgctcttaccgtccaccgtgagcgttacagcggcgtccgggtactgctcctgcaccgccgcaaggatacgcgcgcccagctctttgcaaccaccctcggggtcttcaaagaggtcatactcagggcgcggctgcggttcctgcgccgccggttgctgcaactgcactgtgcaatagggcaccgggttgtttacgtcgttgcccagcaccagcatagcgctggtcacaatgatgttgaacacgttaaccataaagttgtctccagtcgttgataatgccaagattcacggcgtccagcacagtgcgggcagccatttcggtgtaggtatccacaaattctaaaggggattcctgattagtgtctttgtcagagaatatgaccacagtgtagttgtattctgcgtatacccgattgcaccacacgggccagagttcatggcccggatagaccagtattgctttcatatgaaacctcatacgccagttgcattcacatagcgccccgtaggacgctataggcttgctactaggccactgccttcaaagttgcgtccagcacagcacgtacatccacgccctgattaatgagcatactcaccaaatctgcgtcgcttacgccagtctctttggccttcttaatggcgtttttaacgcgccccagcgcttgcaagcgcactgcatcagcgtccagcgcgtcattcttcacctgctccgcttcggcagcgtacagggccatacaggagctatagaagctggcaacaataacttcgcggtcctgcttgtcagcttgtttgtagtcaagacgcatagtgtccagttcgattcccagcttctcagccgacgcatagcacttcttagcgttgaactcgtacttaccggactctttgttgaacttgatgggtaatagcgtacgcagcaccatatcaaagtcagcagcgtcactgcgctgcatatccgtagcccaggaaacgttgctgctgataagaccgtggaagagcgcgctgatagtgatgttacgctttgcttccactacgtcgcccagcgctttacgaatgctacccgcagcggtgagcttgaatactttaccagttgaatgggtcataatacacctctttgattgatttactatcggttaatttcacatagcgccccgtaggacgctataggctattaaccttcaccgtagccaaccatttggcacctccctagttgcttagataattactccacatagcaccccataggatgctataggctgtaattagtgcccaaattgggagttaacagcaggccacccactaggctgtttactgccgcccttttgtttttgctttcccctcaccctgtgctcaccgctcaacccttgtttgctgggcttcacagtaagcggcacgttatcggtggggttaagtgataactgcatattccgccgtaatgctaggcgttttgctttgcgcataatctcacctctcagagtacataatctagcgcagccttgttactgctacgctatgttatatgctctttgcggggtacactccgcgccttgttccctcgattcagaggagcgagctgctctcgcctcggcagtatggtttgcctcagaaccccggtgataacgtccggcacgcttactctttttaactgattatctaggctcggtcgtcatcgtaccagtcaaggtactgggcctccccgcaaatcagcttactgcttgctatctaagttactcagttaatcggaacttgtcaagcgtttatttcttactacttgctggctgtccagctcggggtattcggtagttcccaaccagcctgtttccctaaactccgatgagcatcacttcttaggggttatctcgctgttagcctctcagcgccctatcgtggttagggttccaatcgcgcatttactgttacacgacatattcagttactttgggattcaatctagcttatgttcttcgcggtgtcaactctttttatcgagtgtctaacccttcacactatctagccttaatccggcggagcctcccggctcggctccgttcagcacctcagcgcctcccggtgattgaactatagccccattgaaccaaaagaagcaagtaatattttcaactttttatcactaagagcaaaaagggtaagcagggcaaatacttagagctgcacttagaaccacactagggatagctctaggggtactctaaccactactaaccatactgcatagtactgcatagagcgtagcgtagtgacgtaacgtaagtgaaggaacgtagtgtagcgtagttaatgcttccctccctacggtcggtcatacagggcattactagtgagtactagtgagtagtagtgtatatagtgccctaaacccctcctactccggttacttcatttcataatagctttcgaatgaaagtaagagcaaagggatagcgctgggatagtggatgtgcgccctagtggggagcgcgcagcgtagcacagaatccgcgcaatgtaaagcactaaggatagccagtggatagcctagtgcatactagggatagcactagggacagcactacagcgcactagctggcccactatggccccactactggccccgctggacaggcacaaaataagcaaggcagagcacgcccctatggcccacagggagcgcacagggataacgcggggatagccctagtgccccatagagcgcacaggaagcgccctagtgaacgcacagggatagccatagggtagcactagcgatagccctagaacgcagcacaggcccgctgaggccctctggtgcgcactagcaggcccactcagtgccccccccccccccccctaaattgacgctaggtaccccctatgggggcaattgggcgcgttcagggtgagggaggggctcgcgtgagtctaataaatttcaggtccaggtatagatctgctcgcctagactgggcctgggctttacgctgtgcgttagaagtgcagcaccaagctagcccgagtagccccaggggtaattgccgcagccccaggattaaacagagtaactttgtaggagctgtacccactgtagctactgacaccagttagcagcccatcaacagacccgttaaataccggagaactcaaaccgacaggggcttgagtaatgccgtacgggagagtctgtacagggctagataccagcgtaccggcagcgacagcaccaggggtccacgcaaagctaaatggaacagaacgagcacgctctactgtaataccatccaggctaagtgtgtttccagtgctgttggtgaagcgcaaatctccgtcacccgttaggctgttacccaagtaaaagtctacatcgaaccaccctggaccagccggtaccgcggcaacagaggagccgccactacccaccgctaaggttatgttaccagtagcgcccgggttgtagactcgcaaggatacgcgcactatagccccgagaaggtgcagcggcaactggtaccgacgcatctcctgacccgcgggaacatccagtgctacagtactagcggctccagccctagcggtacgactagcagcagcagcgccacgcatgtacgcctgcccgataaacccagggccgaacggactatccccgcgcactacgttcatgttcccactgtacacgcgcggagggttgatgcggcaagccctagtactactcagtgaccaggatagaacactgctggcatctgcaatgttcgcatcattgtcgaaggcatctacataaccaccttcaatggtccagaattccccttcgcatccatacgccttgttatcagaaataacaatagggccaacagctccagacctaatacgaatacacccggcatacaggttatggtcggagtccgggcggaagtgcgcaaaaccattacgggtaatccaagagcgcgacagctgtccaaagtccagtacgtgctgtgcagctgtgttagccccgtatggtacactatcccactcaaacttattatccgtaatccacaccaggtccgggttactgtttgctgtactcttaatccatgcgcccgagcacagtccgaacgtgttattctgaatgtgcaggttattgacgttgttattaggaatacctatgtaatccccgaggagtataacgctgccgttagaggcacccatcctacggaataagtttccggagatgtggctctccatacagtcacgtaacaccagcgcagagcccgccaagttattaaaagcagagttttccgccccaaaatagctccaggatgttacctccaccataagtcccgaatcactgctgacagccccctgcagtcgcattctaaggaacccgccgcccattccacgggtgctcgtaccgtcaaagtagaacatcttgctggctgtgctcggtttaacgaatacagccccaagcgggttaacaccctctaggccatcacctataaacagcatagggttagtaaggtggcagtctccaacataataagaccccacaggtactcgcagcacctttacacctttagcggaaatccgctcaatagcggctgcatagttaccggaagaatccggacggagtccggtaagtaccggggcatccttcgctaagtagtcagctactctgcaccacaaatcgtcttggctgtagtaccgtgtttgtacgttctctactagtgccatgtgtcccctcttatcgtttcaattcagccagggctgtgcttacgttcttgtactggttcccgatggctttgctctgccactgcctgcgctcccataggccccagcacactttattgcgctgcccattaatatactgggagcagtcgaaggtccagcggttgctgcccttgtacacccaaccggtgccaggggacttctgctggtacttgctaatatagcgccagtccagtacagcctttccagccgctgcgtaatccaggctcttgagatgccgcttcacagcactgccgttgaagccagctacgcctacgttgtaaatgaagtccacagaccccaccagagatacgtcagagagctgcataggaagcccgtcaagggcctttgcgtgttcccctgctgactgtatcagttgcttctgacaatcgctcagcgtggctctctgacccatcttgacgccctttgtctccccatagcagatagtagggaccccggcgctatccttgtaggcggtaaggctcaggccctcgttgtgctgaaccaccccggtaatggcaccgccaagcatagtggcccccgtaagggccgcaataaccttagtccttaaactcatatttaatagtccccttacgtgcctgctcctctaggagcttgaatgtacgtctcttgtaatacgcattccacgccagggttagcaccgcgcacaccgtcgcagtgatgaagctgatagtgctccagttccagctcattaactctgccaaccaacctcctgataccgtagcgccggtaactgccgcacctgcccgggtagcgaggtctgccccaactacgtcccctaccttaatcatcctgctgctccttcttcctgaacagcttacgaatcaccagaatgaccactaggaagaccagaggaatgctggccccagctaatccggcgaggataagactgtaactatcattgttaaccacctgcaggcgccctgcctggattgtaccggcgctaatagtttgcacctgctccttactggacgtgtccaaagtgcctacgttagaatctgatacatcggttttgttggtggtgctggagtccaccttgttattcaagccaacggtttgcttggtgttttcggcaccaacctgagcagatacatccggcttagaaccaactaagccggtgagtgcagaggtcgccgagcaaccagtcagagtaaccgcgagcagtaacccagcgaccagtttacgcattagctagcagccttcactgcggctaccgcggcttctagcgcagcaatcttggtatcgaaggtagcacccgtctgggccacgtcctgcggctgcgtaagcatagcatacaggtccttaccgagaatgttcagctggcgcagcagctcctgctgttgcgctggggttgcttttgcaattgccatagtattgctccttactcaacagagattgctgtgattacaccatcttctacagtgatagttgctgctacagtagcggtagcccccgcctcccgagcggtggtgaacgtaataggtgcagttacttctgcgccgttaccaaccaccactacagcaccaccgtcagaggctcctgcagcagagagtgccgccactgctacagcccctgctgcatctacatcaggacccagagtatctagtgggccggtatcatgcgccaaggttgttgctttatcaagcgccactgccgcattacgtactgcctggcgctgtgccagtgttgcttctgcaaatgccattatcttcttcctctatgttgtttacctctgccacggttctgcaacctagcagccacaccccgaaggcccttagacactttgctctgtgcccaatccagcgggttctcaatgaaggcccgagccatcttctcagactcacgctcagccaccactttctcatcttccaccaggtgcccgttcagcgtagccaccatcatagcgattgcgtctgctcggtcgtccttagctaggctaccgcggtcgtacgtgatgccggacaactgcgcgaacgcggagtacagccaacgtctatcgcgggagtatgccatacaggtactaatgtcgtcgtggatagcacgctcgtgcactaccaggcggtgccgacgagtaactgggctgattgtgtcaatgatacgacgctctttctgcgtggagttattcaggtcccttacgccaataccggcgagacgccgctcccgcagacggttcaggataagcatagacacggtaccgtgccccatgttgctctccacaaccatatccgggatatctaactctacgcataggtcaatcagtttatcaatgttctcttcgctgatacctccttggaagccgcctacggagaataggtggatgtacgagttcgcagcaccaccagcagcgtaagacacttcgtccccgccacacccagccgggtccaccaccagcaccttatgctggtacggcaggtgcatgtccccgtagaatgccgggaagtacatctgctggcccataatcccctcatgctcatgctggtacaggtaccggcggtccgcgatgtaggagaacgtctcaggggaggaatcctggctaccagagtaaaccagcatatccgaaagcttgatgcgcgtacgcatttggtcggacagtgtagtgtcgagcatgtactgcagctggaagccttccggaccgaagtccagctccttctcaatcagtgcatcctcgtcgtagcgtccggtgtccgtgctctcgcctagcgtcccgtcgacgccgaagccggtgcgtttatagccgcgctcaataagctccaggatataaggagcaagtgtacttccatatcgctcttccatttcaacagacggaatgcgcccgggccacacgcggacctcgaagccgcgtcccggcagggttttatagatactgtccttggtctgcggtgtgcccaggtacagcgtatccccgtgcgtacagatagctgcgaagtctttagaaatcatcagcagctgctcacgctgggtttgcgttaaaccgttcttagtggtctcgatatcatccggaatcagcaggtccgcgcgcttcccctgcagggatgcagtgatacctacacaggctacgctggcggatttatccagcggtttcaggtcgcagttgacatcatagccttcgaatgaagtacggtccccacgagtagggtcggcctttaagtagcacagtagaggccaggtttctagcatacgaatgattaagttcgctacgtcagaggcctgcttctctgcaccggacacaatcaggatacgacaggattggtcctggatgagcctccagacggcgtacagtgcagctagtgtagacttagcctcaccacgctgtgcggccaccatgcgcttcctagggcccttctgcatgtactctgcaatgtcggcctgcatgtccgtcaacgtaaaacccaggaaccgcatacctatgtatgcgaattcccggaagtcacttagcgccgcggccatcatcatcgcgatgtcctcgcgctcctctttgggaatactgcgcggattcgcactataaccagtaagtttctggttgagcatgcgcagtcttcgcgcagtcttcaccgataccattagacaattccttctagtaagtcctcagagtctgaaccaccaactttatttagaatttcttgcttacgcgcctctctacgcgccgctagttcatcatcgaactcgtcacgaaggtcctgcatctcctcggaatctgcatccgcggtgatgtcgttgtccttcaagaacttggcgataaccgatttatctgcggcggggagcggcacctcgtcttccttagactgcttgatttcttcaatcaaggcctcagtgaacatgcggtgcagctccgagaggcgactgcgtttagccgcccctgccattgtgcctccagtaattatttaagttttgataatcccagcacttctcagctccgctaacagggcgtttagctgggtggcaacgttgctggtgtcggtactatccgccacagcgtttgccgggcccttgtacgccagttcgcctactgaggccagccagttgtcaaaagctgcctgggttacatacccatcgcccgcctctacatctgcgcccagcctagccgccacgagcgtaccggccggtagcgtctccgcaaacagcaacgaatttcccactaccacaaagctgtagccggggatttggccctgcccattcagctcaactatggccttactaaaagcgatgggcggcgtcacggtgtctgtgggggtatccagtactgtaaaccaagggtagcttacagtgaccctgtcggatataaaggtctgctctagattagttactcgggtatccaggatagcgtcggcagactttctagcagcctcttccgcatccaccctttggtccagacgggcgtcgccggaatcgacgtaacccttgttagtggcgtccgcagtgtccactgggtctcctaggtgggtgattcgatatccgtgcatactgatatcgccgtagaagccctcaatagaacgcccctcaactagctcttgagccaggtgcaggaactgcgtattctgggtatctacgttgccttcaataaacggagcaccgctagagaattcaatgtaaagatactctcgttcagtcttacgaattaggagcaccactgtctctgcagacagtggcgagttcagacgaatattggtggagctggtccaagtgaaggcagtagtctcagcaccatctaagtaaacgtgaatataggacttatccaggtactcgatatcgcactggatatcctgagtacctgcaggctttaccgactcttgccagctgaacgccatattaatcgtctccgaagttattgatgatagctcgcgtaggtgcgaattcctggattagcggtacctgcttagtgaaggtcttgatatccatattaccggtagccaggtcctgtacggccccgagcagccctgtgacgtaacccatagatgccaacgagtgacgaggagaatctcccaggaaaatatcctgcagtaaggataccccgccgatggcactcatacccgttacggattcactgatgagtttctgggtgtctacatcctttccgtccatgccatgcttggccatagtagccagcagcatcaacgggaactggtacgccataatgtgggccacaccaatccacccagcatcgttcagctctctacgcagaatcttgttagtggcagccagtgcgaagctctggtaccctacaatgactttgccgataggattgaactgcgcaaagtgcgaggtctcgccggtacgaatctgctgtaccaggtagtccatcatacgcgtccctacaacctcaacttgcatctgcaggtccggctggaacatggcgcccgggttagccttgttggcagcgatagcgcggtccgcaacgtcacgggtaagcccgaaacgctccagacgcttaaacgcctcagcatcgcccttgaacatctgcgtaagctcatccgccacaatgccggagttcaggttaacctgcagccggtgcaccatactcattccgttgacgtgacgtgcagcctgcccaacgttctgagtgacgttgaaccaggaggcctgacgggtcaggtccaggttatcgtcggcgtacgtattcaaccagcggaagcgcatctccttctggatattaccacgcagcacagtgtctagacgggcagccatatccggagtcttgatagctacggcaccttccttgaaccaaggctggtcacgcatactgcgcagcactctagccataccgaactccttcatggccaaagcagtatcagtcagctgatataggccggagttcttaagcatggtggcgttagccatgttcccggctgcacgcagcaaatccggaagctgtccagcgtcagcaggtgccccacccaggataaagtcgatggtgtcattgacggtcttctcccacttagcggaatccgctagcgcgtgcttagactcatcaatcatcttagcgagctgtcccaggtcctgtacgcctgcataggccatgcctacacgcccagacatacggttagtgtacccgtgcataaccttggctacatcagtatccatcaggtcctgcatgcgcatgctcttaccgttcaccagatactctttgtccatgttgaaccgagtacgctgacgcagattccgcgcaggggatgtgctaccggatttgcgtacgttaccagccaggaaactctggattgcagactcatctacaccagcgctacgcatagccataacgacctcgtcgttacccataccgttaatcagctgcttccacatagggccagactgcccggcgcggccattatagataccgtcaaccatctccttggcaacacgctgcactacccctgactccatgctcgggtacacgtcccgcagggcggaccggaacagggcgcggtagtcgtccagagtgttaccctgtgcgataccttgacgcatcttgtcatagctgtactgacgcgggaagtagtagtcggatttaaccaacgcaccatcatccactagacctgcattgagcatatgctcgtgccacttgctagcccagccagagcggcgataggcgtcaaccagtggagcaatctctgcatctggcaccggcacagcgcggccatttacatcagcactgtaggcagcatccaggtacttgctcaggcggtcttccagtgcagcccgctcagcgcggaacttgctccgatggaagaagcgctcagagaaacctacacccttatccttcaacgcacccaggatagcgtcttccactacgctggcgctggcgtccatctccaaagtaaggttgcgtttgaagtccactacggacgggcgacgaccccctacggcggacgcatccgacactagcagcttagccaagtcttcgttgccttgggcgatgttatcgtacagggcaaacatagtggagagcttcttcttagcgccgtccagcatagcttgggcacccttagcctcgttgagggtagtgctgcccgccaggtcctggaaggcttcgctacggaagctctgggcttggtctgcgtagtccttagctgtccacttaacggcgtcctcatacgcatccaggacgtcctccaaggcagagcctttggccttgatgcccagggcgttcatgatgtactcgcccagttggcggagcatgctcttaccggttggggatttcgtccgcgccagatgctcaacccactcagggctgtcgcctaagcctgccagcatctcgtgcacattacttgcgtaatatcgcatacgcggtgtcagggtggaatcagccgcaataacagcgcgcacttcctccaggcgtttagcaatctcgggattactgtcaatagcgcgcgcagtagcggcatgaatcagttcgtgcacggccaccttgcttgtatctgcatccatagcgcgcagcgcatcaccgactgtagtccaggtgctgccgttagcttgcttaggcgcgcgcagggatatctctccccgcttagctaaatcttgttgtgcataagtgtagcggctgcggtttgcggagcctgctactagtttaaaatcaatgtcatttacagcatcgcccagcgtgtccagaatagccttctgtcctgctgtcaagtgctcagacttcttcaagaactgaactacgtgctgtgctttcatgttcacggaggcggtattgtttctcgatacttggatgctttcatccagtgtcttagtgagaatttcctctccctctcctactccggtaacattagcatccctcgctgtacgagttgtaggcgcttctgggtcgaacataggctcacgcccagtacgagccttagcggcagctttagcagccctagacatatcccagagctggtctaacccagctacgcccgctaccagtgcagttaccgcagcagactgccccagttggtcctgtgcgtagaatgcggaccctacgtcagcggcgcggatagcggtacgtgcagctaagcccgcacgaccagcaataccagcagcagacatcggagccaggatgaacggggagtcgcctaccagcatgcccgcgaacccagctactgtgttgtcagccattaagcggtcacggtcgcgttgctcaagcatttgctgcatgcggtagttgtaatcctctaccgacaccgagtcgtgcaagtactcaatctcttcctgatttggagcatacagcttagctctggtgtcgctgctcagagtctgcttggcgttaaagttctggtcccggtcaaatgccggggcagaggccttacggatagccgcagcgatgatactgttgcccatacctgatgcaaagctctccccggctgtagtggctggggtcttggcctgcgccagtaatgaggcacgttccagtgcatttaggccgttgtctccggcatcgttccaatctacgcgctcaggcgcaggtttaagtgttgcgcccttagcagaatccttttcctgtggattcggttcttggttcagaaactgagccataatatctcctaaaagaattttgataaggggaggccccgaagggcctctggttagtgcgttgcttcaaagagccaatcacgtaggttttgttccaggtacttcttacgctcaggttgggcctgcttgtacgcagcggtattccgcagcgcttgccaagccctaccctgggcctcagatacagggtactgatacgcccccaccggggacttagcagccttgcgcacctgtgccatcgcctctgctacggggccagagctaccgttaccgccgtgatagttcaggtccaccatgacctttaacgcctcgtcggaggcagtcaaaccctgtcccttgagttgcttctgcacgttcggtatgtactgcttctccagtgaggatttgaggatactgacaccgtcgtcaatggtcactttctgtgggacgggcatgcccgagttaacgtgcagaccgaaacctacactacccttgcctttgccttcccggaacccttcgaacttcatagtggtagcgagaatgtcgctaaacagcgacggctccagccctaccgagttacggccgttgacctgtacgctgacagcacgcccgttgtcgtggtcgtagaaggtggcgggacgcactcctacttgctcactgccaatcttcatatctccagccagtgccgaatcgtacgcagcctgcgcagtcgtctgaacgtctcgaaggttcacagacatcgtctggaaggtgcccttcttgtcgaacacggttacggtcatgttctgacctgcgttgcccgcagtggcggcctgcactactacacgctctatgttgctgtggtctgacatatactgaacctggttctgtatatgctgctgcagggaggccttgaattgctcttggtcgcccttataatcacccatgatagattgcacagaggtgcccgcgggcagatacacatgcctaggtgccccagcaatgtccagctctaacttacgggattggatattgccttttagcatcgtattgatgtcgtcagcgtccttccctacaagggattccgggttgtgattatacatataacggtactcctcttccatagcagcgcgagcttcctggcgctgggcatctgcatccccgaagaagctaaaccagttggccgtgccacttgggtccaccatcttgtccgtggggttactctggatattgctgtagcgcccactggccttattgcgtgcctggcggcgaaggtcgtccaagatagtgttactggcattatttgggttttgtgtaacagctttctgcaccactccacgccactcagatgggacctcagacagcagcgccatcttccctaagtccgtactggtgctataagcctgtgcccataagttgatgctatttacgttctcgcgggaaacctcaccatcctcaccgagctggtccagcgtagtcagcgtacgtgccatatccaaagacatacgcttgtgcgcttcgttgactgcccacgcatccttgctgttgctcccgtatgccagcagctgcaggttcccttccggggtgtccggaaagcttttgagcagctcgttgcgcgccttacccaggtcgcccttgtacatccccgccagggtggagcttggcatgtttccagtaattgctgtgcgcaatgcctgggtgtccgctgccttctcgcgaatggtctgggccttgttccagaactccatgctggccccagcgctgagcaccccattggttgactgctcaatgattcgaccacggatacgctgcatagtctgctcttgctgctcaggagtctgcccttcaagagactggattgcatcggagatttcgaaacgggcttgggtctcaatctgagcacctgcgcgcttgaactcctgatacagtgccgcgttgacgtccactgagttaaccccgagttccttggtagctaactcttgcagctggtttattaccatcgggtcctgcgtctgctgcgccacgctgaccagatactgcttggcccggtccagcttcttgctcttatccaagtgctcagcagccagtatgctatctaaaccggtcttgatagacatctgcgcagcggcaccctgtcccgcctgcaggcgctgatagaactcatcactggacgagctaaggccgcggtcgagtgcacggtcagcctgcgccagggcaaacgcagctctacctttctggaaggctgtgtagttcgccatgctggtagcacggagctgctgcagtatattcgtggcagactgtttggacatgtccgggagatacatcccgagcttgtctgccattgactgtacgtgctcttgctcctgctgctggaattcctcgtcagtcagaccagactcagcagctttcttagctcgtgcgatgctatctgtgcgccacttggctagagagtcgtacgcggcggcggatacgtagccatcctgataggcctcgcgtacgaagatgttctgcttctgtacagcctcatctttggaagccattgcatctactgcgccctgggcatccattgcgccgcgcaccgttgcggctgcagcgttttcttttactgcttcgtcaaaccctacgccgaagtcctgcacgaaccctgacagggcagctaggcgttttgctttggaggtatcaacagacacctcacttaccgttgacggtaagctaacatcgttggactgcagttgcactcctccgatacttaacccctgtctactgggttgaatcacaggcatttgacattcctcttaagttaccaggtatgaactgagctgttacctttgctcccccataaatcataggaggacgccatgttctgagtagctgctgcaccacttccgggtgttgagctaccagagtcagtagacgacgcagcgttaccagcgtactgcccaacggcagatgccccgacactcaacaacgagttaaacatgttatcgtaggggtcctccatgtccatgttagccaggccgctgtccacggccttgtccgtcattagacggaaaccctcttcctgagttgcctgctggtcacgcacgctggcctcttgtcgtccggctacagtgttcactgtggctacggcgtctttaacagaggcccccatagtaccggaagctgctgcctgcagccctacttggctctgtgcctgcagcttctgctgctggatgttaaacagagatacctcagtccggtccctggactgggctcgctgtagcgcgatgtcgtttagctgtttggctgtctgttgaatcacagccttgttcctggccttggacacttcaatctgagcaccatgccccagaacggtcttagcggccatggccgcaaccatccaccacatattaaattctccgtctgcgttggttgtagcgcaggatgtacgagatatccagcacattcagttccatagaaccctcagtaaataatgacacctcggttgtgtctgcgttagtacggcatggcacggtaatcgtagccaggtccatacgcaggacctgcccgagcgtcagctcttttgagttcatcaggatacctgtcagttccccgccccagttgacatcccgtggggtgtctagtacctgcacatcgaagtgcccagagttacgtaccgccacatccaggcgcagcaggcgcacgtgcccactccccacgagcttgtcattctggtcccgcagaataggtgtagttagcgtgaacgtactgcggtaacgcctcccgattacgtaggtgccatcaggtacaccgcgtacaacccgcagggtgttctccccggcaatctcctttatgccaacctcagtaggtcccatagggttactgggcaagtaagttaggataagctcttcctcatagcggtcagcccacccaactggacgcagtactgccggaacggtgaataccccgtcctgtacttgaacttgcttctgcaaatccgagtacgcttcgcgatactccgaacccagctggtaaccttcacgcgggtccatagacacaatcaaaagcttgttgctgggactgggcccttgcatgtacaagaacacttcatcctccagcgcttgtacgctcaggattggatacgggaacgaccacttatgccacgccgcctgcatcttagcgccgtcacttccgccccacatgaactcgtagaccagcaagctactacgctccccagacatgcgcgagaaggccatattggtgacactggagttttgcatctgcaataccctgcctgggatataccgcggtaagtgcaccgtagaatcctgtgtagtatactgcgatgaagtatacggcgatgggatcaactcaagaatacccgcgtagctgtcgttgcgcttgttcgggtaaattactgtctgccctgccatgaccggagtaacgcgactatcgcactcataggtgctggtaatgctaatacttgcgttagtgggggtgagcactgctgaacccggcacaacggcctgcatgctgttagcaaacaggaccaggtccctgttaaactgtacagcggtacggtacacagaatcctgcgcagacgcagagctaatactgatacggtccgtatccagcagtgacgtcacagtagagcggtagaagcgctgatacaggcccgaggcggacatatccacagagctgccgctaagcagaaccaggcgaccctggaaagctgcaatgccagtaatgtagccattctcgacgaaccccggattaccgttgttatcgtcgttgcctgctaagcgcccttcccaatcccgcgcaataatattgtcatccgcggcaagttctctgggcatgttcgtaatcttggtgatgctgccgtacgcccccacctcagaccaggtgcgggtgctgtagctgaactgataccacgctgtctcagacgaggctgtacctacacggcacattgctccgtcagcttgcgctgggagctgtgcaggcaggtcctgctcctgatctacacgggactggttggataccccagcgtaagtatcaccggcgtcagaggacaccacgcagttgctcagtccatagaagaacaggtacgcaccgcgtacgctcacgttcccggcgggcatgccattagctacaagagagtcccgcagctgctgagcaacgtaggcacctgatacctcctcagcgttaccgctggtgctgccagcagctggggcggtgtagtcccctgagtagtctacccctgcggaggtaactgtgacgttccagcgtttctggaatgctgcagacttaacgtagaagaaccccgtggtgctggggtcgatacgcccagtattgtccacggttgtgctaggagccatctccgtattcaggatataagtcagtccggcaatgcttgcggtctgcaaagaggtctggcctacggtggtaacgaagtacgggtcgttgccggaattaaggatggtctttccattcttagccagcaaccaccagttaccgttgctggtgttaatcagcaggtgcctaccgtcagtgccacgctcgacgtattcagtgaacagggagtcaagcccagggttatcgattgtgctttcccatacaatctcacccggcggtctacggcggataccggaaaccgggtcgctgagcatattcagctgcgcccccagttgtcctggttggcgctctctcggaacctgctgggaaacgccctgcagcaagctctgaatagtaccttctaatgattgcgccataacctctccttagaccataaaacgagcgcggcggattctgcgtgcaaaacgggtcttgctggtgctgaacttctgattgcgcagatgctcgcgcagcaccatgctcttgtaccgctcagcttcctgtgcgtaattagcgtagttgctgtcaccgcccaggtcatttaagtatacctgcgcagtggtgtagttagccacccacatagcggcgtgctccggcaggtcctcaaaggccaaatccagtaccacacgaatacgcacaggcgcatcgaagtattggttctgctctaccaggtcgtataggttcccgtcacgtaccccgtacttggattctgagcaggcgtcatatacagccagctggttccacggcaccttaatcaggccgtcggtggtgggcgtaacttcacgctcgaccacgttaaaccagaatcctgtgctgagcaacccacgacggttacgtgcaagtgcagagcgagctaatccagcgctagggttactagtgttgatgtccataacgcgggactcccccagggcttccagcgtcaggttcacagcgtctaattctctcatatttgttcctctattaaagaccccttggacctttaagacagggacaaaaaaaaagcccctggcacccgaaggcaccaggggcgcgtattactcttccgcagtatcagcggctgcatcagccgccttacgggttttcttggtagccttgcggccagactcgaccgaggccacctggatgttcttcgctacatcggtggcggccttaaccgcctcccgctgagctgcattggcctggagagtctccagaccgaacgtagcgattactgccattgaacctccaattaggacttggtggtgaaggtgaacttagtcactgcagcggtgtccggacgacgcagacctatgttgtacatcgcgtagcagtccagtacgttgctgaactcgcgcgtatcgtcccagatgcgggaggtgaacggcttagcttcaacagtcaccagggtcttggacttgctgaaagtcaccatacggcacagcgcgtcgtctgcggtgacagtgtaagcagagcccagcggatgcgtaccagcctcggtcgggaactcggtgcactctactacaggtacgccgttcatcttcactacacgacggtctttgtaaccgtcgttgttggacggaccgaattcgatgttcaggagcttcggatgctccagcagacgcgaataggtatcgacatccaccagagtgaccatatccgccagcggggtcttgcgcttgatgagctcatcaataccagccttgtgcgccaggttgatgttcatggcgttagcctccatctcagcctgggtcagctgcgtggcggtagtggtacccggaaccaggatagctgcgcctacctctataccgtcgttgaacgccggtttcaggtgcgccggagcaacccaggaacggcccttgatgagctgaatcaggtgcgcctggtcgaaggtctctgcgaactcagagccgttgttctggcccatctcggttaggaagtccggaccggtccagtcatcctggtagtcaatcgggttacggatatacagcaccgtatccaccacgataatcatcttatcgttacgaaccggggtgctatccagcgcctcgccggagcgacgacccttcaccgaggaggtgttcaagcggtcaatacggtaggtgttagaaccgctgatagagcgctggctggagagtcccaggaatagagcctggtactggaagcgggtatccacttcgttctgatacacttccaggtgaatgtctacgtcagacgccgcgccgccccagtgcggacgagtcaggttgccattataaatagtgttagccatgccttagtttcctttataaataaaattaaagacctacgcgcttaccagcctcacggcgtgcgagcaaatcattataacgttgactgaactgcggagatgccaagctacggttgcccgcttcctgacggagtttggtatattctgcacggaagtccgcagcagataatgcgttgttgctggctacgccccgtaccattgggttctgtgtcttgataagacccatatcccggcagaagcccgctaccaactcagcggcctgcttaagctcaccagcgttagcgagtacacgagctgcgttacgcagaggttcaggagccttggaattaaacagctgtgctgctacctcccagttctccttcccgcccacaatatcgtaagcttcctgcactgccttggtggcttgtccaacctggtcttccaggtacgccttagccaacagctctgcgtaagcagcgtgctcgccgaaacgttccttaatgaaggccgtatcgattaggttagggtcctgatactccagggccttaccaagtgcccgcaccatatcagagtcagttaacccagatacttgcttcaacatagctaccccggcgtcaatcgtcggattgcctgtctgagccagctcctggggctgctccttagcgctatcgccacccttatccagggctgcttttagggcttcgatatccagaggaatcttagcaggttcaggggaatctttgccctgttgctgctgggtaggtgcgggcgcatcctgcacgccttgattgttcggggcgttaaggggagcacctaggcccggaatcttagggccaccttggttctctacctgtgtagtttctacgttctgaccgttttctacgttatccatctatgcctctgttgttaacttggtaataagcccagctgcttacctgctactgttgggtctgctgctgtcaagccctggagttggtcctgtgctgcacctgcggatacatcggcagacgcatcttgaacttcttgcttctgttgcagctgctcttctgtgtacatgaacggctcgctgacgataccgtaggcgtcgaagtaccagtctacgcacgcatccttgttgaagcgtggagtaatctgctccagcaccgggatagccagttgcatggactgcgctgcctctagcagcttatccgctgctgcggctttagccagtgcagaggtacccaccgtaacgttgatgctcactacaccttcgctgaggtacagcttaaagcgaggatataccagtgcagtgtacaggtacgccagcttacgcagccatgtgtcgctcagaatactgaacccgccacccatagcggcttccgcctctttggcattctggcgaatctcgtaagccgtgacgcgctcaccttgccgggagttaccggtgtacataaacgcacgcgacagtttctgttcgagcatctgaatgttgctggcaatccactgaatcttctgggcagagccaccctcgtaagcagtgacgggggatttgctgttcccgttggaaccgccgccgcccacctgcacagcctcgccagtctccgacgttgcgaactcgtccacgtctaacccagagcttgcgtcaatcagcgggattaacctcgcagactcaacctcgtagttagtcaacgcttccgacagtaccgataatctggcgaagtccccggcgtagtcctctaccaagccgcgcccgtagtgttcgccgctaacaaggttccacaccagcacgttgtagggaagctccagctccggataggtgctgctgtctccaatgcggtgcccgtctgcttcttggtacacctcgtagcttactacctctgcaccgtcctctgtccgcttaactttgcgacaagaggcagtgtagatatcaacgtcgccgtatgggtctttgtcacggtagaaggtgttccggaaactctctggcaggtcctggacgcttgcgcgctctctgataatgagtcgcaggacgttaccgcttccatcccttcgaacggtaaagttacggactgaatagacgatggatttacctgtccgctcatcaatatactccaacgcgttacctgtaaccagcagcagcttcacagcctgcaacttcgcagcataaccgtctttctcaaatactttctgtgacgccgtgttctcgacctcggccaacttagattctgccgtagcagcactgcccagcgaactaatgaactcgtccaggtccgaactcttggagaaccggaagaagctagtgccttgcgggaacagcgcgcctacaatcttagtggctgcagtgttgaccagctgcgcccctgtgctctggtaatcacgctccaggggcctgcgtctaccgtccagggaatcgtcccgggtaaagatagtgctgagcgtccactgcgcaaacttctcagaggcatccaagacacccgcgtcctggtccttcttaaagagttctgctaatgttgctttttgttccaagctacccccttacaggcccagaggattgctctgccctgcttgtcgccgtttcttctgctcagacgtaattgcctctgcagatgcagaggcagcccctgcggggtcaatctcagcaatgttatctgcggcgctattagcctctaaggcagcctgttgtttagctgcgctggcctgttgctctgccaagcgctgctgcgcctctaatcctgcgttgtcagtaaggccgagcatatccgtggccttgcctaacagtttacctaaaccaccactcattctgacctcactaaatgataagttgtattgtatgtgttatccgatgcacctcggctaatggcgatacgcccagcccgcatactcttagctattgcgcgaaggccctgcataatcacaagtaccgccttactgttacccggcttcaatacgaagaagtctgtatacagcacaggctctacgtaatgacagtcctctacagcttctgggtagtagcttacagcaccgactaagtcgccttgggagtcatagactcctagtatatactgtttacccagtatgctgcccagtactctccagtagtgctgctctggagctaggccccgactaatgccgtggcccagttcgtgtagttgcctcactgcgtctgtaatgtcgtcagacttatacagaaccttgagagtgtaatcggaagttttactagtgtgttttaacttcattcctactccggtaacttcatttatcagcagaagaagaaaggcgattccagtacttgccggatgtccagagtacctacctcgggcatatccaggtccgtcaagtccgccccggctgctgctgctgcgcgagtaatatccccaagcaggtcgtgctcttcgtataggctcacaaactgttcgcggatgtgtcggtgcatagcgtcaacgtcagctgcatgtgtagccagcgagtcgtgaataggcacgatgtccaacccttccgcggcacacagaaccatcatcaagtgcgtactgtccaggctatgcacaaagttcggggcaatcccagaggctgccttgcgcttgttacaggtcttgaaatcccggttatgcacccgcatgacggtgaggttcatgcagtcaatgcgtacccgcacttcttcacgctgcgtgtaacggttcattacaagcccacccagcggcgtataccactgcagatgctggcttgccggtacgcgtctagcgaggttctgcaagtaccccataactgccgcagcagctgggttcgcctcttcgatagcggtacgcatacgcggcgccaggtagcacgacaggttccacaggctgttagtctcggcaccctcgtatccctcggcgcaagcaccttcgaagatgtagtcgctgcagctgcgcaccgtagcgctgtagaaataggtcatactggggcgcttggtcatactgcgggtgatttcgttctctctccagtacgtgctctggataacgaaatcctccttgtccaggtccagtatcaccttctcgtccgtacggcgcttcacgtccatgtacaggtcagctttcttatagttaccctcccagtacaggttcgtcagacgcccgcccacagggtctctcaggagcgctgagagatgctgcccacctgagtttgtagcgtccatagcaactgggattcggctaatatgctcttctgggcatccagaacgcacagcattaaccaggtcgatagcggcggccaataggcaccaagggctgtccgcggaggtgaaagcagggcaatcaaacggtgaaactgtaagctgctcaatctctgcaaagttcgcatcaacccaagctgcgcggtcttcgaataaggtcttgtcataaccaaagcatgtggcgacatgcaccttgagccagaataagccgcgatcacccagaggttttcctctgccaaactcaagaagggctttctgcaaatcagaaccttgagggtgcagcgaggacttgaagtacaaccggtaccgccaatccacgcaggttgggaagtacagagctttctcatctttgaattcctctgccatttctaacgtagtcaaaaggctgcgcagttgcgacacacgcttacggtctgcgctgtaccacagggacatgcgcgtcttccactcaccaaaacggtcaagctcttcctctgtgtagttctcttttggaacaccatccaagtaccactccggtttcggctccggtactgagcgcggcatgcctatcccaacacccatggcccgtgcttcttgcaccagttccagtatgcgcttattaatacggtacggggtttcctgtgccttattaagcgcttttttaatgccatccgcggacttaaatgcttccgctacttcacggagacgagctctgtcaatgtgcgagttatgataggtcccgcgattgtcgataggggtgaggtatccaccatcccacagagtagtgtgctgcaccggcggtaccagcataggcggcttcatggttacagtgtcagcggactctaccagtttctggaaggcctccataacgtcgtcagccggatagagcatgctcagattcccgctacagttcttccactggaacaggcccgtctcaaacaccgcggcacacagcagacgccctacggagatgttctgggcattggtccaaggctcgtgcccatagtgcacgttctcggcactggcgcggagcgtacgcaggatgtgcgtaggggacttcgtacggcgctctgtgaggtactcatacacacggtccatgtacgcaggggctacgttgcgtaactgcagagccagtagctctgactgtacgtttctgcccagtgcggacattaccgcctgtgcagtctgacggcgactggcggactcgccaggggcgacgctgaacgcctcaaacattgtgcacaggctcagagtggtcaggacgtccaaggggactaagcgcaggaaccgtcggtacttaccaccaatgcccggggctttgacatttcgcatctcatcgatagcggcagcagccacctcatatgccgaggtgagcatacgctgcgtcatcggcaggttcataatcccgccattctgcagtgcgtccgtaatcagcttacgtgcccgctcgattccgcgaatcttataggtctcttcaagctccagctggcgcttcaccagtgcttcctcgggtactacaaccgtattcagggcgctaatcataggcgcttagtctccttggttatgtccggtacttctaactactgattgcgactcacccagagattgtacatctccagatagtctttagcggagctttcgtcgccccgttctactgctttctgccacatcccgtggcaccatgcgctaggcgtcaatgcacttacctcggtgttgctcgtacagttctgagtacttgtcggacttggcaatgtcctgctccagcttatccttgttcccggcgcgcagtctgtacttgagccggttccccaggcagtatccgtagaactgctctttcgtcatactgcgtgcaatcacctcaattgcctccaggtccgggaagaactggtagtgccgaggagagttcactgagtcagaaacagcctcgctcttcgaatggaagagctggaagaactccgctcgccaagaggtcccacactcggctaaggttataagtccgtcttctgcgcacgtcactaatctgggggagtctaggtctacctgtagctgttcacagatgtccttccagataccccctacgtgactcgctttgcgcacaaccaaatcacctgcatagaatttagtggattcaatcatttaatagtctcccgtgctttgcgtcgtgcccgggccttgcgggccttgagcttctgtgcttgtgctagttcttccggcgtcttgtgcgtatagtatagcatatccgtaggttctcggtctaagtaatcggcgaccctacgtagagattcagcaatagccccagaagattgcatgctaccaacaatccagcgcccagcggcagatgccactttgccttcccctccattgcacgagcgatgaagagcaccccgaatacgcccagtaatatgacagtggtcaacgacaacagaatcaccagttacccccttgattgtgaagtccaaaggtttgccgcagaggaggcatatacctccctggtctttggcaagcttaatagccacagagcgaatctgtgctcgagttattttacgcagcgccatgaaatccctcttaacatatgatataccgtactttgagccatacccaggcgtctagctatagcgttgctaccccattcccggtccccaggaatgtgcatttgccgcagatagcgcaccgtaccttcgttcaaacgtgagcggccgctgctggaaccctttgctgatttgcttttgtgggtccctccatgcaggtgctcagggttaatgcagcgagaatttccacaggtgtgctgtactacttcgggccactctcctgtgtgttcatagtacgccttcctgtgtgcggttgtaggttggcgtttaccgtcaataagcacccacgcggataggaacccagtctttggccgcccctttctcccatggtctatacaaggtgtactcattaccatacctcaatccccccaactacatccagcatagcattgtcgtgaatgagagaatccaaatgctcaaccgttcttcgatgtgttttgggtgctcgttcacgcagcgcatccagaatagtttcaagttcatcgtgtttcccctcgtagtataactcaatcgcccgcaggctcatttccttcgcagacatcttcgccattgtctgggtgctcctgtatccactgtatatgctgtttatggtactcgtgcagcgaatgcacccagtcacgcagactgggagtagtcaacagtgacatcagatactgataggcagaatctgacggggagcgccgcaggaacaggcattctgcctctgcgagtacgtcttggttgtttcgagcgtaagccgctacgacgaattctgcggcgtcctgctctgaggtaatagggtagatagcatcaaaggccgttcgcttgccacagggcttcccatcaagcaacgtgatgcctttgacgttatctgcgtcgtcccctgctagcatctgccaccagaagaacttcaacccgtgtgctcgtacaggcatagcctgggtgtcatcccacttaatccatccgaatgggtcctccagtgcaggccacactgtacctgtcagtatatcgaaccgagccatagggctgagccaagaatccttgtcctgggacatcaggattccccggtctccgaagctgtacgaatccattacaaagaggtcgtcggcctcgaagtagtcactgctgactacctgaataccctgctcagaatactggtctgggttctcaatcaggtgccgcttcaacggtgccttgagcggtagctcctgtcgattagcgcgctgcccctgatagggcttagccgtaggcaggtgccagcgcaagcacttagcacatcctgcaggcgtcaggtacgccactgcctctgagcagccgaccaggaacatgtcctcaagcaccagctgatagaagcggcgtattgcggtatccaaacgttttactgtagcggcggctttgtacacgcaaaaatccgcatcgtacagcagaatcttcccagagttctgcggagctaactgctcgctaagctgggacaagtcaaccccgttgataatcatcagcgccccgtaatatcgcgggccttcttgtcggcccagttaacccaacgttctgcccactttgccttgctcagcttatcgccaaggtagcacagtcccgccaatggaatcagcgggagaatcaaagctacgtaaattgcgcgagatacgtacaacatacttaagcctccagttcagacagcaccagcacggtgccgagcatgtccccgattacttccggagtacgcaggctctggtctacgtcgtagatacaggagccaatctccgccaggccaacgctgagcgtgcccactacgcggataagtacaaggtcgtctcctcgtaacttatcggcatgtgccgccagatcgttgtgctcccggaaggctgtagcggccaggtccaggtccattccgtacagggccgccagctcatctagtgcgttgtagatgtcgtccagactaatattaagcaccccatacgccgctgcatcgtataccgctgagccgaccgtaatggcaaggttctcgtacgcttctaatactttatccattagtcaaatcctttcagtttgtgtttttgaatgaaggcgtaggctttggtctcagtggccgtggcctctgcgcccagggcgtatgcactgcgccgggacttggcgcactggcgattcaagtgataacgctgcgcactaatctcgggacccagaaggcttgccctgtatgcgtgagagctagctgcccagcgccagtcgtctgctcgcttctgcaaacgctgtgcgcgcagaagcagaaacacagcgtactgttctttggcccatgtgattatgcgcatttataccccccaggaagttagctacttcgtcacgcttggcacgcaggttatcagcatgacaagcatgcgcttctgctacctctttgctgtgcttggaggcctctactcgcgcctcggattgagcggccagacgtactgcgtcgtctgcgaatttaactgacagctgctcgttaacctgcgctttggcatctgctcgtttagcttctgctgtgtaggctgcactcaggagtttgatgagaatgttgatgatgttcatagtcttcctctaaggccccatgcggggccgtattagttaatagtgttgttgttttgactaagcccaggtgcgtttagtagctgttaaattcttcgctgtgcattaactctactaatacatcaccatgacaagcctggggtttgcagtaacaacccaggacctgcccccttaaactagcaagctcttttctgagcagcgggtccttttctagtttctgtattatgtactccctgtacatttttatgcactcgtcccgtccgtaatcttttacagtgtaaggattgccccacaaagaccccctacctatgtaaacggtaaaaggttctttgtacctgttgactacgcgggttatcgctcaggcttgaggtgcagcaggcgcagcgggcgctgctggcgctacaggggccgctggagccgctggagcagcgggggctgccggtgctgcctgagcagcgactgccgcaggggcagccggagcagcaggtgcctgcatagctgccggactcggaacagagccagcgttcagcataatatccagagcactgcccgggaagtctacggccttgtacatatcctcctgaatccagttcttgctcttaccgtcgtcgaaggtgccttcgatgtgcaggctatcccaggtctctttggttgggttgttccacaggaacagcttaatctcagaggcatccagggctggcatcttgataggctcgccggtgttcgggtcgaacttcggaatcgggcggataccggacaggtccacgatgttagacttcttgcccgcagcactggtgtgctcatcaatcgggaaggtgaaggcctggcccagacgctgtgctgcatgcttaatgctattgtcgtagttgagcttgtcgaagaacttcttgaagcctgctcgctcaaagttactgatagccatcgggtacgggcggatacgcttcacttcaccgttaggaccgtacaccacaataccgatgcgcacgttagccactgcaggcttaccagtaggcttaccgcccttagttggtaggcgcttaccgatttctacgtactcggtgaagtagccgtagtattcgcccttcggaagcagtacatcctcatacgcaccgccctgtgaggtttcccgcatatctacatcttgggtttcgattgctgcgtctaccagagcgttcaaggatgccagtacattagtagtcatataatttatacctcgttagaaaagtgtttgtgatgctgagagataactgcttgccttgctaagtgggcctcttctgcggtagcgtagaatcctaggtggtattgtaccccatctgtttgtatgtaggcacgccacttaccattgcttttacgataagacactccacgataccccgaccgggaatccttccgcaatcctgcattcttcgcgtttcctgctttattggcctcccttaaattgacccaccgattatctgtacggtttctgtttacgtggtctataacgttcggccaacgtccgcacattaaggcgaaggccagtcgatgtgcaaagtattgcctacccttcacacttactaccccgtaaccatccttaatgtaacccacagcctcggaaccgtcaggcctatgcaatttccccgattcggggtcataccgcaaatattgcggcagagaagtagcgtgcatataccctctcgtttagttcaaatgatatttacgtgcagatgcaggacaggcctagcgattcttaagtgcggacttaatgcctgcagccgcggctgccgccacaccgcctgccgccaggattgccaacagcaaagctacaccgccgtagaacggaagcagcacccacagccaggaccaggcgataaccccggtcagtttcaaggttataaagataagacccagtacagaacagattcccattttcattggtacccctaattaggttttgattatgtcgccaacttttaaactcagagctgaggattcatctttataccaccgctctgtctcagatttgtgcccccagcagtcatactccagggttacacgatacacctggtattgctcatcccatacgggcgcacccactcgggtgacggttgcgtctagcaaattcatttgcttctccctacccatttcccggaatcgtcaagtaacatggggatgatttgcgggcatccatctgtaatcaccatacaccctagaatcggcttgcttcttgacaacttaccataagcaaaggccagactcttgttgtcgattaaacaaccgcagtgcgcaccaaagtacagggcagtgctgctagcggcatactgtatatctaacttcccatggaagtgtccaatcaccatggacttacgttcatgggctgcgttgagcagcaggtccccagatacttgatgttggaatcgcacaatacccagtggagtattcaaatcccaagcatcgccccaactccacccgggggccccatgctctgggaacaggatgtcccggtacttcttaatgaactgtacagggagtccatgagctttggctctgcggtagacaagagagccgtggttagagtcgcacaggagcaggttaggaaacaggttatgcagccgctccaggccaagcttggccttctctaactccaccccagcactatccaactccggactgctgtcgtgaaagctaatggcgtgcccatccgtctcgtcgcctatctgcacaacaatgtctgggcagtactcgtcccgtacagtgcgcaaaaagtcgtacgcgtccggatgtgtgtacggctcgtgcaggtccccgataacgagaatacgtcgacaggtttccggtacaaacgtatccccaatgtcatccgttggggagggctggattagtttgcgggcttgcatcaaagcattattagcctttgccttgctgcccttgttatccatgaagatgctgcgccaatagcgcacaagctgacgagatacactaatgtccgtgtccacatccccgcgattatccagctcttggttgtagtactgagcagccagagcgttgtctaggtactggcccaggattgcctggtgctgctctttggtgaatagctttattaggctaacacgtgccattattgcctctcttgtgttgttcctactcgtatcacattaattctaggggaatcacagaatcaagccaaagtcaacaaataattttatttaattatttagttgaccctagcatatttccatgctaccctaaccccctacaccacccaagggtacacctatcactactcttcgataagcttgtactccccggggaagaaggtgacgccgtccccgggcctacttactaacagtccagggtaacttagttctatctcaccagtaaccgggtcgaagaatataaccgtgtgccttgtacctggggtgaagtatgctgcatacctcgggtctatcggctcaggcccaagatccatcaactccacaacactgcctgactttatactcattctaccttctccttactgtacatactcgtacccatctcagcctctgctgggaacgggacctcaccaatgataccgtagttaggccagagctggtggatacgcttaggtgcgtcctccatgcactgcttaaccagcaagctcgcctcacgtccaacctctgggttggcgctgtccagatacagcgcatcgtgcacgttcgtaatcaggcacacctgattgtcgaaccagtcacgggccaagagtgcacgcagaaccataccagccgccaccgccatcaggaagaatgcttccccttggcaccagtagttcgccatctcggtttccttgtagtccatgaccttctgcttacgctgcccaggcacaacctccttccactgctctttctgacggaagctgtagcgggcaccagcagggctggtccacgtcccaatgcggtagattcgatagctgccgtcgtccgcctgctcccggtacatgcgaccctccgcaccggtacgctctacctcttccttaacaacagcgcggaagccaattgtttgcgggaacagcgcagcctcgttgtccaagaaagcctgtgcaaattccaccgtacatccagtagcaaacgcaatccccttagccgtagcgccatactgggctgcaaagctaggagccttaatacttgtacgcattgccttccaaagcggatgcagctcgtgcttcttgttgtggcagcgctcatatacttcttcatacggtaatccttcacggaaagctaggcggtaacagtgcatatccgtacctgcctgtagcaggcccagcagtttcttatcccctgtatgcacgcaggacataaccacttccagcgcagagtagtcaacctcagtgatgcggccgttatcaccgaatcggctggtgaatacctgcttcaccttggatttagccaccccatccccgtcctcatccgggcggggtaggttctgcaggttcgggttagaactactaaggcgcccggttacggtggcacaggtattcaggcggtggtgtatgattccggaaccatcaggacgttcagggattacgtactgcagcattcccttccgctctttgacttctccgtttgcatccagaacttcccgcaaatagtaagtaccagtgtccttctcgagcgccgccagctcgtttaccaacttacagaactcgaacccttggcgagccagtgcctccattgcgtcagtgctggtgctgtatactggcgtgccgtcatgcagggtacgcgcctgccggaactctccgcgctctgcgtacttctcccggataacttccggaagctcctggatgtccactaggcccggacagaagtaaaggtcatcctcccacttaagtttctcctcctctgtatcaaggcggaatacttttggcagccccttgttcttaccggacttgtacgtggttgcaccgggtggcgcgggcatgtcgtccacggcaacccaagtgtccccgacttgccaatagtctgccttgacatactgcggggggaaatatggaaccttcttgcggtacttgataggtccgccgtacaccagtgcagacatatggaagtccgaaccgaagttgaaatccagcgtctccggcaagtccttcgggatgtactgctgcagctcctgcttaatctccaggatgcgctgctcctgctcttcttggttcttgcgagcaatcggcatattcacgaacaggccgaaccattcgcagtacgcccaagccagcaaggcatccatgcgctcccacacgtactgcatctgattgcgctgggcgaacgtagcgcactggccgtagaagcacagggccgtgttcgggatgtccccgttaaccaggtagtcgtgcagtagcatcgggtcaatctgggaggttagcacaccctgctcccacagaagcttaaccccgtctactttgtgcgtaccaccgtacttaggagccgtctcgtccagcgacggatacatgctctgaaagtccgaggcgatgtattcagaatgcatcgtacagaatacgcgacctccccgctttaggaaggcctcaaactcggcgcgcgcaaaggttaggaaccagctaatctcatatgcggcgttgtgagccacaatcagccaacagtcagctggtattgggagccattctgatacaggtgccgcttcaaagtgcgcgcgactgttataccgtacactctctacggggcctacttctaccgtaccgtcatcgtgcgtgcggtcaatacgccacgctgattctacgatgtaattatccggacagtacggggaagcaacactaccgtaatatgggtggttttgcgtctcataatccgttatcaggatgcttctgctcattccataccctcccctttatgatattagatatgtatccttgacttgttccgaagcgtctcgctatagatatctgggtctcaccgccagcgtatgcttctcgtatgctgtgcacgtcttctggggtaagtctggcagcagggttgcggctgcccagcaaattacgcgcacctttatttcggtcctgcatattatcgctaggagtccctagtagcaggtgctccggatttatgcaccgaggattgtcgcacgaatgccggactacaagtcccgcgatatcgctcagcttcaagttgtgggctatacagtatgctttgcggtggctgccagttgtcttcccgtcaaatctggagcggccatacccagcgccctttcctcggcaagtgcttcccctctgtccgtggtcaatacaacctgtcatttccacttagccctccgagccttgttgatagccagatgcacaatcagctggctgctgtccagtgcgaatcgtttacggaaagtacctgcagatgcagcgtacgccttgattacctcgtcgtctaggtagttgatgtctgacggtttaagcatactagtaaatctcccagcagtgatataggccctacaatatcccactctctctgattgtaacgtgccccgagttccacggtacaaaattccccggtaacgcggtgtcgcaccacgtaactaccgcgtataagtcctgtgtaatccactttttggataacccctgtatagtctacttgcataaatcctcctgtgtacctacatagcgccctcgtagaaggcgctagggaagtcacttgattggtggcggaggttcgatagcctccagcagcggctgctgcagtaggtaagtgttgtactcctgtatcgcttgtactgccaacccgcgcaggcgcagtgcttcgtttacgtcccaagcagcaccggtggatacaagagagaacgcatcagcatcaaagttgaatgtgctctccttagattcagtcagtcctatgtaggcgccgctttcacttacggcgcacacagtgtaagtcctgccaatcttcacgccagtgcggtagaatatatcacgcggcacaacggtgctgcgctttactttatcgccaactttaaacttagacattaatttggccctcatcaaatctacaacgacccggctcgaatcccacctcgaattgcaggagcgattctttaccagacagtgccatcttgttcttcggagtactgataccacggacgttttgcatgtgcggctgctcgttcctgtccaagcatcccatcataatcgccaagtccaaggcaccctgcacgccaatcttgctctgcttcatagcggtgagcggcgggaacagcatgttgtaaccttcgagtgaaagctgcatagtgcctacaatagcgcagtcgttctcgcacccaaggatacgcagctcctgccatttcgcctcaaggttctggtgctcactctccatagtgccaccacggatattcgccaccatgtcgatgatgattaccgcggggcgcatctcctccatgagcgtggatatctgcgccatcgtcaatgagtgcgcagccttaacacgaatccggtcagccctgcctactttcttgaggtaggctggcacgaactcttgcttactgtgtcggtccttaatctccgccagagtccaatgcagcgccgcttgatatacccgcggcactgtgcgcgtcgccggaccctcgttaacaagccagaggatagggcggtccccgtacacttccggctgctgctgcatttgctcagcaaaatccacagcaatagcagcaagcagactagttttaccagagtccacaggagcagccactgcgatacagtccccgccacgtagacctcggatgttgctagcgagttgctcgaacacgcccagtttaagaccgccgctctcgtcagtcgcggcaagtatttcgtcaacactaccgctctcccattcaagcagcgaatcatgaacagcagcaccgtccccgtacttgcgctggaggtgcttcatttccagcaggtaatcaacttcctccccatcctgatagcgttgcgtcagcgcggctacctccccgctgtaggccagctcgttcagggtctggacaatccccaccacagaatcctgcggtacggcctgtactccccgcataagctcgtccatgattaccctctcttcccgggataagtgaccggcccggaggttgagcatgctctgcatcgcatcccactgcacttcctggtgctccgggtacgtgttccagtacaaccccacccagtctagtaggttcgacgtatccggcgcgagcatggacttgggtatctgttcacgcagtcggttccacaccttctgcgtgcacattgcacgaacaactattaggtccaattagagcctccaagttttagctttcaatacatcgtgcactgctgacacacttacaccaaggctagcagctatggccggtgtgccgtgttccctgctgtgccgcctgtaggtcttcctgatatagtccacctgctgcgctgttagcttggagtacccattctgctcccctttagaaactccacgtctagccctaccccgggcaatacagtcatggacgttatccttgaccgtacctaattctaaatgctcgggattaatacatctcgggttgtcacacttatggcgcacaactagccccgctatgctctccggagatatatcgttcgccgagcaatacacctttctatgcaggggtatcttccgccctttgaacgtggtatttccgtaaccctttggtccgcctttctgtttgtgctctttacacgcgcctaataccatctaataactcctgtattgttgcctcttttgggtccccgtcgtagtagatttcgtggcacgacataaagggacgtagcgcgcgccgtatcatggccgcgccggagtgtcccgcttggtcattatccagggacagtatcactgtcggtttgttctgtatcagccacgcccttaactgcacgggcaagcgagtacccagcatagctatagcctgcacgttcattgcagagtagttcgtaatcgcgtgctgatatttgatcgctgatagatagtcctcggtgagcacgacctttagaggtgcggccgcagctacatccggtgctacggcaggtgccgcggcagcgaatggtattggttggccgtacattacccacttcggttgctgtcgagcatgaactgcacgacccagagcagcgcttccgacacggaagattatccgctgtttctctttgctccattctgcatcccccaccatttcaggcatgattccctttgtgattaggaatccgtaaataaaactctgcgtttccgcaggcgcttggctaatgcaaattgcatctgcaggtgcagagggctgcaccctcggctcttcctgtaactgtatgcgctggtactgcttgtgctccttgcccacctgcttgcagcggtggcaatagtattcccaggcatccgggttattgtagagcaccccggcggcgtccctgccgcagcaccgaaagcgagccctctgccctacggccaggcgcttgcacgctctaagccagggctggtccattacttaatttccagggtagtggcgtaagtcaagtcgggttgcctaagaatctggtgctcgttcaacagcaccggtgccccgtcatgcaggtagaacatatccccaccaggagattttatggcccagtaaatctttgcaccccaggtaaatggaactgccgttctgggggcatcaggcaaggtactatagtttatggtactaggcatttgctttctccttccgtttgatttccatagccatgcggcgcaggtcgtgtgccaactgcagggctgaatcggggtcgatgttaatcccaatctcaacctttgcccgagtgcttcccttcttaggaactaccccgatgtacattaaaccttccccatccccattatccttctcaagaactaggcgttggtcatttcccgggtcgcgcttagagttcatgtaggccaccttgtccgggactggcggcagctcatccttcgggtcttgatacagctcgaagttatcggcgtaccacgggtaggggtcggctcctccatctgtaaagttatccaactgcagccagtggccgcttgtagctatatctgtaattacgtagtaagcaaaatcccctaggtacgacttgagcgacgaattgtttttgtgtgctttgcgaacaactttatcaccaactttaaacttagacataatcaaccctccacaatattatcgtatccgccccagtcttctacgactcgggtgcctagttcaatcagttcttctttaaagccgtaatcggagaacaccattatgtactccgtcgccttctctggattctcctgcacccagctaatcagttgctgcttagaaagttgtgatacctctcggaacgctgccagtaactgcgggtcctcagcaggcggcatgtcccacggctgccgtaaactgagcgttggtgcagagagccattggtctggttctactaccctaggatcccgctcaatcggaaggtgcgagaacgtgccatcttgtagtacacgctcaagcacttgccccaggatgttcaggtccagtacctcatccggggtgtgctcgtgcatgtaccctacacctacgttggtgcactcagggatgatgccaacgaactcggctgagtcagtgtacacccccttctgtaagtgctgctccgtgcgtcccaggcgctctgctagggtcttggcaaaggtgtcagagcagcagcgcatatacctttgatgcgtaatgataccgtcgccgcggcggtcgaagctgatcatagccttgaccccagtccaaaatccagagtcatccttaaccgatgcagcgctaccctcgcagccaacctcttcgtccacgaagaagcagtagcgtccgtgcac

SEQ ID NO: 46 - DNA, 44804 bp, Unknown
  source: /note="Description of Unknown: MCoc6c Bacteriophage Sequence"
aaagctacaccgccgtagaacggaagcagcacccacagccaggaccaggcgataaccccggtcagtttcaaggttataaagataagacccagtacagaacagattcccattttcattggtacccctaattaggttttgattatgtcgccaacttttaaactcagagctgaggattcatctttataccaccgctctgtctcagatttgtgcccccagcagtcatactccagggttacacgatacacctggtattgctcatcccatacgggcgcacccactcgggtgacggttgcgtctagcaaattcatttgcttctccctacccatttcccggaatcgtcaagtaacatggggatgatttgcgggcatccatctgtaatcaccatacaccctagaatcggcttgcttcttgacaacttaccataagcaaaggccagactcttgttgtcgattaaacaaccgcagtgcgcaccaaagtacagggcagtgctgctagcggcatactgtatatctaacttcccatggaagtgtccaatcaccatggacttacgttcatgggctgcgttgagcagcaggtccccagatacttgatgttggaatcgcacaatacccagtggagtattcaaatcccaagcatcgccccaactccacccgggggccccatgctctgggaacaggatgtcccggtacttcttaatgaactgtacagggagtccatgagctttggctctgcggtagacaagagagccgtggttagagtcgcacaggagcaggttaggaaacaggttatgcagccgctccaggccaagcttggccttctctaactccaccccagcactatccaactccggactgctgtcgtgaaagctaatggcgtgcccatccgtctcatcgcctatctgcacaacaatgtctgggcagtactcgtcccgtacagtgcgcaaaaagtcgtacgcgtccggatgtgtgtacggctcgtgcaggtccccgataacgagaatacgtcgacaggtttccggtacaaacgtatccccaatgtcatccgttggggagggctggattagtttgcgggcttgcatcaaagcattattagcctttgccttgctgcccttgttatccatgaagatgctgcgccaatagcgcacaagctgacgagatacactaatgtccgtgtccacatccccgcgattatccagctcttggttgtagtactgagcagccagagcgttgtctaggtactggcccaggattgcctggtgctgctctttggtgaatagttttattaggctaacacgtgccattattgcctctcttgtgttgttcctactcgtatcacattaattctaggggaatcacagaatcaagccaaagtcaacaaataattttatttaattatttagttgaccctagcatatttccatgctaccctaaccccctacaccacccaagggtacacctatcactactcttcgataagcttgtactccccggggaagaaggtgacgccgtccccgggcctacttactaacagtccagggtaacttagttctatctcaccagtaaccgggtcgaagaatataaccgtgtgccttgtacctggggtgaagtatgctgcatacctcgggtctatcggctcaggcccaagatccatcaactccacaacactgcctgactttatactcattctaccttctccttactgtacatactcgtacccatctcagcctctgctgggaacgggacctcaccaatgataccgtagttaggccagagctggtggatacgcttaggtgcgtcctccatgcactgcttaaccagcaagctcgcctcacgtccaacctctgggttggcgctgtccaggtacagcgcatcgtgcacgttcgtaatcaggcacacctgattgtcgaaccagtcacgggccaagagtgcacgcagaaccataccagccgccaccgccatcaggaagaatgcttccccttggcaccagtagttcgccatctcggtttccttgtagtccatgaccttctgcttacgctgcccaggcacaacctccttccactgctctttctgacggaagctgtagcgggcaccagcagggctggtccacgtcccaatgcggtagattcgatagctgccgtcgtccgcctgctcccggtatatgcgaccctccgcaccggtacgctctacctcttccttaacaacagcgcggaagccaattgtttgcgggaacagcgcagcctcgttgtccaagaaagcctgtgcaaattccaccgtacatccagtagcaaacgcaatccccttagccgtagcgccatactgggctgcaaagctaggagccttaatacttgtacgcattgccttccaaagcggatgcagctcgtgcttcttgttgtggcagcgctcatatacttcttcatacggtaatccttcacggaaagctaggcggtaacagtgcatatccgtacctgcctgtagcaggcccagcagtttcttatcccctgtatgcacgcaggacataaccacttccagcgcagagtagtcaacctcagtgatgcggccgttatcaccgaatcggctggtgaatacctgcttcaccttggatttagccaccccatccccgtcctcatccgggcggggtaggttctgcaggttcgggttagaactactaaggcgcccggttacggtggcacaggtattcaggcggtggtgtatgattccggaaccatcaggacgttcagggattacgtactgcagcattcccttccgctctttgacttctccgtttgcatccagaacttcccgcaaatagtaagtaccagtgtccttctcaagcgccgccagctcgtttaccaacttacagaactcgaacccttggcgagccagtgcctccattgcgtcagtgctggtgctgtatactggcgtgccgtcatgcagggtacgcgcctgccggaactctccgcgctctgcgtacttctcccggataacttccggaagctcctggatgtccactaggcccggacagaagtaaaggtcatcctcccacttaagtttctcctcctctgtatcaaggcggaatacttttggcagccccttgttcttaccggacttgtacgtggttgcaccgggtggcgcgggcatgtcgtccacggcaacccaagtgtccccgacttgccaatagtctgccttgacatactgcggggggaaatatggaaccttcttgcggtacttgataggtccgccgtacaccagtgcagacatatggaagtccgaaccgaagttgaaatccagcgtctccggcaagtccttcgggatgtactgctgcagctcctgcttaatctccaggatgcgctgctcctgctcttcttggttcttgcgagcaatcggcatattcacgaacaggccgaaccattcgcagtacgcccaagccagcaaggcatccatgcgctcccacacgtactgcatctgattgcgctgggcgaacgtagcgcactggccgtagaagcacagggccgtgttctttatatcaccattgactaggtaatccctgagaagaatggggtctatctgcgaggtcagaacaccctgttcccacaatatttttaccccatcaatcttatgctccccaccatactttggcgcagtttcatccaaggatgggtacatactctgaaagtcagacacaatatactccccgtgcattgtgtcgaatacgcggccgccgcgctttaggaattcctcaaagtgttgccgctgatatgttaaaaaccagctaatttcgaaggctgcgttgtgggccacgatgcaccagcaatcagaaggtatgcggaaccacagatgctccccggctacgtcgtcaagaaattcctgcttgctgttgaatctgatatcaaaggtcggttctacggtaactgtgccgtcatcctcggtccggtctatgcggtaggccgaatgcactacatagttgtcagggcagtaggggctagccttgctaccatagtaaggattattctcgacctcaaggtctatagtcataatactgctagtcatactgcaaccccgtgattatggtgataccccgccgcctcagctgccagtctacgacactctacggcttgctctatactgctaaatgaacctaattgtttatttcctagggttgctatccaacgacctctcttcctgtgcacccctacatagccgctgcggttgcttctatacagggacttgttctgcatgttcttctcaggaagcactgccctcaagttatctggggtatcttctaacctgttatgatttatgtggtctatatggtggcctgctcgcagcggaccgttgtgcatctcatatactatcaaacttcttttgtatagcttattatgcagcttaacgtaccagtatccatgtactttgttcagagttcctgcctcggaacctgcggcgcagtttaggtggctgcgtccgcgcccacttctaacctcgtgcttccagtagagtttgccgtctttgtaggtaaaccaaatatcccaattcatttccacttagccctccgagccttgttgatagccagatgcacaatcagctggctgctgtccagtgcgaatcgtttacggaaagtacctgcagatgcagcgtacgccttgattacctcgtcgtctaggtagttgatgtctgacggtttaagcatactagtaaatctcccagcagtgatataggccctacaatatcccactctctctgattgtaacgtgccccgagttccacggtacaaaattccccggtaacgcggtgtcgcaccacgtaactaccgcgtataagtcctgtgtaatccgctttttggataacccctgtatagtctacttgcataaaccctcctgtgtacctacatagcgccctcgtagaaggcgctagggaagtcacttgattggtggcggaggttcgatagcctccagcagcggctgctgcagtaggtaagtgttgtactcctgtatcgcttgtactgccaacccgcgcaggcgcagtgcttcgtttacgtcccaagcagcaccggtggatacaagagagaacgcatcagcatcaaagttgaatgtgctctccttagattcagtcagtcctatgtaggcgccgctttcacttacggcgcacacagtgtaagtcctgccaatcttcacgccagtgcggtagaatatatcacgcggcacaacggtgctgcgctttactttatcgccaactttaaacttagacattaatttggccctcgtcaaatctacaacgacccggctcgaatcccacctcgaattgcaggagcgattctttaccagacagtgccatcttgttcttcggagtactgataccacggacgttttgcatgtgcggctgctcgttcctgtccaagcatcccatcataatcgccaagtccaaggcaccctgcacgccaatcttgctctgcttcatagcggtgagcggcgggaacagcatgttgtaaccttcgagtgaaagctgcatagtgcctacaatagcgcagtcgttctcgcacccaaggatacgcagctcctgccatttcgcctcaaggttctggtgctcactctccatagtgccgccacggatattcgccaccatgtcgatgatgattaccgcggggcgcatctcctccatgagcgtggatatctgcgccatcgtcaatgagtgcgcagccttaacacgaatccggtcagccctgcctactttcttgaggtaggctggcacgaactcttgcttactgtgccggtccttaatctccgccagagtccaatgcagcgccgcttgatatacccgcggcactgtgcgcgtcgccggaccctcgttaacaagccagaggatagggcggtccccgtacacttccggctgctgctgcatttgctcagcaaaatccacagcaatagcagcaagcagactagttttaccagagtccacaggagcagccactgcgatacagtccccgccacgtagacctcggatgttgctagcgagttgctcgaacacgcccagtttaagaccgccgctctcgtcagtcgcggcaagtatttcgtcaacactaccgctctcccattcaagcagcgaatcatgaacagcagcaccgtccccgtacttgcgctggaggtgcttcatttccagcaggtaatcaacttcctccccatcctgatagcgttgcgtcagcgcggctacctccccgctgtaggccagctcgttcagggtctggacaatccccaccacagaatcctgcggtacggcctgtactccccgcataagctcgtccatgattaccctctcttcccgggataagtgaccggcccggaggttgagcatgctctgcatcgcatcccactgcacttcctggtgctccgggtacgtgttccagtacaaccccacccagtctagtaggttcgacgtatccggcgcgagcatggacttgggtatctgttcacgcagtcggttccacaccttctgcgtgcacattgcacgaacaactattaggtccaattagagcctccaagttttagctttcaatacatcgtgcactgctgacacacttacaccaaggctagcagctatggccggtgtgccgtgttccctgctgtaccgcctgtaggtcttcctgatatagtccacctgctgcgctgttagcttggagtacccattctgctcccctttagaaactccacgtctagccctaccccgggcaatacagtcatggatgttatccttgaccgtacctaattctaaatgctcgggattaatacatctcgggttgtcacacttatggcgcacaactagccccgctatgctctccggagatatatcgttcgccgagcaatacacctttctatgcaggggtatcttccgccctttgaacgtggtatttccgtaaccctttggtccgcctttctgtttgtgctctttacacgcgcctaataccatctaataactcctgtattgttgcctcttttgggtccccgtcgtagtagatttcgtggcacgacataaagggacgtagcgcgcgccgtatcatggccgcgccggagtgtcccgcttggtcattatccagggacagtatcactgtcggtttgttctgtatcagccacgcccttaactgcacgggcaagcgagtacccagcatagctatagcctgcacgttcattgcagagtagttcgtaatcgcgtgctgatatttgatcgctgatagatagtcctcggtgagcacgacctttagaggtgcggccgcagctacatccggtgctacggcaggtgccgcggcagcgaatggtattggttggccgtacattacccacttcggttgctgtcgagcatgaactgcacgacccagagcagcccttccgacacggaagattatccgctgtttctctttgctccattctgcatcccccaccatttcaggcatgattccctttgtgattaggaatccgtaaataaaactctgcgtttccgcaggcgcttggctaatgcaaattgcatctgcaggtgcagagggctgcaccctcggctcttcctgtaactgtatgcgctggtactgcttgtgctccttgcccacctgcttgcagcggtggcaatagtattcccaggcatccgggttattgtagagcaccccggcggcgtccctgccgcagcaccgaaagcgagccctctgccctacggccaggcgcttgcacgctctaagccagggctggtccattacttaatttccagggtagtggcgtaagtcaagtcgggttgcctaagaatctggtgctcgttcaacagcaccggtgccccgtcatgcaggtagaacatatccccaccaggagattttatggcccagtaaatctttgcaccccaggtaaatggaactgccgttctgggggcatcaggcaaggtactatagtttatggtactaggcatttgctttctccttccgtttgatttccatagccatgcggcgcaggtcgtgtgccaactgcagggctgaatcggggtcgatgttaatcccaatctcaacctttgcccgagtgcttcccttcttaggaactaccccgatgtacattaaaccttccccatccccattatccttctcaagaactaggcgttggtcatttcccgggtcgcgcttagagttcatgtaggccaccttgtccgggactggcggcagctcatccttcgggtcttgatacagctcgaagttatcggcgtaccacgggtaggggtcggctcctccatctgtaaagttatccaactgcagccagtggccgcttgtagctatatctgtaattacgtagtaagcaaaatcccctaggtacgacttgagcgacgaattgtttttgtgtgctttgcgaacaactttatcaccaactttaaacttagacataatcaaccctccacaatattatcgtatccgccccagtcttctacgactcgggtgcctagttcaatcagttcttctttaaagccgtaatcggagaacaccattatgtactccgtcgccttctctggattctcctgcacccagctaatcagttgctgcttagaaagttgtgatacctctcggaacgctgccagtaactgcgggtcctcagcaggcggcatgtcccacggctgccgtaaactgagcgttggtgcagagagccattggtctggttctactaccctaggatcccgctcaatcggaaggtgcgagaacgtgccatcttgtagtacacgctcaagcacttgccccaggatgttcaggtccagtacctcatccggggtgtgctcgtgcatgtaccctacacctacgttggtgcactcagggatgatgccaacgaactcggctgagtcagtgtacacccccttctgtaagtgctgctccgtgcgtcccaggcgctctgctagggtcttggcaaaggtgtcagagcagcagcgcatatacctttgatgcgtaatgataccgtcgccgcggcggtcgaagctgatcatagccttgaccccagtccaaaatccagagtcatccttaaccgatgcagcgctaccctcgcagccaacctcttcgtccacgaagaagcagtagcgtccgtgcacaccccgccgcagcatctccagcatcaggtagataccagcaccgcagtccgcccccaagcagtcagcttgttgcggattctttacgaacagcacgcccttgttagtgcagccgacgtccggtgcagcgctggttgggcgcgccactgtgtcgaggtgcgacgtaaacgctacgtcactttgttcggagtccccgaccagcacgaagtagttcccgtgcttgtcctttacgtagtgcataccactacccagcgcctgcataagcagcggctcaaaccacttagtgctgccccagctaggccggtgcgtttgcagtatctgcaagagcagctgcatatcaatcccatgcggattcaagaacattaagctgcctcctctatttcttcatcgtcgttgcccagatacttctcccccaagcaatcggctgcatactcagtgagaatcaacccgtgcacagggtgttcttctgcgtgctcaataagcacctgtcggtcctgtgcatacaccagttcttcttggtcatgcactaccccctctaccgaacagtgctcaatgtctccgtcgtatacataagcgtcgtggtaatcagaccaagtgcaactccatcgattatacagaccctcgcgcccaactacgtatacaaactccccctcttcgaggcagccgtcgcagaccatttcataatcggcggtttcgtgcatatcatcaacggagtagcgccccccgcagcagcagcaccgagcagattctgtgccgacgtagatgtacccttctgattcttgcgcctcgtactcgtagtcgtcacgtattacaaaggcgtcactgccttcttcgtctacgccacgctggctgctatcgagatatggcatcagcactgcgccgttgtaggttgggtgcggtatgcgtgccagcattaccccctcgagacattcagtgtttctggtgtacccatgcccccgcaggattgcatccgcagcgttgccgtaagcacggacgtactctttggtttcaggttttacgattgctcgtgccagcacttcgaagtcgtccccgaaaagctccccggtatactggatgaataggcgcaacccgttatccggcaacccgtggctggtggtggcgtacgtccgcacagggctatgcttaaatgagtacccgctcatgcagctacccgggccattctcgtaggcgtcgtaccattcctgctcggtcttgcacaggtacgttgtagggtctacgttcatagccttgaggtcttcgatagcatcgcggaagtctaccccgtttccgtagtagttagcgagccacttaccgacgcgcatctctacgcaacggtactcattaactgcggcgaagtccttatgcatccgcggctgccccagcatcacgatgggctcaccgttgcggaaaccaaagcccaaaggcacggcgaatctagacactacgaagccgtgcaacttcatgagcagcgcagcggcgttgccatcgcggaggtggcgtccgtaatcgtagccagtgtactcctggcgctgccgctcttctggtgcaagcataatgcgctcgaataactgcacggcctgcttgtgcaccttgtaaccggtgaactcttctacactagcaactacgcgctcaaccactacatcatcgccctcatagaagtcgcggcggcgttcccagaacttgctgtcgatggtgattcgcgccggggaaaagagttcgtagaaagttccagaccggtgcaggtctaccttttgcaacgggccgcgagtcatcattacttcgcggtactcagggtgcagtatcccgcctatagtcacctctaagccaggggtgtaagcgctgacagtgcggagacccataagcgcctgcagcggaccctcattgtgagggtggtcagaaccttgcatttgcaagtcctggaacggggtccagtaatcaccgctggaatacatcgaacatttcattggcagtgcgtttgcaccttccggcaacactactttccattcgataggtgctgtgccagtttctttgatagtctcttgcattttcatttgctcccgagttaattgtattgcgtcgtgtattaatagctcagcgtgcataccacgcagcgagttgtcgttgcttataatatgagcgcacagccgccctaaatcttgtataggctccacgatacccgtaccgtagtagtgctgcgaccacatcaaactcaatgtgctcttgcaactgccgcgcggcagattctgtatactcgcggtacgtggggagcaccaccgcagagtcctgcttacgaactcggaggagtctacgctcgactggtacgattttcttgagctcattaggaacctctttgaatgtttcccacggacacccgcacttgccttgtgtctccagcaagcgccagataaacgccgcggtttcgtctacagttagcataggcttctcttagtcacgcagtttcgtgccaccaacacaaaagccggagaggtgataacgtcacctgctcggtaactgctccgcattaatcccgcagaggttaaaagtatgcggcgctcattaattgccccttctaaagggatgagataatacagaccgctataggtctcccggtacacgtcatacttcatactacaccccgcacattaaaccggtaacagtagccgcgcagggtcatacccagtcgctttgcttgtttctcatagtgctgtcgcagtcccgcctttgcgctgtactcccgcgccagcccgtcgattgttggttgctgcttacgcatcagcagcgtttcaggattctttccgtaagccttcatgccgtacccccactgacacggcgcacgcacatgagcttagtgtaaggcccaaaactatcatagcggcgctctgcatacacagctactacgtcatcggaaaccttgacctcttcgcccaagtatcttgcaggcaaggacttgtactttccagtgcaatatgggtacttgatagcgccgggatttgcatccgcaatacgcaacgcctcagatttacgaatgaactttaagactttcatagccgccaacacctctcaaatttcgttgttgctcttaccatccacagtgagcgtcaccgcggcgtccgggtactgctcctgcaccgccgcaaggatacgcgcacccagctctttgcagccgccctccgggtattcgaataggtcgtactcagggcgtggctgcagttgctgtgttgctggctgctgcaattgcacagtacagtagggcaccgggttgcttgcgtcatttcccagcaccagcatagcgctggtcacaatgatgttgaatacattaaccatagagttgtctccagtcgttgataatgccaagattcacggcgtccagcacagtgcgggcagccatttcggtgtaggtatccacaaattctaaaggggattcctgattagtgtctttgtcagagaatataaccacagtgtagctgtattcttcgtatatccgattgcaccacacgggccagagttcatggcccggatagaccagtattgctttcatatgaaacctcatacgccagttgcattcacatagcgccccgtaggacgctataggcttgctactaggccactgccttcaaagttgcgtccagcacagcacgtacatccacgccctgattaatgagcatactcaccaaatctgcgtcgcttacgccagtctctttggccttcttaatggcgtttttaacgcgccccagcgcttgcaagcgcactgcatcagcgtccagcgcgtcattcttcacctgctccgcttcggcagcgtacagggccatacaggagctatagaagctggcaacaataacttcgcggccctgcttgtcagcttgtttgtagtcaagacgcatagtgtccagttcgattcccagcttctcagccgacgcatagcacttcttagcgttgaactcgtacttaccggactctttgttgaacttgatgggtaatagcgtacgcagcaccatatcaaagtcagcagcgtcactgcgctgcatatccgtagcccaggaaacgttgctgctgataagaccgtggaagagcgcgctgatagtgatgttacgctttgcttccactacgtcgcccagcgctttacgaatgctacccgcagcggtgagcttgaatactttaccagttgaatgggtcataatacacctctttgattgatttactatcggttaatttcacatagcgccccgtaggacgctataggctattaaccttcaccgtagccaaccatttggcacctccctagttgcttagataattactccacatagcaccccataggatgctataggctgtaattagtgcccaaattgggagttaacagcaggccacccactaggctgtttactgccgcccttttgtttttgctttcccctcaccctgtgctcaccgctcaacccttgtttgctgggcttcacagtaagcggcacgttatcggtggggttaagtgataactgcatattccgccgtaatgctaggcgttttgctttgcgcataatctcacctctcagagtacataatctagcgcagccttgttactgctacgctatgttatatgctctttgcggggtacactccgcgccttgttccctcgattcagaggagcgagctgctctcgcctcggcagtatggtttgcctcagaaccccggtgataacgtccggcacgcttactctttttaactgattatctaggctcggtcgtcatcgtaccagtcaaggtactgggcctccccgcaaatcagcttactgcttgctatctaagttactcagttaatcggaacttgtcaagcgtttatttcttactacttgctggctgtccagctcggggtattcggtagttcccaaccagcctgtttccctaaactccgatgagcatcacttcttaggggttatctcgctgttagcctctcagcgccctatcgtggttagggttccaatcgcgcatttactgttacacgacatattcagttactttgggattcaatctagcttatgttcttcgcggtgtcaactctttttatcgagtgtctaacccttcacactatctagccttaatccggcggagcctcccggctcggctccgttcagcacctcagcgcctcccggtgattgaactatagccccattgaaccaaaagaagcaagtaatattttcaactttttatcactaagagcaaaaagggtaagcagggcaaatacttagagctgcacttagaaccacactagggatagctctaggggtactctaaccactactaaccatactgcatagtactgcatagagcgtagcgtagtgacgtaacgtaagtgaaggaacgtagtgtagcgtagttaatgcttccctccctacggtcggtcatacagggcattactagtgagtactagtgagtagtagtgtatatagtgccctaaacccctcctactccggttacttcatttcataatagctttcgaatgaaagtaagagcaaagggatagcgctgggatagtggatgtgcgccctagtggggagcgcgcagcgtagcacagaatccgcgcaatgtaaagcactaaggatagccagtggatagcctagtgcatactagggatagcactagggacagcactacagcgcactagctggcccactatggccccactactggccccgctggacaggcacaaaataagcaaggcagagcacgcccctatggcccacagggagcgcacagggatagccctagcgcctcatagcacgcactgagagcgcacaggaagcgccctagtgaacgcacaaggacaggcatagggtagcactagcgatagccctagaacgcagcacaggcccgctgaggccctctggtgcgcactagcaggcccacccagtgcccccccccccccctaaattgacgctaggtaccccctatgggggcaattgggcgcgttcagggtgagggaggggctcgcgtgagtctaataaatttcaggtccaggtatagacctgctcgcctagactgggcctgggctttacgctgtgcgttagaagtgcagcaccaagctagcccgagtagccccaggggtaattgccgcagccccaggattaaacagagtaactttgtaggagctgtacccactgtagctactgacaccagttagcagcccatcaacagacccgttaaataccggagaactcaaaccgacaggggcttgagtaatgccgtacgggagagtctgtacagggctagataccagcgtaccggcagcgacagcaccaggggtccacgcaaggctaaatggaacagaacgagcacgctctactgtaataccatccaggctcagtgtgtttccagtgctgttggtgaagcgcaaatctccgtcacccgttaggctgttacccaagtaaaagtctacatcgaaccaccctggaccagccggtaccgcggcaacagaggagccgccactacccaccgctaaggttatgttaccagtagcgcccgggttgtagactcgcaaggatacgcgcactatagccccgagaaggtgcagcggcaactggtaccgacgcatctcctgacccgcgggaacatccagtgctacagtactagcggctccagccctagcggtacgactagcagcagcagcgccacgcatgtacgcctgcccgataaacccagggccgaacggactatccccgcgcactacgttcatgttcccactgtacacgcgcggagggttgatgcggcaagccctagtactactcagtgaccaggatagaacactgctggcatctgcaatgttcgcatcattgtcgaaggcatctacataaccaccttcaatggtccagaattccccttcgcatccatacgccttgttatcagaaataacaatagggccaacagctccagacctaatacgaatacacccggcatacaggttatggtcggagtccgggcggaagtgcgcaaaaccattacgggtaatccaagagcgcgacagctgtccaaagtccagtacgtgctgtgcagctgtgttagccccgtatggtacactatcccactcaaacttattatccgtaatccacaccaggtccgggttactgtttgctgtactcttaatccatgcgcccgagcacagtccgaacgtgttattctgaatgtgcaggttattgacgttgttattaggaatacctatgtaatccccgaggagtataacgctgccgttagaggcacccatcctacggaataagtttccggagatgtggctctccatacagtcacgtaacaccagcgcagagcccgccaagttattaaaagcagagttttccgccccaaaatagctccaggatgttacctccaccataagtcccgaatcactgctgacagccccctgcagtcgcattctaaggaacccgccgcccattccacgggtgctcgtaccgtcaaagtagaacatcttgctggctgtgctcggtttaacgaatacagccccaagcgggttaacaccctctaggccatcacctataaacagcatagggttagtaaggtggcagtctccaacataataagaccccacaggtactcgcagcacctttacacctttagcggaaatccgctcaatagcggctgcatagttaccggaagaatccggacggagtccggtaagtaccggggcatccttcgctaagtagtcagctactctgcaccacaaatcgtcttggctgtagtaccgtgtttgtacgttctctactagtgccatgtgtcccctcttatcgtttcaattcagccagggctgtgcttacgttcttgtactggttcccgatggctttgctctgccactgcctgcgctcccataggccccagcacactttattgcgctgcccattaatatactgggagcagtcgaaggtccagcggttgctgcccttgtacacccaaccggtgccaggggacttctgctggtacttgctaatatagcgccagtccagtacagcctttccagccgctgcgtaatccaggctcttgagatgccgcttcacagcactgccgttgaagccagctacgcctacgttgtaaatgaagtccacagaccccaccagagatacgtcagagagctgcataggaagcccgtcaagggcctttgcgtgttcccctgctgactgtatcagttgcttctgacaatcgctcagcgtggctctctgacccatcttgacgccctttgtctccccatagcagatagtagggaccccggcgctatccttgtaggcggtaaggctcaggccctcgttgtgctgaaccaccccggtaatggcaccgccaagcatagtggcccccgtaagggccgcaataaccttagtccttaaactcatatttaatagtccccttacgtgcctgctcctctaggagcttgaatgtacgtctcttgtaatacgcattccacgccagggttagcaccgcgcacaccgtcgcagtgatgaagctgatagtgctccagttccagctcattaactctgccaaccaacctcctgacaccgtagcgccggtaactgccgcacctgcccgggtagcgaggtctgccccaactacgtcccctaccttaatcatcctgctgctccttcttcctgaacagcttacgaatcaccagaatgaccactaggaagaccagaggaatgctggccccagctaatccggcgaggataagactgtaactatcattgttaaccacctgcaggcgctctgcctggattgtaccggtgctaatagtttgcacctgctccttactggacgtgtccaaagtgcctacgttagaatctgatacatcggttttgttggtggtgctggagtccaccttgttattcaagccaacggtttgcttggtgttttcggcaccaacctgagcagatacatccggcttagaaccaactaagccggtgagtgcagaggtcgccgagcaaccagtcagagtaaccgcgagcagtaacccagcgaccagtttacgcattagctagcagccttcactgcggctaccgcggcttctagcgcagcaatcttggtatcgaaggtagcacccgtctgggccacgtcctgcggctgcgtaagcatagcatacaggtccttaccgagaatgttcagctggcgcagcagctcctgctgttgcgctggggttgcttttgcaattgccatagtattgctccttactcaacagagattgctgtgattacaccatcttctacagtgatagttgctgctacagtagcggtagcccccgcctcccgagcggtggtgaacgtaataggtgcagttacttctgcgccgtcaccaaccaccactacagcaccaccgtcagaggctcctgcagcagagagtgccgccactgctacagcccctgctgcatctacatccggacccagagtatctagtgggccggtatcatgcgccaaggttgttgctttatcaagcgccactgccgcattacgtactgcctggcgctgtgccagtgttgcttctgcaaatgccattatcttcttcctctatgttgtttatctctgccacggttctgcaacctagcagccacaccccgaaggcccttagacactttgctctgtgcccaatccagcgggttctcaatgaaggcccgagccatcttctcagactcacgctcagccaccactttctcatcttccaccaggtgcccgttcagcgtagccaccatcatagcgattgcgtctgctcggtcgtccttagctaggctaccgcggtcgtacgtgatgccggacaactgcgcgaacgcggagtacagccaacgtctatcgcgggagtatgccatacaggtactaatgtcgtcgtggatagcacgctcgtgcactaccaggcggtgccgacgagtaactgggctgattgtgtcaatgatacgacgctctttctgcgtggagttattcaggtcccttacgccaataccggcgagacgccgctcccgcagacggttcaggataagcatagacacggtaccgtgccccatgttgctctccacaaccatatcctggatatctaactctacgcataggtcaatcagtttatcaatgttctcttcgctgatacctccttggaagccgcctacggagaataggtggatgtacgagttcgcagcaccaccagcagcgtaagacacttcgtccccgccacacccagccgggtccaccaccagcaccttatgctggtacggcaggtgcatgtccccgtagaatgccgggaagtacatctgctggcccataatcccctcatgctcatgctggtacaggtaccggcggtccgcgatgtaggagaacgtctcaggggaggaatcctggctaccagagtaaaccagcatatccgaaagcttgatgcgcgtacgcatttggtcggacagtgtagtgtcgagcatgtactgcagctggaagccttccggaccgaagtccagctccttctcaatcagtgcatcctcgtcatagcgtccggtgtccgtgctctcgcctagcgtcccgtcgacgccgaagccggtgcgtttatagccgcgctcaataagctccaggatataaggagcaagtgtacttccatatcgctcttccatttcaacagacggaatgcgcccgggccacacgcggacctcgaagccgcgtcccggcagggttttatagatactgtccttggtctgcggtgtgcccaggtacagcgtatccccgtgcgtacagatagctgcgaagtctttagaaatcatcagcagctgctcacgctgggtttgcgttaaaccgttcttagtggtctcgatatcatccggaatcagcaggtccgcgcgcttcccctgcagggatgcagtgatacctacacaggctacgctggcggatttatccagcggtttcaggtcgcagttgacatcatagccttctaatgaagtacggtccccacgagtagggtcggcctttaagtagcacagtagaggccaggtttctagcatacgaatgattaagttcgctacgtcagaggcctgcttctctgcaccggacacaatcaggatacgacaggattggtcctggatgagcctccagacggcgtacagtgcagctagtgtagacttagcctcaccacgctgtgcggccaccatgcgcttcctagggcccttctgcatgtactctgcaatgtcggcctgcatgtccgtcaatgtaaaacccaggaaccgcatacctatgtatgcgaattcccggaagtcacttagcgccgcggccatcatcatcgcgatgtcctcgcgctcctctttgggaatactgcgcggattcgcactataaccagtaagtttctggttgagcatgcgcagtcttcgcgcagtcttcaccgataccattagacaattccttctagtaagtcctcagagtctgaaccaccaactttatttagaatttcttgcttacgcgcctctctacgcgccgctagttcatcatcgaactcgtcacgaaggtcctgcatctcctcggaatctgcatccgcggtgatgtcgttgtccttcaagaacttggcgataaccgatttatctgcggcggggagcggcacctcgtcttccttagactgcttgatttcttcaatcaaggcctcagtgaacatgcggtgcagctccgagaggcgactgcgtttagccgcccctgccattgtgcctccagtaattatttaagttttgataatcccagcacttctcagctccgctaacagggcgtttagctgggtggcaacgttgctggtgtcggtactatccgccacggcgtttgccgggcccttgtacgccagttcgcctactgaggccagccagttgtcaaaagctgcctgggttacatacccatcgcccgcctctacatctgcgcccagcctagccgccacgagcgtaccggccggtagcgtctccgcaaacagcaacgaatttcccactaccacaaagctgtagccggggatttggccctgcccattcagctcaactatggccttactaaaagcgatgggcggcgtcacggtgtctgtgggggtatccagtactgtaaaccaagggtagcttacagtgaccctgtcggatataaaggtctgctctagattagttactcgggtatccaggatagcgtcggcagactttctagcagcctcttccgcatccaccctttggtccagacgggcgtcgccggaatcgacgtaacccttgttagtggcgtccgcagtgtccactgggtctcctaggtgggtgattcgatatccgtgcatactgatatcgccgtagaagccctcaatagaacgcccctcaactagctcttgagccaggtgcaggaactgcgtattctgggtatctacgttgccttcaataaacggagcaccgctagagaattcaatgtaaagatactctcgttcagtcttacgaattaggagcaccactgtctctgcagacagtggcgagttcagacgaatattggtggagctggtccaagtgaaggcagtagtctcagcaccatctaagtaaacgtgaatataggacttatccaggtactcgatatcgcactggatatcctgagtacctgcaggctttaccgactcttgccagctgaacgccatattaatcgtctccgaagttattgatgatagctcgcgtaggtgcgaattcctggattagcggtacctgcttagtgaaggtcttgatatccatattaccggtagccaggtcctgtacggccccgagcagccctgtgacgtaacccatagatgccaacgagtgacgaggagaatctcccaggaaaatatcctgcagtaaggataccccgccgatggcactcatacccgttacggattcactgatgagtttctgggtgtctacatcctttccgtccatgccatgcttggccatagtagccagcagcatcaacgggaactggtacgccataatgtgggccacaccaatccacccagcatcgttcagctctctacgcagaatcttgttagtggcagccagtgcgaagctctggtaccctacaatgactttgccgataggattgaactgcgcaaagtgcgaggtctcgccggtacgaatctgctgtaccaggtagtccatcatacgcgtccctacaacctcaacttgcatctgcaggtccggctggaacatggcgcccgggttagccttgttggcagcgatagcgcggtccgcaacgtcacgggtaagcccgaaacgctccagacgcttaaacgcctcagcatcgcccttgaacatctgcgtaagctcatccgccacaatgccggagttcaggttaacctgcagccggtgcaccatactcattccgttgacgtgacgtgcagcctgcccaacgttctgagtgacgttgaaccaggaggcctgacgggtcaggtccaggttatcgtcggcgtacgtattcaaccagcggaagcgcatctccttctggatattaccacgcagcacagtgtctagacgggcagccatatccggagtcttgatagctacggcaccttccttgaaccaaggctggtcacgcatactgcgcagcactctagccataccgaactccttcatggccaaagcagtatcagtcagctgatataggccggagttcttaagcatggtggcgttagccatgttcccggctgcacgcagcaaatccggaagctgtccagcgtcagcaggtgccccacccaggataaagtcgatggtgtcattgacggtcttctcccacttagcggaatccgctagcgcgtgcttagactcatcaatcatcttaacgagctgtcccaggtcctgtacgcctgcataggccatgcctacacgcccagacatacggttagtgtacccgtgcataaccttggctacatcagtatccatcaggtcctgcatgcgcatgctcttaccgttcaccagatactctttgtccatgttgaaccgagtacgctgacgcagattccgcgcaggggatgtgctaccggattcgcgtacgttaccagccaggaaactctggattgcagactcatctacaccagcgctacgcatagccataacgacctcgtcgttacccataccgttaatcagctgcttccacatagggccagactgcccggcgcggccattatagataccgtcaaccatctccttggcaacacgctgcactacctctgactccatgctcgggtacacgtcccgcagggcggaccggaacagggcgcggtagtcgtccagagtgttaccctgtgcgataccttgacgcatcttgtcatagctgtactgacgcgggaagtagtagtcggatttaaccaacgcaccatcatccactagacctgcattgagcatatgctcgtgccacttgctagcccagccagagcggcgataggcgtcaaccagtggagcaatctctgcatccggcaccggcacagcgcggccatttacatcagcactgtaggcagcatccaggtacttgctcaggcggtcttccagtgcagcccgctcagcgcggaacttgctccgatggaagaagcgctcagagaaacctacacccttatccttcaacgcacccaggatagcgtcttccactacgctggcgctggcgtccatctccaaagtaaggttgcgtttgaagtccactacggacgggcgacgaccccctacggcggacgcatccgacactagcagcttagccaagtcttcgttgccttgggcgatgttatcgtacagggcaaacatagtggagagcttcttcttagcgccgtccagcatagcttgggcacccttagcctcgttgagggtagtgctgcccgccaggtcctggaaggcttcgctacggaagctctgggcttggtctgcgtagtccttagctgtccacttaacggcgtcctcatacgcatccaggacgtcctccaaggcagagcctttggccttgatgcccagggcgttcatgatgtactcacccagttggcggagcatgctcttaccagttggggatttcgtccgcgccagatgctcaacccactcagggctgtcgcctaagcctgccagcatctcgtgcacattgcttgcgtaataccgcatacgcggcgtcaaggtggagtctgctgcaataacagcgcgcacttcctccaggcgcttagcaatctcgggattactgtcaacggcgcgtgcagtggcggcatgaatcagttcgtgcacggctaccttgctggtgtctgcatccatagcgcgcagtgcgtccccggctgtagtccaggtgctgccattagctcgcttaggtgcgcgtagagatacctccccgcgcctagctaaatcttgttgtgcgtaagtgtagcggctgcggtttgcggagcctgctaccagtttaaaatcaatgtcgtttacagcatcacccagcgtgtccagaatagccttctggcctgctgtcaagtgttcagacttcttcaagaactgaactacgtgctgtgctttcatgttcacggaggcggtattgtttctcgatactaggatgctttcatccagtgtcttagtgagaatttcctctccctctcctactccggtaacattagcatccctcgctgtacgagttgtaggcgcttctgggtcgaacataggctcacgcccagtacgagccttagcggcagctttagcagccctagacatatcccagagctggtctaacccagctacgcccgctatcagtgcagttaccgcggcggactggcccagttggtcctgtgcatagaatgcagtacctacatcagcagcgcgtatggcggtacgtgcagctaagcccgcgcggccagcaataccggcggcaggcatcggggccagtatgaacggggagtcgcctaccaacatacccgcgaacccagccactgtgttgtcagccattaagcggtcacggtcacgctgctcaagcatctgctgcatgcggtagttataatcttcgaccgacaccgagtcgtgcaagtactcaatctcttcctgatttggggcgtacagcttagctcgggtgtcgctactcagggtctgcttggcattaaagttcaggtctcggtcaaatgccggagcagaggccttacgtatagccgcagcgatgatgctgttacccatacccgatgcaaagctctctgcggctgtagtagctggggtcttggcctgcgccagtaaggaggcacgctccagcgcgttcaggccgttatctccagcatcattccaatctacgcgctcaggcgcaggtttaattgttgcgcccttagcagaatccttttcctgtggattcggttctcggttcagaaactgagccataatatctcctaaaagaattttgataaggggaggccccgaagggcctctggttagtgcgttgcttcaaagagccaatcacgtaggttttgttccaggtacttcttacgctcaggttgggcctgcttgtacgcagcggtattccgcagcgcttgccaagccctacccttggcctcagatacagggtactgatacgcccccaccggggacttagcagccttgcgcacctgtgccatcgcctctgctacggggccagagctaccgttaccgccgtgatagttcaggtccaccatgacctttaacgcctcgtcggaggcagtcaaaccctgtcccttgagttgcttctgcacgttcggtatgtactgcttctccagtgaggatttgaggatactgacaccgtcgtcaatggtcactttctgtgggacgggcatgcccgagttaacgtgcagaccgaaacctacactacccttgcctttgccttcccggaacccttcgaacttcatagtggtagcgagaatgtcgctaaacagcgacggctccagccctaccgagttacggccgttgacctgtacgctgacagcacgcccgttgtcgtggtcgtagaaggtggcgggacgcactcctacttgctcactgccaatcttcatatctccagccagtgccgaatcgtacgcagcctgcgcagtcgtctgaacgtctcgaaggttcacagacatcgtctggaaggtgcccttcttgtcgaacacggttacggtcatgttctgacctgcgttgcccgcagtggcggcctgcacgactacacgctctatgttgctgtggtctgacatatactgaacctggttctgtatatgctgctgcagggaggccttgaattgctcttggtcgcccttgtaatcacccatgatagattgcacagaggtgcccgcgggcagatacacatgcctaggtgccccagcaatgtccagctctaacttacgggattggatattgccttttagcatcgtattgatgtcgtcagcgtccttccctacaagggattccgggttgtgattatacatataacggtactcctcttccatagcagcgcgagcttcctggcgctgggcatctgcatccccgaagaagctaaaccagttggccgtgccacttgggtccaccatcttgtccgtggggttactctggatattgctgtagcgcccactggccttattgcgtgcctggcggcgaaggtcgtccaagatagtgttactggcattatttgggttttgtgtaacagctttctgcaccactccacgccactcagatgggacctcagacagcagcgccatcttccctaagtccgtactggtgctataagcctgtgcccataagttgatgctatttacgttctcgcgggaaacctcaccatcctcaccgagctggtccagcgtagtcagcgtacgtgccatatccgaagacatacgcttgtgcgcttcgttgactgcccacgcatccttgctgttgctcccgtatgccagcagctgcaggttcccttccggggtgtccggaaagcttttgagcagctcgttgcgcgccttacccaggtcgcccttgtacatccccgccagggtggagcttggcatgtttccagtaattgctgtgcgcaatgcctgggtgtccgctgccttctcgcgaatggtctgggccttgttccagaactccatgctggccccagcgctgagcaccccattggttgactgctcaatgattcgaccacggatacgctgcatagtctgctcttgctgctcaggagtctgcccttcaagagactggattgcatcggagatttcgaaacgggcttgggtctcaatctgagcacctgcgcgcttgaactcctgatacagtgccgcgttgacgtccactgagttaaccccgagttccttggtagctaacccttgcagctggtttattaccatcgggtcctgcgtctgctgcgccacgctgaccagatactgcttggcccggtccagcttcttgctcttatccaagtgctcagcagccagtatgctatctaaaccggtcttgatagacatctgcgcagcggcaccctgtcccgcctgcaggcgctgatagaactcatcactggacgagctaaggccgcggtcgagtgcacggtcagcctgcgccagggcaaacgcagctctacctttctggaaggctgtgtagttcgccatgctggtagcacggagctgctgcagtatattcgtggcagactgtttggacatgtccgggagatacatcccgagcttgtctgccattgactgtacgtgctcttgctcctgctgctggaattcctcgtcagtcagaccagactcagcagctttcttagctcgtgcgatgctatctgtgcgccacttggctagagagtcgtacgcggcggcggatacgtagccatcctgataggcctcacgtacgaagatgttctgcttctgtacagcctcatctttggaagccattgcatctactgcgccctgggcatccattgcgccgcgcaccgttgcggctgcagcgttttcttttactgcttcgtcaaaccctacgccgaagtcctgcacgaaccctgacagggcagctaggcgttttgctttggaggtatcaacagacacctcacttaccgttgacggtaagctaacatcgttggactgcagttgcactcctccgatacttaacccctgtctactgggttgaatcacaggcatttgacattcctcttaagttaccaggtatgaactgagctgttacctttgctcccccataaatcataggaggacgccatgttctgagtagctgctgcaccacttccgggtgttgagctaccagagtcagtagacgacgcagcgttaccagcgtactgcccaacggcagatgccccgacactcaacaacgagttaaacatgttatcgtaggggtcctccatgtccatgttagccaggccgctgtccacggccttgtccgtcattagacggaaaccctcttcctgagttgcctgctggtcacgcacgctggcctcttgtcgtccggctacagtgttcactgtggctacggcgtctttaacagaggcccccatagtaccggaagctgctgcctgcagccctacttggctctgtgcctgcagcttctgctgctggatgttaaacagagatacctcagtccggtccctggactgggctcgctgtagcgcgatgtcgtttagctgtttggctgtctgttgaatcacagccttgttcctggccttggacacttcaatctgagcaccatgccccagaacggtcttagcggccatggccgcaaccatccaccacatattaaattctccgtctgcgttggttgtagcgcaggatgtacgagatatccagcacattcagttccatagaaccctcagtaaataatgacacctcggttgtgtctgcgttagtacggcatggcacggtaatcgtagccaggtccatacgcaggacctgcccgagcgtcagctcttttgagttcatcaggatacctgtcagttccccgccccagttgacatcccgtggggtgtctagtacctgcacatagaagtgcccagagttacgtaccgccacatccaggcgcagcaggcgcacgtgcccactccccacgagcttgtcattctggtcccgcagaataggtgtagttagcgtgaacgtactgcggtaacgcctcccgattacgtaggtgccatcaggtacaccgcgtacaacccgcagggtgttctccccggcaatctcctttatgccaacctcagtaggtcccatagggttactgggcaagtaagttaggataagctcttcctcatagcggtcagcccacccaactggacgcagtactgccggaacggtgaatatcccgtcctgtacttgaacttgcttctgcaaatccgagtacgcttcgcgatactccgaacccagctggtaaccttcacgcgggtccatagacacaatcaaaagcttgttgctgggactgggcccttgcatgtacaagaacacttcatcctccagcgcttgtacgctcaggattggatacgggaacgaccacttatgccacgccgcctgcatcttagcgccgtcacttccgccccacatgaactcgtagaccagcaagctactacgctccccagacatgcgcgagaaggccatattggtgacactggagttttgcatctgcaataccctgcctgggatataccgcggtaagtgcaccgtagaatcctgtgtagtatactgcgatgaagtatacggcgatgggatcaactcaagaatacccgcgtagctgtcgttgcgcttgttcgggtaaattactgtctgccctgccatgaccggagtaacgcgactatcgcactcataggtgctggtaatgctaatacttgcgttagtgggggtgagcactgctgaacccggcacaacggcctgcatgctgttagcaaacaggaccaggtccctgttaaactgtacagcggtacggtacacagaatcctgcgcagacgcagagctaatactgatacggtccgtatccagcagtgacgtcacagtagagcggtagaagcgctgatacaggcccgaggcggacatatccacagagctgccgctaagcagaaccaggcgaccctggaaagctgcaatgccagtaatgtagccattctcgacgaaccccggattaccgttgttatcgtcgttgcctgctaagcgcccttcccaatcccgcgcaataatattgtcatccgcggcaagttctctgggcatgttcgtaatcttggtgatgctgccgtacgcccccacctcagaccaggtgcgggtgctgtagctgaactgataccacgctgtctcagacgaggctgtacctacacggcacattgctccgtcagcttgcgctgggagctgtgcaggcaggtcctgctcctgatctacacgggactggttggataccccagcgtaagtatcaccggcgtcagaggacaccacgcagttgctcagtccatagaagaacaggtacgcaccgcgtacgctcacgttcccggcgggcatgccattagctacaagagagtcccgcagctgctgagcaacgtaggcacctgatacctcctcagcgttaccgctggtgctgccagcagctggggcggtgtagtcccctgagtagtctacccctgcggaggtaactgtgacgttccagcgtttctggaatgctgcagacttaacgtagaagaaccccgtggtgctggggtcgatacgcccagtattgtccacggttgtgctaggagccatctccgtattcaggatataagtcagtccggcaatgcttgcggtctgcaaagaggtctggcctacggtggtaacgaagtacgggtcgttgccggaattaaggatggtctttccattcttagccagcaaccaccagttaccgttgctggtgttaatcagcaggtgcctaccgtcagtgccacgctcgacgtattcagtgaacagggagtcaagcccagggttatcgattgtgctttcccatacaatctcacccggcggtctacggcggataccggaaaccgggtcgctgagcatattcagctgcgcccccagttgtcctggttggcgctctctcggaacctgctgggaaacgccctgcagcaagctctgaatagtaccttctaatgattgcgccataacctctccttagaccataaaacgagcgcggcggattctgcgtgcaaaacgggtcttgctggtgctgaacttctgattgcgcagatgctcgcgcagcaccatgctcttgtaccgctcagcttcctgtgcgtaattagcgtagttgctgtcaccgcccaggtcatttaagtatacctgcgcagtggtgtagttagccacccacatagcggcgtgctccggcaggtcctcaaaggccaaatccagtaccacacgaatacgcacaggcgcatcgaagtattggttctgctctaccaggtcgtataggttcccgtcacgtaccccgtacttggattctgagcaggcgtcatatacagccagctggttccacggcaccttaatcaggccgtcggtggtgggcgtaacttcacgctcgaccacgttaaaccagaatcctgtgctgagcaacccacgacggttacgtgcaagtgcagagcgagctaatccagcgctagggttactagtgttgatgtccataacgcgggactcccccagggcttccagcgtcaggttcacagcgtctaattcacgaataaaccacccccggcacgaaaccgtgctcttcaagtttggcgcgcaagtacgctgcacgagcatctagtgcagtatcaaagctgccaattgttctattcttaccgtggttgcatatctgcgccacgaatttaccctgctgcttggcaaagtagaatcctctggccttagttaagttgcacagattctgccgtacagtagccgcgcgcaagttctctatccggttatctttgcggtttccgtttatgtggtccacggtgtctggccactccccatgtactagaaagtacaccaccctgtgacttagatacttcttaccgcggataactatctgatagtaccccgtgggtcctgagtgagtgcatccggctgcgtcaccggccctgtacgtgtttctgtacccatcaaccctccagcgtaatccgcttgggctagtagggtcgtacattagtaattctctcatatttgttcctctattaaagaccccttggacctttaagacagggacaaaaaaaaaaagcccctggcacccgaaggcaccaggggcgcgtattactcttccacagtatcagcggctgcatcagccgccttacgggttttcttggtagccttgcggccagactcgaccgaggccacctggatgttcttcgctacatcggtggcggccttaaccgcctcccgctgagctgcattggcctggagagtctccagaccgaacgtagcgattactgccattgaacctccaattaggacttggtggtgaaggtgaacttagtcactgcagcggtgtccggacgacgcaggcctatgttgtacatcgcgtagcagtccagtacgttgctgaactcgcgcgtatcgtcccagatacgggaggtgaacggcttagcttcaacagtcaccagggtcttggacttgctgaaagtcaccatacggcacagcgcgtcgtctgcggtgacagtgtaagcagagcccagcggatgcgtaccagcctcggtcgggaactcggtgcactctactacaggtacgccgttcatcttcactacacgacggtctttgtaaccgtcgttgttggacggaccgaattcgatgttcaggagcttcggatgctccagcagacgcgaataggtatcgacatccaccagagtgaccatatccgccagcggggtcttgcgcttgatgagctcatcaataccagccttgtgcgccaggttgatgttcatggcgttagcctccatctcagcctgggtcagctgcgtggcggtagtggtacccggaaccaggatagctgcgcctacctctataccgtcgttgaacgccggtttcaggtgcgccggagcaacccaggaacggcccttgatgagctgaatcaggtgcgcctggtcgaaggtctctgcgaactcagagccgttgttctggcccatctcggttaggaagtccggaccggtccagtcatcctggtagtcaatcgggttacggatatacagcaccgtatccaccacgataatcatcttatcgttacgaaccggggtgctatccagcgcctcgccggagcgacgacccttcaccgaggaggtgttcaagcggtcaatacggtaggtgttagaaccgctgatagagcgctggctggagagtcccaggaatagagcctggtactggaagcgggtatccacttcgttctgatacacttccaggtgaatgtctacgtcagacgccgcgccgccccagtgcggacgagtcaggttgccattataaatagtgttagccatgccttagtttcctttataaataaaattaaagacctacgcgcttaccagcctcacggcgtgcgagcaaatcattataacgttgactgaactgcggagatgccaagctacggttgcccgcttcctgacggagtttggtatattctgcacggaagtccgcagcagataatgcgttgttgctggctacgccccgtaccattgggttctgtgtcttgataagacccatatcccggcagaagcccgctaccaactcagcggcctgcttaagctcaccagcgttagcgagtacacgagctgcgttacgcagaggttcaggagccttggaattaaacagctgtgctgctacctcccagttctccttcccgcccacaatatcgtaagcttcctgcactgccttggtggcttgtccaacctggtcttccaggtacgccttagccaacagctctgcgtaagcagcgtgctcgccgaaacgttccttaatgaaggccgtatcgattaggttagggtcctgatactccagggccttaccaagtgcccgcaccatatcagagtcagttaacccagatacttgcttcaacatagctaccccggcgtcaatcgtcggattgcctgtctgagccagctcctggggctgctccttagcgctatcgccacccttatccagggctgcttttagggcttcgatatccagaggaatcttagcaggttcaggggaatctttgccctgttgctgctgggtaggtgcgggcgcatcctgcacgccttgattgttcggggcgttaaggggagcacctaggcccggaatcttagggccgccttggttctctacctgtgtagtttctacgttctgaccgttttctacgttatccatctatgcccctgttgttaacttggtaataagcccagctgcttacctgctactgttgggtctgctgctgtcaagccctggagttggtcctgtgctgcacctgcggatacatcggcagacgcatcttgaacttcttgcttctgttgcagctgctcttctgtgtacatgaacggctcgctgacgataccgtaggcgtcgaagtaccagtctacgcacgcatccttgttgaagcgtggagtaatctgctccagcaccgggatagccagttgcatggactgcgctgcctctagcagcttatccgctgctgcggctttagccagtgcagaggtacccaccgtaacgttgatgctcactacaccttcgctgaggtacagcttaaagcgaggatataccagtgcagtgtacaggtacgccagcttacgcagccatgtgtcgctcagaatactgaacccgccacccatagcggcttccgcctctttggcattctggcgaatctcgtaagccgtgacgcgctcaccttgccgggagttaccggtgtacataaacgcacgcgacagtttctgttcgagcatctgaatgttgctggcaatccactgaatcttctgggcagagccaccctcgtaagcagtgacgggggatttgctgttcccgttggaaccgccgccgcccacctgcacagcctcgccagtctccgacgttgcgaactcgtccacgtctaacccagagcttgcgtcaatcagcgggattaacctcgcagactcaacctcgtagttagtcaacgcttccgacagtaccgataatctggcgaagtccccggcgtagtcctctaccaagccgcgcccgtagtgttcgccgctaacaaggttccacaccagcacgttgtagggaagctccagctccggataggtgctgctgtctccaatgcggtgcccgtctgcttcttggtacacctcgtagcttactacctctgcaccgtcctctgtccgcttaactttgcgacaagcggcagtgtagatatcaacgtcgccgtatgggtctttgtcacggtagaaggtgttccggaaactctctggcaggtcctggacgcttgcgcgctctctgataatgagtcgcaggacgttaccgcttccatcccttcgaacggtaaagttacggactgaatagacgatggatttacctgtccgctcatcaatatactccaacgcgttacctgtaaccagcagcagcttcacagcctgcaacttcgcagcataaccgtctttctcaaatactttctgtgacgccgtgttctcgacctcggccaacttagattctgccgtagcagcactgcccagcgaactaatgaactcgtccaggtccgaactcttggagaaccggaagaagctagtgccttgcgggaacagcgcgcctacaatcttagtggctgcagtgttgaccagctgcgcccctgtgctctggtaatcacgctccaggggcctgcgtctaccgtccagggaatcgtcccgggtaaagatagtgctgagcgtccactgcgcaaacttctcagaggcatccaagacacccgcgtcctggtccttcttaaagagttctgctaatgttgctttttgttccaagctacccccttacaggcccagaggattgctctgccctgcttgtcgccgtttcttctgctcagacgtaattgcctctgcagatgcagaggcagcccctgctgggtcaatctcagcaatgttatctgcggcgctattagcctctaaggcagcctgttgtttagctgcgctggcctgctgctctgccaagcgctgctgtgcctctaatcctgcgttgtcagtaaggccgagcatatccgtggccttacctaacagtttacctaaaccaccactcattctgacctcactaaatgataagttgtcttgtacgtgttatccgatgtgctccggctaatggcaatacgcccggcgcgcatgcacttggctatcgcgtgcatcccctgcataatcacagtcactgccgcaccattttccggttttagtacgaagaagtctgtatacagcacaggctctacgtaatgacagtcctccacagcttctggatagtagctgacagcaccgactaatccgccttgggagtcatagactcctagtatatactgtttacccaatatacttcccagcactctccagtagtgctgctctggagccaggccccgactaatgccgtggcccagttcgtgcagttgcttcactgcgtctgtaatgtcgtcagacttatacagaaccttgagagtgtaatcggaagttttactagtgtgttttaacttcattcctactccggtaacttcatttatcagcagaagtattcggcctttgctttgcggtatgcggcctcagcctcgggtattgtaccgaaggtgcctagatggatactggcacctctttgggtcatccttgcggcgtacttgttcccctgcttccgtacgcccatgggtagcttgcgacctcttgtaggggtcctgttgccttggtttagacgcatactggatgcgcgtaaattggtccaagcattgtttagaggattcctgtccgcgtggtctatcacatccggtggctcttccccagtgaccaggacccacgcaaccctgtgcgccagggtgggctgtccggccacgtacaccattaaataaccattactgtacacacttccggcggggctgcccgcctttgcgccgcgctggtttatgcgccaacatagtgcgcccgtctctgggttgtacgtatagcgacgttgtatttcctctaaatgcggcagtagttgtttaggcataatatcctcatgaaaagaagaaaggcgattccagcacttgccggatgtccagggaacctacttctggcatatccaaatccgtcaagtccgccccagctgctgctgccgcgcgagtaatatccccaagtaggtcatgctcttcgtataggctcacaaactgttcgcggatgtgtcggtgcatagcgtcaacgtcagctgcatgtgtagccagcgagtcgtgaataggcacgatgtccaacccttccgcggcacacagaaccatcatcaagtgcgtactgtccaggctatgcacaaagttcggggcaatcccagaggctgccttgcgcttgttacaggtcttgaaatcccggttatgcacccgcatgacggtgaggttcatgcagtcaatgcgtacccgcacttcttcacgctgcgtgtaacggttcattacaagcccacccagcggcgtataccactgcagatgctggcttgccggtacgcgtctagcgaggttctgcaagtaccccataactgccgcagcagctgggttcgcctcttcgatagcggtacgcatacgcggcgccaggtagcacgacaggttccacaggctgttagtctcggcaccctcgtatccctcggcgcaagcaccttcgaagatgtagtcgctgcagctgcgcaccgtagcgctgtagaaataggtcatactggggcgcttggtcatactgcgggtgatttcgttctctctccagtacgtgctctggataacgaaatcctccttgtccaggtccagtatcaccttctcgtccgtacggcgcttcacgtccatgtacaggtcagctttcttatagttaccctcccagtacaggttcgtcagacgcccgcccacagggtctctcaggagcgctgagagatgctgcccacctgagtttgtagcgtccatagcaactgggattcggctaatatgctcttctgggcatccagaacgcacagcattaaccaggtcgatagcggcggccaataggcaccaagggctgtccgcggaggtgaaagcagggcaatcaaacggtgaaactgtaagctgctcaatctctgcaaagttcgcatcaacccaagctgcgcggtcttcgaataaggtcttgtcataaccaaagcatgtggcgacatgcaccttgagccagaataagccgcgatcacccagaggttttcctctgccaaactcaagaagggctttctgcaaatcagaaccttgagggtgcagcgaggacttgaagtacaaccggtaccgccaatccacgcaggttgggaagtacagagctttctcatctttgaattcctctgccatttctaacgtagtcaaaaggctgcgcagttgcgacacacgcttacggtctgcgctgtaccacagggacatgcgcgtcttccactcaccaaaacggtcaagctcttcctctgtgtagttctcttttggaacaccatccaagtaccactccggtttcggctccggtactgagcgcggcatgcctatcccaacacccatggcccgtgcttcttgcaccagttccagtatgcgcttattaatacggtacggggtttcctgtgccttattaagcgcttttttaatgccatccgcggacttaaatgcttccgctacttcacggagacgagctctgtcaatgtgcgagttatgataggtcccgcgattgtcgataggggtgaggtatccaccatcccacagagtagtgtgctgcaccggcggtaccagcataggcggcttcatggttacagtgtcagcggactctaccagtttctggaaggcctccataacgtcgtcagccggatagagcatgctcagattcccgctacagttcttccactggaacaggcccgtctcaaacaccgcggcacacagcagacgccctacggagatgttctgggcattggtccaaggctcgtgcccatagtgcacgttctcggcactggcgcggagcgtacgcaggatgtgcgtaggggacttcgtacggcgctctgtgaggtactcatacacacggtccatgtacgcaggggctacgttgcgtaactgcagagccagtagctctgactgtacgtttctgcccagtgcggacattaccgcctgtgcagtctgacggcgactggcggactcgccaggggcgacgctgaacgcctcaaacattgtgcacaggctcagagtggtcaggacgtccaaggggactaagcgcaggaaccgtcggtacttaccaccaatgcccggggctttgacatttcgcatctcatcgatagcggcagcagccacctcatatgccgaggtgagcatacgctgcgtcatcggcaggttcataatcccgccattctgcagtgcgtccgtaatcagcttacgtgcccgctcgattccgcgaatcttataggtctcttcaagctccagctggcgcttcaccagtgcttcctcgggtactacaaccgtattcagggcgctaatcataggcgcttagtctccttggttatgtccggtacttctaactactgattgcgactcacccagagattgtacatctccagatagtctttagcggagctttcgtcgccccgttctactgctttctgccacatcccgtggcaccatgcgctaggcgtcaatgcacttacctcggtgttgctcgtacagttctgagtacttgtcggacttggcaatgtcctgctccagcttatccttgttcccggcgcgcagtctgtacttgagccggttccccaggcagtatccgtagaactgctctttcgtcatactgcgtgcaatcacctcaattgcctccaggtccgggaagaactggtagtgccgaggagagttcactgagtcagaaacagcctcgctcttcgaatggaagagctggaagaactccgctcgccaagaggtcccacactcggctaaggttataagtccgtcttctgcgcacgtcactaatctgggggagtctaggtctacctgtagctgttcacagatgtccttccagataccccctacgtgactcgctttgcgcacaaccaaatcacctgcatagaatttagtggattcaatcatttaatagtctcccgtgctttgcgtcgtgcccgggccttgcgggccttgagcttctgtgcttgtgctagttcttccggcgtcttgtgcgtatagtatagcatatccgtaggttctcggtctaagtaatcggcgaccctacgtagagattcagcaatagccccagaagattgcatgctaccaacaatccagcgcccagcggcagatgccactttgccttcccctccattgcacgagcgatgaagagcaccccgaatacgcccagtaatatgacagtggtcaacgacaacagaatcaccagttacccccttgattgtgaagtccaaaggtttgccgcagaggaggcatatacctccctggtctttggcaagcttaatagccacagagcgaatctgtgctcgagttattttacgcagcgccatgaaatccctcttaacatatgatataccgtactttgagccatacccaggcgtctagctatagcgttgctaccccattcccggtccccaggaatgtgcatttgccgcagatagcgcaccgtaccttcgttcaaacgtgagcggccgctgctggaaccctttgctgatttgcttttgtgggtccctccatgcaggtgctcagggttaatgcagcgagaatttccacaggtgtgctgtactacttcgggccactctcctgtgtgttcatagtacgccttcctgtgtgcggttgtaggttggcgtttaccgtcaataagcacccacgcggataggaacccagtctttggccgcccctttctcccatggtctatacaaggtgtactcattaccatacctcaatccccccaactacatccagcatagcattgtcgtgaatgagagaatccaaatgctcaaccgttcttcgatgtgttttgggtgctcgttcacgcagcgcatccagaatagtttcaagttcatcgtgtttcccctcgtagtataactcaatcgcccgcaggctcatttccttcgcagacatcttcgccattgtctgggtgctcctgtatccactgtatatgctgtttatggtactcgtgcagcgaatgcacccagtcacgcagactgggagtagtcaacagtgacatcagatactgataggcagaatctgacggggagcgccgcaggaacaggcattctgcctctgcgagtacgtcttggttgtttcgagcgtaagccgctacgacgaattctgcggcgtcctgctctgaggtaatagggtagatagcatcaaaggccgttcgcttgccacagggcttcccatcaagcaacgtgatgcctttgacgttatctgcgtcgtcccctgctagcatctgccaccagaagaacttcaacccgtgtgctcgtacaggcatagcctgggtgtcatcccacttaatccatccgaatgggtcctccagtgcaggccacactgtacctgtcggtatatcgaaccgagccatagggctgagccaagaatccttgtcctgggacatcaggattccccggtctccgaagctgtacgaatccattacaaagaggtcgtcggcctcgaagtagtcactgctgactacctgaataccctgctcagaatactggtctgggttctcaatcaggtgccgcttcaacggtgccttgagcggtagctcctgtcgattagcgcgctgcccctgatagggcttagccgtaggcaggtgccagcgcaagcacttagcacatcctgcaggcgtcaggtacgccactgcctctgagcagccgaccaggaacatgtcctcaagcaccagctgatagaagcggcgtattgcggtatccaaacgttttactgtagcggcggctttgtacacgcaaaaatccgcatcgtacagcagaatcttcccagagttctgcggagctaactgctcgctaagctgggacaagtcaaccccgttgataatcatcagcgccccgtaatatcgcgggccttcttgtcggcccagttaacccaacgttctgcccactttgccttgctcagcttatcgccaaggtagcacagtcccgccaatggaatcagcgggagaatcaaagctacgtaaattgcgcgagatacgtacaacatacttaagcctccagttcagacagcaccagcacggtgccgagcatgtccccgattacttccggagtacgcaggctctggtctacgtcgtagatacaggagccaatctccgccaggccaacgctgagcgtgcccactacgcggataagtacaaggtcgtctcctcgtaacttatcggcatgtgccgccagatcgttgtgctcccggaaggctgtagcggccaggtccaggtccattccgtacagggccgccagctcatctagtgcgttgtagatgtcgtccagactaatattaagcaccccatacgccgctgcatcgtataccgctgagccgaccgtaatggcaaggttctcgtacgcttctaatactttatccattagtcaaatcctttcagtttgtgtttttgaatgaaggcgtaggctttggtctcagtggccgtggcctctgcgcccagggcgtatgcacggcgccgggacttggcgcactggcgattcaagtgataacgctgcgcactaatctcgggacccagaaggcttgccctgtatgcgtgagagctagctgcccagcgccagtcgtctgctcgcttctgcaaacgctgtgcgcgcagaagcagaaacacagcgtactgttctttggcccatgtgattatgcgcatttatacccccaggaagttagctacttcgtcacgcttggcacgcaggttatcagcatgacaagcatgcgcttctgctacctctttgctgtgcttggaggcctctactcgcgcctcggattgagcggccagacgtactgcgtcgtctgcgaatttaactgacagctgctcgttaaactgcgctttggcatctgctcgtttagcttctgctgtgtaggctgcactcaggagtttgatgagaatgttgatgatgttcatagtcttcctctaaggccccatgcggggccatattagtttaggttagggtagattaggcttgaggtgcagcaggcgcagcgggcgctacaggagccgcaggagccactggagcagctggggctgcaggtgcttgcggtgcagcgggagccgccggtgcagaaggagcagcaggtgcctgcatagctgccggactcggaacagagccagcgttcagcataatatccagagcactgcccgggaagtctacggccttgtacatatcctcctgaatccagttcttgctcttaccgtcgtcgaaggtgccttcgatgtgtaggctgtcccaggtctctttggttgggttgttccacaggaacagcttaatctcagaggcatccagggctggcatcttgataggctcgccggtgttcgggtcgaacttcggaatcgggcggataccggacaggtccacgatgttagacttcttgcccgcagcactggtgtgctcatcaatcgggaaggtgaaggcctgccccagacgctgtgctgcatgcttaatgctattgtcgtagttgagcttgtcgaagaacttcttgaagcctgctcgctcaaagttactgatagccatcgggtacgggcggatacgcttcacttcaccgttaggaccgtacaccacaataccgatgcgcacgttagccactgcaggcttaccagtaggcttaccgcccttagttggtaggcgcttaccgatttctacgtactcggtgaagtagccgtagtattcgcccttcggaagcagtacatcctcatacgcaccgccctgtgaggtttcccgcatatctacatcttgggtttcgattgctgcgtctaccagagcgttcaaggatgccagtacattagtagtcatataatttatacctcgttagaaaagtgtttgtgatgctgagagataactgcttgccttgctaagtgggcctcttctgcggtagcgtagaatcctaggtggtattgtaccccatctgtttgtatgtaggcacgccacttaccattgcttttacgataagacactccacgataccccgaccgggaatccttccgcaatcctgcattcttcgcgtttcctgctttattggcctcccttaaattgacccaccgattatctgtacggtttctgtttacgtggtctataacgttcggccaacgtccgcacattaaggcgaaggccagtcgatgtgcaaagtattgcctacccttcacacttactaccctgtaaccatccttaatgtaacccacagcctcggaaccgtcaggcctatgcaatttccccgattcggggtcataccgcaaatattgcggcagagaagtagcgtgcatataccctctcgtttagttcaaatgatatttacgtgcagatgcaggacaggcctagcgattcttaagtgcggacttaatgcctgcagccgcggctgccgccacaccgcctgccgccaggattgccaacagcaaagctacaccgccgtagaacggaagcagcacccacagccaggaccaggcgataaccccggtcagtttcaaggttataaagataagacccagtacagaacagattcccattttcattggtaccccta

SEQ ID NO: 47 - DNA, 43154 bp, Unknown
  source: /note="Description of Unknown: MCoc4c Bacteriophage Sequence"
gccgctgcgcagatgtctatcaagaccggtttagatagcatactggctgctgagcacttggataagagcaagaagctggaccgggccaagcagtatctggtcagcgtggcgcagcagacgcaggacccgatggtaataaaccagctgcaagagttagctaccaaggaactcggggttaactcagtggacgtcaacgcggcactgtatcaggagttcaagcgcgcaggtgctcagattgagacccaagcccgtttcgaaatctccgatgcaatccagtctcttgaagggcagactcctgagcagcaagagcagactatgcagcgtatccgtggtcgaatcattgagcagtcaaccaatggggtgctcagcgctggggccagcatggagttctggaacaaggcccagaccattcgcgagaaggcagcggacacccaggcattgcgcacagcaattactggaaacatgccaagctccaccctggcggggatgtacaagggcgacctgggtaaggcgcgcaacgagctgctcaaaagctttccggacaccccggaagggaacctgcagctgctggcatacgggagcaacagcaaggatgcgtgggcagtcaacgaagcgcacaagcgtatgtcttcggatatggcacgtacgctgactacgctggaccagctcggtgaggatggtgaggtttcccgcgagaacgtaaatagcatcaacttatgggcacaggcttatagcaccagtacggacttagggaagatggcgctgctgtctgaggtcccatctgagtggcgtggagtggtgcagaaagctgttacacaaaacccaaataatgccagtaacactatcttggacgaccttcgccgccaggcacgcaataaggccagtgggcgctacagcaatatccagagtaaccccacggacaagatggtggacccaagtggcacggccaactggtttagcttcttcggggatgcagatgcccagcgccaggaagctcgcgctgctatggaagaggcgtaccgttatatgtataatcacaacccggaatcccttgtagggaaggacgctgacgacatcaatacgatgctaaaaggcaatatccaatcccgtaagttagagctggacattgctggggcacctaggcatgtgtatctgcccgcgggcacctctgtgcaatctatcatgggtgattataagggcgaccaagagcaattcaaggcctccctgcagcagcatatacagaaccaggttcagtatatgtcagaccacagcaacatagagcgtgtagtagtgcaggccgccactgcgggcaacgcaggtcagaacatgaccgtaaccgtgttcgacaagaagggcaccttccagacgatgtctgtgaaccttcgagacgttcagacgactgcgcaggctgcgtacgattcggcactggctggagatatgaagattggcagtgagcaagtaggagtgcgtcccgccaccttctacgaccacgacaacgggcgtgctgtcagcgtacaggtcaacggccgtaactcggtagggctggagccgtcgctgtttagcgacattctcgctaccactatgaagttcgaagggttccgggaaggcaaaggcaagggtagtgtaggtttcggtctgcacgttaactcgggcatgcccgtcccacagaaagtgaccattgacgacggtgtcagtatcctcaaatcctcactggagaagcagtacataccgaacgtgcagaagcaactcaagggacagggtttgactgcctccgacgaggcgttaaaggtcatggtggacctgaactatcacggcggtaacggtagctctggccccgtagcagaggcgatggcacaggtgcgcaaggctgctaagtccccggtgggggcgtatcagtaccctgtatctgaggcccagggtagggcttggcaagcgctgcggaataccgctgcgtacaagcaggcccaacctgagcgtaagaagtacctggaacaaaacctacgtgattggctctttgaagcaacgcactaaccagaggcccttcggggcctccccttatcaaaattcttttaggagatattatggctcagtttctgaaccgagaaccgaatccacaggaaaaggattctgctaagggcgcaacaattaaacctgcgcctgagcgcgtagattggaatgatgctggagataacggcctgaacgcgctggagcgtgcctccttactggcgcaggccaagaccccagctactacagccgcagagagctttgcatcgggtatgggtaacagcatcatcgctgcggctatacgtaaggcctctgctccggcatttgaccgagacctgaactttaatgccaagcagaccctgagtagcgacacccgagctaagctgtacgccccaaatcaggaagagattgagtacctacacgactcggtgtcggtcgaagattataactaccgcatgcagcagatgcttgagcagcgtgaccgtgaccgcttaatggctgacaacacagtggctgggttcgcgggtatgttggtaggcgactccccgttcatactggccccgatgcctgccgccggtattgctggccgcgcgggcttagctgcacgtaccgccatacgcgctgctgatgtaggtactgcattctatgcacaggaccaactgggccagtccgccgcggtaactgcactgatagcgggcgtagctgggttagaccagctctgggatatgtctagggctgctaaagctgccgctaaggctcgtactgggcgtgagcctatgttcgacccagaagcgcctacaactcgtacagcgagggatgctaatgttaccggagtaggagagggagaggaaattctcactaagacactggatgaaagcatcctagtatcgagaaacaataccgcctccgtgaacatgaaagcacagcacgtagttcagttcttgaagaagtctgaacacttgacagcaggccagaaggctattctggacacgctgggtgatgctgtaaacgacattgattttaaactggtagcaggctccgcaaaccgcagccgctacacttacgcacaacaagatttagctaggcgcggggaggtatctctacgcgcacctaagcgagctaatggcagcacctggactacagccggggacgcactgcgcgctatggatgcagacaccagcaaggtagccgtgcacgaactgattcatgccgccactgcacgcgccgttgacagtaatcccgagattgctaagcgcctggaggaagtgcgcgctgttattgcagcagactccaccttgacgccgcgtatgcggtattacgcaagcaatgtgcacgagatgctggcaggcttaggcgacagccctgagtgggttgagcatctggcgcggacgaaatccccaaccggtaagagcatgctccgccaactgggtgagtacatcatgaacgccctgggcatcaaggccaaaggctctgccttggaggacgtcctggatgcgtatgaggacgccgttaagtggacagctaaggactacgcagaccaagcccagagcttccgtagcgaagccttccaggacctggcgggcagcactaccctcaacgaggctaagggtgcccaagctatgctggacggcgctaagaagaagctctccactatgtttgccctgtacgataacatcgcccaaggcaacgaagacttggctaagctgctagtgtcggatgcgtccgccgtagggggtcgtcgcccgtccgtagtggacttcaaacgcaaccttactttggagatggacgccagcgccagcgtagtggaagacgctatcctgggtgcgttgaaggataagggtgtaggtttctctgagcgcttcttccatcggagcaagttccgcgctgagcgggctgcactggaagaccgcctgagcaagtacctggatgctgcctacagtgctgatgtaaatggccgcgctgtgccggtgccggatgcagagattgctccactggttgacgcctatcgccgctctggctgggctagcaagtggcacgagcatatgctcaatgcaggtctagtggatgatggtgcgttggttaaatccgactactacttcccgcgtcagtacagctatgacaagatgcgtcaaggtatcgcacagggtaacactctggacgactaccgcgccctgttccggtccgccctgcgggacgtgtacccgagcatggagtcagaggtagtgcagcgtgttgccaaggagatggttgacggtatctataatggccgcgccgggcagtctggccctatgtggaagcagctgattaacggtatgggtaacgacgaggtcgttatggctatgcgtagcgctggtgtagatgagtctgcaatccagagtttcctggctggtaacgtacgcgaatccggtagcacatcccctgcgcggaatctgcgtcagcgtactcggttcaacatggacaaagagtatctggtgaacggtaagagcatgcgcatgcaggacctgatggatactgatgtagccaaggttatgcacgggtacactaaccgtatgtctgggcgtgtaggcatggcctatgcaggcgtacaggacctgggacagctcgctaagatgattgatgagtctaagcacgcgctagcggattccgctaagtgggagaagaccgtcaatgacaccatcgactttatcctgggtggggcacctgctgacgctggacagcttccggatttgctgcgtgcagccgggaacatggctaacgccaccatgcttaagaactccggcctatatcagctgactgatactgctttggccatgaaggagttcggtatggctagagtgctgcgcagtatgcgtgaccagccttggttcaaggaaggtgccgtagctatcaagactccggatatggctgcccgtctagacactgtgctgcgtggtaatatccagaaggagatgcgcttccgctggttgaatacgtacgccgacgataacctggacctgacccgtcaggcctcctggttcaacgtcactcagaacgttgggcaggctgcacgtcacgtcaacggaacgagtatggtgcaccggctgcaggttaacctgaactccggcattgtggcggatgagcttacgcagatgttcaagggcgatgctgaggcgtttaagcgtctggagcgtttcgggcttacccgtgacgttgcggaccgcgctatcgctgccaacaaggctaacccgggcgccatgttccagccggacctgcagatgcaagttgaggttgtagggacgcgtatgatggactacctggtacagcagattcgtaccggcgagacctcgcactttgcgcagttcaatcctatcggcaaagtcattgtagggtaccagagcttcgcactggctgccactaacaagattctgcgtagagagctgaacgatgctgggtggattggtgtggcccacattatggcgtaccagttcccgttgatgctgctggctactatggccaagcatggcatggacggaaaggatgtagacacccagaaactcatcagtgaatccgtaacgggtatgagtgccatcggcggggtatccttactgcaggatattttcctgggagattctcctcgtcactcgttggcatctatgggttacgtcacagggctgctcggggccgtacaggacctggctaccggtaatatggatatcaagaccttcactaagcaggtaccgctaatccaggaattcgcacctacgcgagctatcatcaataacttcggagacgattaatatggcgttcagctggcaagagtcggtaaagcctgcaggtactcaggatatccagtgcgatatcgagtacctggataagtcctatattcacgtttacttagatggtgctgagactactgccttcacttggaccagctccaccaatattcgtctgaactcgccactgtctgcagagacagtggtgctcctaattcgtaagactgaacgagagtatctttacattgaattctctagcggtgctccgtttattgaaggcaacgtagatacccagaatacgcagttcctgcacctggctcaagagctagttgaggggcgttctattgagggcttctacggcgatatcagtatgcacggatatcgaatcacccacctaggagacccagtggacactgcggacgccactaacaagggttacgtcgattccggcgacgcccgtctggaccaaagggtggatgcggaagaggctgctagaaagtctgccgacgctatcctggatacccgagtaactaatctagagcagacctttatatccgacagggtcactgtaagctacccttggtttacagtactggatacccccacagacaccgtgacgccgcccatcgcttttagtaaggccatagttgagctaaatgggcagggccaaatccccggctacagctttgtggtagtgggaaattcgttgctgtttgcggagacgctaccggccggtacgctcgtggcggctaggctgggcgcagatgtagaggcgggcgatgggtatgtaacccaggcagcttttgacaactggctggtctcagtaggcgaactggcgtacaagggcccggcaaacgctgtggcggatagtaccgacaccagcaacgttgccacccagctaaacgccctgttagcggagctgagaagtgctgggattatcaaaacttaaataattactggaggcacaatggcaggggcggctaaacgcagtcgcctctcggagctgcaccgcatgttcactgaggccttgattgaagaaatcaagcagtctaaggaagacgaggtgccgctccccgccgcagataaatcggttatcgccaagttcttgaaggacaacgacatcaccgcggatgcagattccgaggagatgcaggaccttcgtgacgagttcgatgatgaactagcggcgcgtagagaggcgcgtaagcaagaaattctaaataaagttggtggttcagactctgaggacttactagaaggaattgtctaatggtatcggtgaagactgcgcgaagactgcgcatgctcaaccagaaacttactggttatagtgcgaatccgcgcagtattcccaaagaggagcgcgaggacatcgcgatgatgatggccgcggcgctaagtgacttccgggaattcgcatacataggtatgcggttcctgggttttacattgacggacatgcaggccgacattgcagagtacatgcagaagggccctaggaagcgcatggtggccgcacagcgtggtgaggctaagtctacactagctgcactgtacgccgtctggaggctcatccaggaccaatcctgtcgtatcctgattgtgtccggtgcagagaagcaggcctctgacgtagcgaacttaatcattcgtatgctagaaacctggcctctactgtgctacttaaaggccgaccccactcgtggggaccgtacttcattcgaaggctatgatgtcaactgcgacctgaaaccgctggataaatccgccagcgtagcctgtgtaggtatcactgcatccctgcaggggaagcgcgcggacctgctgattccggatgatatcgagaccactaagaacggtttaacgcaaacccagcgtgagcagctgctgatgatttctaaagacttcgcagctatctgtacgcacggggatacgctgtacctgggcacaccgcagaccaaggacagtatctataaaaccctgccgggacgcggcttcgaggtccgcgtgtggcccgggcgcattccgtctgttgaaatggaagagcgatatggaagtacacttgctccttatatcctggagcttattgagcgcggctataaacgcaccggcttcggcgtcgacgggacgctaggcgagagcacggacaccggacgctatgacgaggatgcactgattgagaaggagctggacttcggtccggaaggcttccagctgcagtacatgctcgacactacactgtccgaccaaatgcgtacgcgcatcaagctttcggatatgctggtttactctggtagccaggattcctcccctgagacgttctcctacatcgcggaccgccggtacctgtaccagcatgagcatgaggggattatgggccagcagatgtacttcccggcattctacggggacatgcacctgccgtaccagcataaggtgctggtggtggacccggctgggtgtggcggggacgaagtgtcttacgctgctggtggtgctgcgaactcgtacatccacctattctccgtaggcggcttccaaggaggtatcagcgaagagaacattgataaactgattgacctatgcgtagagttagatatccaggatatggttgtggagagcaacatggggcacggtaccgtgtctatgcttatcctgaaccgtctgcgggagcggcgtctcgccggtattggcgtaagggacctgaataactccacgcagaaagagcgtcgtatcattgacacaatcagcccagttactcgtcggcaccgcctggtagtgcacgagcgtgctatccacgacgacattagtacctgtatggcatactcccgcgatagacgttggctgtactccgcgttcgcgcagttgtccggcatcacgtacgaccgcggtagcctagctaaggacgaccgagcagacgcaatcgctatgatggtggctacgctgaacgggcacctggtggaagatgagaaagtggtggctgagcgtgagtatgagaagatggctcgggccttcattgagaacccgctggattgggcacagagcaaagtgtctaagggccttcggggtgtggctgctaggttgcagaaccgtggcagaggtaaacaacatagaggaagaagataatggcatttgcagaagcaacactggcacagcgccaggcagtacgtaatgcggcagtggcgcttgataaagcaacaaccttggcgcatgataccggcccactagatactctgggtccggatgtagatgcagcaggggctgtagcagtggcggcactctctgctgcaggagcctctgacggtggtgctgtagtggtggttggtaacggcgcagaagtaactgcacctattacgttcaccaccgctcgggaggcgggggctaccgctactgtagcagcaactatcactgtagaagatggtgtaatcacagcaatctctgttgagtaaggagcaatactatggcaattgcaaaagcaaccccagcgcaacagcaggagctgctgcgccagctgaacattctcggtaaggacctgtatgctatgcttacgcagccgcaggacgtggcccagacgggtgctaccttcgataccaagattgctgcgctagaagccgcggtagccgcagtgaaggctgctagctaatgcgtaaactggtcgctgggttactgctcgcggttactctgactggttgctcggcgacctctgcactcaccggcttagttggttctaagccggatgtatctgctcaggttggtgccgaaaacaccaagcaaaccgttggcttgaataacaaggtggactccagcaccaccaacaaaaccgatgtatcagattctaacgtaggcactttggacacgtccagtaaggagcaggtgcaaactattagcaccggtacaatccaggcagagcgcctgcaggtggttaacaatgatagttacagtcttatcctcgccggattagctggggccagcattcctctggtcttcctagtggtcattctggtgattcgtaagctgttcaggaagaaggagcagcaggatgattaaggtaggggacgtagttggggcagacctcgctacccgggcaggtgcggcagttaccggcgctacggtatcaggaggttggttggcagagttaatgagctggaactggagcactatcagcttcatcactgcgacggtgtgcgcggtgctaaccctggcgtggaatgcgtattacaagagacgtacattcaagctcctagaggagcaggcacgtaaggggactattaaatatgagtttaaggactaaggttattgcggcccttacgggggccactatgcttggcggtgccattaccggggtggttcagcacaacgagggcctgagccttaccgcctacaaggatagcgccggggtccctactatctgctatggggagacaaagggcgtcaagatgggtcagagagccacgctgagcgattgtcagaagcaactgatacagtcagcaggggaacacgcaaaggcccttgacgggcttcctatgcagctctctgacgtatctctggtggggtctgtggacttcatttacaacgtaggcgtagctggcttcaacggcagtgctgtgaagcggcatctcaagagcctggattacgcagcggctggaaaggctgtactggactggcgctatattagcaagtaccagcagaagtcccctggcaccggttgggtgtacaagggcagcaaccgctggaccttcgactgctcccagtatattaatgggcagcgcaataaagtgtgctggggcctatgggagcgcaggcagtggcagagcaaagccatcgggaaccagtacaagaacgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgtccggattcttccggtaactatgcagccgctattgagcggatttccgctaaaggtgtaaaggtgctgcgagtacctgtggggtcttattatgttggagactgccaccttactaaccctatgctgtttataggtgatggcctagagggtgttaacccgcttggggctgtattcgttaaaccgagcacagccagcaagatgttctactttgacggtacgagcacccgtggaatgggcggcgggttccttagaatgcgactgcagggggctgtcagcagtgattcgggacttatggtggaggtaacatcctggagctattttggggcggaaaactctgcttttaataacttggcgggctctgcgctggtgttacgtgactgtatggagagccacatctccggaaacttattccgtaggatgggtgcctctaacggcagcgttatactcctcggggattacataggtattcctaataacaacgtcaataacctgcacattcagaataacacgttcggactgtgctcgggcgcatggattaagagtacagcaaacagtaacccggacctggtgtggattacggataataagtttgagtgggatagtgtaccatacggggctaacacagctgcacagcacgtactggactttggacagctgtcgcgctcttggattacccgtaatggttttgcgcacttccgcccggactccgaccataacctgtatgccgggtgtattcgtattaggtctggagctgttggccctattgttatttctgataacaaggcgtatggatgcgaaggggaattctggaccattgaaggtggttatgtagatgccttcgacaatgatgcgaacattgcaaatgccagcagtgttctatcctggtcactgagtagtactagggcttgccgcatcaaccctccgcgcgtgtacagtgggaacatgaacgtagtgcgcggggatagtccgttcggccctgggtttatcgggcaggcgtacatgcgtggcgctgctgctgctagtcgtaccgctagggctggagccgctagtactgtagcactggatgttcccgcgggtcaggagatgcgtcggtaccagttgccgctgcaccttctcggggctatagtgcgcgtatccttgcgagtctacaacccgggcgctactggtaacataaccttagcggtgggtagtggcggctcctctgttgccgcggtaccggctggtccagggtggttcgatgtagacttttacttgggtaacagcctaacgggtgacggagatttgcgcttcaccaacagcactggaaacacactgagcctggatggtattacagtagagcgtgctcgttctgttccatttagccttgcgtggacccctggtgctgtcgctgccggtacgctggtatctagccctgtacagactctcccgtacggcattactcaagcccctgtcggtttgagttctccggtatttaacgggtctgttgatgggctgctaactggtgtcagtagctacagtgggtacagatcctacaaagttactctgtttaatcctggggctgcggcaattacccctggggctactcgggctagcttggtgctgcacttctaacgcacagcgtaaagcccaggcccagtctaggcgagcaggtctatacctggacctgaaatttattagactcacgcgagcccctccctcaccctgaacgcgcccaattgcccccatagggggtacctagcgtcaatttagggggggggggggcactgagtgggcctgctagtgcgcaccagagggcctcagcgggcctgtgctgcgttctagggctatcgctagtgctaccctatgcctgtccttgtgcgttcactagggcgcttcctgtgcgctctcagtgcgtgctatgaggcgctagggctatccctgtgcgctccctgtgggccataggggcgtgctctgccttgcttattttgtgcctgtccagcggggccagtagtggggccatagtgggccagctagtgcgctgtagtgctatccccggtgctatccctagtacgcactaggctatccactggctatcgctagtgctttacattgtgctgattatatgctacgctgcgcgctccccactagggcgcacttccactatccagcgctctcccaatgctatccctttgctcttactttcattcgaaagctattatgaaatgaagtaaccggagtaggaggggtttagggacactatatacactactactcactatgcactccctagtatgtccctgtgcctacgcagtaggctgacatacctacacagtcaccgcatcactacgtggcttcactctcgttacgccactgcgttctgctctttgtagtattagatagtattggctcgtaatggctagcagtggctacagctagtgccagcatagggctatccctgatgtggttctaagtatttaccctgcttaccctttttgctcccggtgataaaaagcttaaaaaagtgcttgcttcttttggttcaatgggtctatagttcaatcaccgggaggcgctgaggtgctaaccggggccgagccgggaggctccgctggattaaagctagatagtgcgaagggttagacactcgataaaaagagttgacaccgcgaagggcataagctagattgagtccaagcagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttccgattcactgagtaacttagatagcaagcagtaagctgatttgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccccaccgataacgtgccgcttactgtgaagcccagcaaacaagggttgagcggtgagcacagggtgaggggaaagcaaaaacaaaagggcggcagtaaacagcctagtgggtggcctgctgttaactcccaatttgggcactaattacagcctatagcatcctatggggtgctatgtggagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgctggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggcaagtacgagttcaacgctaagaagtgctatgcgtcggctgagaagctgggaatcgaactggacactatgcgtcttgactacaaacaagctgacaagcagggccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggcagtggcctagtagcaagcctatagcgtcctacggggcgctatgtgaatgcaactggcgtatgaggtttcatatgaaagcaatactggtctatccgggccatgaactctggcccgtgtggtgcaatcggatatacgaagaatacagctacactgtggttatattctctgacaaagacactaatcaggaatcccctttagaatttgtggatacctacaccgaaatggctgcccgcactgtgctggacgccgtgaatcttggcattatcaacgactggagacaactctatggttaatgtattcaacatcattgtgaccagcgctatgctggtgctgggcaacgacgtaaacaacccggtgccctattgcacagtgcagttgcagcaaccggcggcgcaggaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtaaggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgcctgcgctttaatgtacgaggtgtagtatgaagtatgacgtgtaccgagagacctatagcggtctgtattatctcatccctttagagggggcaattaatgagcgccgcatacttttaacctctgcgggattaatgcggagcagttaccgagcaggtgacgttatcacctctccggcttttgtgttggtgtcacgaaactgcgttcctaagagaagcctatgctaacagtagacgaaacagcgctgctatgctggcgtctgctggaaacgcagggcaagtgcggctgcacttgggaaacattcaaagaggttcctaatgaactcaagcaaatcataccggtcgagcgtagactcctccgtgttcgtaggcaggactctacggtggtgctcaccacgtaccgcgagtatacagagtctgccgcgcggtagttgcaagagcacattaagttcgatgtggttgcagcactgctacggtacggatatcgtggagcctatacaagatttagggcggctgtgcgctcgtattataagcaaagacagctcgctgcgtggtatgcgcgctgacttggcagttaacgacgaactcattgaatctattcaggagcaaattaaaatgcaagagactatcaaagaaactgtcacagcacctatcgaatggaaagtagtgttgccggaaggtgcaaacacactgccaattaaatgttcgatgtattccagcggtgattactggaccccgttccaggacttgcaaatgcaaggttctgaccaccctcacaatgagggtccgctgcaggcgcttatgggtctccgcactgtcagcgcttacacccctggcttagaggtgactataggcgggatactgcaccctgagtaccgcgaagtaatgatgactcgcggcccgttgcaaaaggtagacctgtaccggtctggaactttctacgaactcttttccccggcgcgaatcaccatcgacagcaagttctgggaacgccgccgcgacttctatgagggcgatgatgtagtggttgagcgcgtagttgctagtgtagaagagttcaccggttacaaggtgcacaagcaggccgtgcagttattcgagcgcattatgcttgcaccagaagagcggcagcgccaggagtacactggctacgattacggacgccacctccgcgatggcaacgccgctgcgctgctcatgaagttgcacggcttcgtagtgtctagattcgccgtgcctttgggctttggtttccgcaacggtgagcccatcgtgatgctggggcagccgcggatgcataaggacttcgccgcagttaatgagtaccgttgcgtagagatgcgcgtcggtaagtggctcgctaactactacggaaacggggtagacttccgcgatgctatcgaagacctcaaggctatgaacgtagaccctacaacgtacctgtgcaagaccgagcaggaatggtacgacgcctacgagaatggcccgggtagctgcatgagcgggtactcatttaagcatagccctgtgcggacgtacgccaccaccagccacgggttgccggataacgggttgcgcctattcatccagtataccggggagcttttcggggacgacttcgaagtgctggcacgagcaatcgtaaaacctgaaaccaaagagtacgtccgtgcttacggcaacgctgcggatgcaatcctgcgggggcatgggtacaccagaaacactgaatgtctcgagggggtaatgctggcacgcataccgcacccaacctacaacggcgcagtgctgatgccgtacctcgatagcagccagtgcggtgttgatgaagaaggcagtgacgcctttgtaatccgtgatgactacgagtacgaggcgcaagaagccgatggatacatctacgtaggcactgaatctgctcggtgctgctgctgcgaggggcgctactccattgatgatatgcacgaaaccgccgacggtgaaatggtctgcgacggctgcgccgaagatggggactttgtatatgtagttggccgagaagggctgcataatcgctggagctgcacttggtctgattaccacgacgcctatgtatatgacgcggacattgagcactgttcggtagagggggtagtgcatgaccaagaagaactggtgtatgcacaggaccgacaggtgcttattgagcacgcagaagaacaccctgtgcacgggttgattctcactgagtatgcagccgattgcttgggggagaagtatctgggcaacgacgatgaagaaatagaggaggcagcttaatgttcttgaatccgcatgggattgatatgcagctgctcttgcagatactgcaaacgcaccggcctagctggggcagcactaagtggtttgagccgctgcttatgcaggcgctgggtagtggtatgcactacgtaaaggacaagcacgggaactacttcgtgctggtcggggactccgaacaaagtgacgtagcgtttacgtcgcacctcgacacagtggcgcgcccaaccagcgctgcaccggacgtcggctgcactaacaagggcgtgctgttcgtaaagaatccgcaacaagctgactgcttgggggcggactgcggtgctggtatctacctgatgctggagatgctgcggcggggtgtgcacggacgctactgcttcttcgtggacgaagaggttggctgcgagggtagcgctgcatcggttaaggatgactctggattttggactggggtcaaggctatgatcagcttcgaccgccgcggcgacggtatcattacgcatcaaaggtatatgcgctgctgctctgacacctttgccaagaccctagcagagcgcctgggacgcacggagcagcacttacagaagggggtgtacactgactcagccgagttcgttggcatcatccctgagtgcaccaacgtaggtgtagggtacatgcacgagcacaccccggatgaggtactggacctgaacatcctggggcaagtgcttgagcgtgtactacaagatggcacgttctcgcaccttccgattgagcgggatcctagggtagtagaaccagaccaatggctctctgcaccaacgctcagtttacggcagccgtgggacatgccgcctgctgaggacccgcagttactggcagcgttccgagaggtatcacaactttctaagcagcaactgattagctgggtgcaggagaatccagagaaggcgacggagtacataatggtgttctccgattacggctttaaagaagaactgattgaactaggcacccgagtcgtagaagactggggcggatacgataatattgtggagggttgattatgtctaagtttaaagttggtgataaagttgttcgcaaagcacacaaaaacaattcgtcgctcaagtcgtacctaggggattttgcttactacgtaattacagatatagctacaagcggccactggctgcagttggataactttacagatggaggagccgacccctacccgtggtacgccgataacttcgagctgtatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatggaaatcaaacggaaggagaaagcaaatgcctagtaccataaactatagtaccttgcctgatgccctcagaacggcagttccatttacctggggtgcaaagatttactgggccataaaatctcctggtggggatatgttctacctgcatgacggggcaccggtgctgttgaacgagcaccagattcttaggcaacccgacttgacttacgccactaccctggaaattaagtaatggaccagccctggcttagagcgtgcaagcgcctggccgtagggcagagggctcgctttcggtgctgcggcagggacgccgccggggtgctctacaataacccggatgcctgggaatactattgccaccgctgcaagcaggtgggcaaggagcacaagcagtaccagcgcatacagttacaggaagagccgagggtgcagccctctgcacctgcagatgcaatttgcattagccaagcgcctgcggaaacgcagagttttatttacggattcctaatcacaaagggaatcatgcctgaaatggtgggggatgcagaatggagcaaagagaaacagcggataatcttccgtgtcggaagggctgctctgggtcgtgcagttcatgctcgacagcaaccgaagtgggtaatgtacggccaaccaataccattcgctgccgcggcacctgccgtagcaccggatgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccctggataatgaccaagcgggacactccggcgcggccatgatacggcgcgcgctacgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacccctgcatagaaaggtgtattgctcggcgaacgatatatctccggagagcatagcggggctagttgtgcgccataagtgtgacaacccgagatgtattaatcccgagcatttagaattaggtacggtcaaggataacgtccatgactgtattgcccggggtagggctagacgtggagtttctaaaggggagcagaatgggtactccaagctaacagcgcagcaggtggactatatcaggaagacctacaggcggtacagcagggaacacggcacaccggccatagctgctagccttggtgtaagtgtgtcagcagtgcacgatgtattgaaagctaaaacttggaggctctaattggacctaatagttgttcgtgcaatgtgcacgcagaaggtgtggaaccgactgcgtgaacagatacccaagtccatgctcgcgccggatacgtcgaacctactagactgggtggggttgtactggaacacgtacccggagcaccaggaagtgcagtgggatgcgatgcagagcatgctcaacctccgggccggtcacttatcccgggaagagagggtaatcatggacgagcttatgcggggagtacaggccgtaccgcaggattctgtggtggggattgtccagaccctgaacgagctggcctacagcggggaggtagccgcgctgacgcaacgctatcaggatggggaggaagttgattacctgctggaaatgaagcacctccagcgcaagtacggggacggtgctgctgttcatgattcgctgcttgaatgggagagcggtagtgttgacgaaatacttgccgcgactgacgagagcggcggtcttaaactgggcgtgttcgagcaacttgctagcaacatccgaggtctacgtggcggggactgtatcgcagtggctgctcctgtggactctggtaaaactagtctgcttgctgctattgctgtggattttgctgagcaaatgcagcagcagccggaagtgtacggggaccgccctatcctctggcttgttaacgagggtccggcgacgcgcacagtgccgcgggtatatcaagcggcgctgcattggactctggcggagattaaggaccggcacagtaagcaagagttcgtgccagcctacctcaagaaagtaggcagggctgaccggattcgtgttaaggctgcgcactcattgacgatggcgcagatatccacgctcatggaggagatgcgccccgcggtaatcatcatcgacatggtggcgaatatccgtggcggcactatggagagtgagcaccagaaccttgaggcgaaatggcaggagctgcgtatccttgggtgcgagaacgactgcgctattgtaggcactatgcagctttcactcgaaggttacaacatgctgttcccgccgctcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgcttatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagcggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgaattgggatatttggtttacctacaaagacggcaaactctactggaagcacgaggttagaagtgggcgcggacgcagccacctaaactgcgccgcaggttccgaggcaggaactctgaacaaagtacatggatactggtacgttaagctgcataataagctatacaaaagaagtttgatagtatatgagatgcacaacggtacgctgcgagcaggccaccatatagaccacataaatcataacaggttagaagataccccagataacttgagggcagtgcttcctgagaagaacatgcagaacaagtccctatatagaagcaaccgcagcggctatgtaggggtgcacaggaagagaggtcgttggatagcaaccctaggaaataaacaattaggttcatttagcagtatagagcaagccgtagagtgtcgtagactggcagctgaggcggcggggtatcaccataatcacggggttgcagtatgactagcagtattatgactatagaccttgaggtcgagaataatccttactatggtagcaaggctagcccctactgccctgacaactatgtagtgcattcggcctaccgcatagaccggaccgaggatgacggcacagttaccgtagaaccgacctttgatatcagattcaacagcaagcaggaattccttgacgacgtagccggggagcatctgtggttccgcataccttctgattgctggtgcatcgtggcccacaacgcagccttcgaaattagctggtttttaacatatcagcggcaacactttgaggaattcctaaagcgcggcggccgcgtattcgacacaatgcacggggagtatattgtgtctgactttcagagtatgtacccatccttggatgaaactgcgccaaagtatggtggggagcataagattgatggggtaaaaatattgtgggaacagggtgttctgacctcgcagatagaccccattcttctcagggattacctagtcaatggtgatataaagaacacggccctgtgcttctacggccagtgtgctacgttcacccagcgcaatcagatgcagtacgtgtgggagcgtatggatgccttgctggcttgggcgtactgcgaatggttcggcctgttcgttaatatgccaattgcgcgcaagaaccaggaggagcaggagcagcgcatctgtgagattaagcaggagctgcagcagtatatcccgaaggacctaccggagactctggatttcaacttcggctcggactttcatatgtctgcactggtgtacggcgggcctatcaagtatcgcaagaaggtgccctatgaccctccccagtacgtcaaggccgactactggcaagtcggggacacttgggttgccgtggatgacgtgcccgcaccgccaggtgcaaccacgtacaagtccggtaagaacaaggggctaccaaaagtattccgccttgatacagaggaggagaaacttaagtgggaggatgacctttacttctgcccgggcctagtgaacatccaggagctgccggaagttatccgggagaagtatgcggagcgtggagagttccgacaggcgcgcaccctgcaggacggtacgccagtatacagcaccagcacagacgcaatggaggcgctggcccgccaagggttcgagttctgtaagttggtgaatgagctggcggcgcttgagaaggacaccggtacctactatttacgggaagttctggatgcaaacggagaagtcaaagagcggaagggaatgctgcagtacgtaatacccgaacgcccagatggttccggtatcatacaccaccggctgaatacttgtgccactgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcttgctacaggcaggtacggatatgcactgttaccgcctcgctttccgcgagggactgccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtacacgatgcattgtatctggacagcgccaacccggaggttggacgtgaggcgagcctgctggttaagcagtgcatggaggatgcacctaagcgtatccaccagctctggcctaactacggtatcattggcgaggtgcccttcccggcggaagctgaaatgggtacgagcatgtacagtaaggagaaggtagaatgaatattaaacctggcagtattgtggagatgctggaacttggaccggagcctatcgacccacgacatcgtgcctactttgcaccgggtacgcagcatcgcgtgatatcttacgacgttgaattcggcgaggtggagctactcaatccggacagcaactcagagaagcctggggacggcatcaccttcttcgctggagagtacaagctcatcgcggagtagtgataggtggacccttgggtggtgtagggggttagggtagcatggaaatatgctagggtcaactaaataattaaataaaattatttgttgactctggcttgattctgtgattccccgagaattaatgtgatacgagtaggaacaacacaagagaggcaaccttggctaaagtaagtctaatcaaactgtggaccaaagaagagcaccaacaaattcttggcagtttcctaaataacactgatgcagctattgcgtacaataacaaatttcgcaggggggacgtaatcgtgtctcgccagcttgtacgctactggcgcagcatcttcatggataacaagggcagcaaggccagtgccaaccgcgggctgcaggaggcgcgtaagctaatccaaccaagcccaacggacgatatcgggaatacaaaggtgccggatatgtgccaccgcattctggttgtcggggacctgcacgctccgtatacccacgtagacgcaatgccgttccttgagagcgtacgtgatgcgtactgcccggacatggtagtgcaggtgggtgacgaaaccgacgggcacgctatcagcttccacgactctgaccctaacctggatagcgcaggggtggagctggagaaagccaagctcgtactggaggagctgcatgaactattcccgaacctgctggtttgcgattccaatcacggctcactcgtatatcgccgcgctaaagctcacggtttgccagtgcaatttatcaagaagtaccgggacatcttattccctgagcatggtgctccggcgtggtcgtgggccgacgcttgggtgctcaacacaccgctggggcctgtccgtttccagcatcaagtcagcggtgatttcatgctcaatgcatcccatgagcgcacctctctggtgttggggcatgagcatggacgcttcgaggttcagtatgctgcttcttcaacggcgctgtactttggtgcgtatgcagggtgcttgattgaccgcaagagcatggcctttgcttatggcagactcacccgcaagaaaccaatcctgggtgtgatggtaatcaccgagggttgcccgcagttaattccgatgctgctcgacgacgatggtcgttgggtagggagaagcaaatgaatgtactggattcaactgtcacccgagtagatgctcctgtatgggatgagcaataccaggtgtatcgtgtaaccctggagtatgactgctgggggcacaaatctgagacagagcggtggtataaagatgaagcctcagctcttagtttaaaagttggtgacataatcaaaacctaattaggagtgtcgatgaaaatgggaatctgttctgtactgggccttatctttgtaaccctgaaactgactggcgttatcgcctggtcctggtggtgggtactgcttccgttctacggcggtgtagctttgctgttggcaatcctggcggcaggcggtgtggcagcagccgcggctgcaggcattaaatccgcacttaagaatcgctaggccggacctgcatctgcacgtaaatatcatttaaactaaacgaggacgtaattatatgactacgaatgtactggcatccctgaacgctctggtagacgcagcaatcgaaacccaagatgtggatatgcgggaaaccgcacagggtggtgcgtacgaggacgtgctgctgccgaagggtgaatattacggttacttcaccgagtatgtggaaatcggtaagcgcctgccgaccaagggtggtaagcctaccggtaagcctgcagtggctaacgtacgtatcggcattgtagtgttcggccccaacggcgaagtgaagcgtatccgcccgtacccgatggctatcagtaactttgagcgagcaggcttcaagaagttcttcgacaagctcaactacgacaatagcattaagcatgcagcgcagcgtctgggccaggccttcaccttcccgattgatgagcacaccagcgccgcgggcaagaagtctaacatcgtggacctgtccggtatccgcccgattccgaagttcgacccgaacaccggcgagcctatcaagatgccagccctggatgcctctgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcaccgcaagcacctgcagccccagctgctccagtggctcctgcggctcctgtagcgcccgctgcgcctgctgcacctcaagcctaatctaccctaacctaaactaatatggccccgcatggggccttagaggaagactatgaacatcatcaacattctcatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgctaacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctagctctcacgcatacagggcaagccttctgggtcccgagattagtgcgcagcgttatcacttgaatcgccagtgcgccaagtcccggcgccgtgcatacgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggacatgttcctggtcggctgctcagaggcagtggcgtacctgacgcctgcaggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatataccgacaggtacagtgtggcctgcactggaggacccattcggatggattaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcatatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggcccgggcacgacgcaaagcacgggagactattaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggagttcttccagctcttccattcgaagagcgaggctgtttctgactcagtgaactctcctcggcactaccagttcttcccggacctggaggcaattgaggtgattgcacgcagtatgacgaaagagcagttctacggatactgcctggggaaccggctcaagtacagactgcgcgccgggaacaaggataagctggagcaggacattgccaagtccgacaagtactcagaactgtacgagcaacaccgaggtaagtgcattgacgcctagcgcatggtgccacgggatgtggcagaaagcagtagaacggggcgacgaaagctccgctaaagactatctggagatgtacaatctctgggtgagtcgcaatcagtagttagaagtaccggacataaccaaggagactaagcgcctatgattagcgccctgaatacggttgtagtacccgaggaagcactggtgaagcgccagctggagcttgaagagacctataagattcgcggaatcgagcgggcacgtaagctgattacggacgcactgcagaatggcgggattatgaacctgccgatgacgcagcgtatgctcacctcggcatatgaggtggctgctgccgctatcgatgagatgcgaaatgtcaaagccccgggcattggtggtaagtaccgacggttcctgcgcttagtccccttggacgtcctgaccactctgagcctgtgcacaatgtttgaggcgttcagcgtcgcccctggcgagtccgccagtcgccgtcagactgcacaggcggtaatgtccgcactgggcagaaacgtacagtcagagctactggctctgcagttacgcaacgtagcccctgcgtacatggaccgtgtgtatgagtacctcacagagcgccgtacgaagtcccctacgcacatcctgcgtacgctccgcgccagtgccgagaacgtgcactatgggcacgagccttggaccaatgcccagaacatctccgtagggcgtctgctgtgtgccgcggtgtttgagacgggcctgttccagtggaagaactgtagcgggaatctgagcatgctctatccggctgacgacgttatggaggccttccagaaactggtagagtccgctgacactgtaaccatgaagccgcctatgctggtaccgccggtgcagcacactactctgtgggatggtggatacctcacccctatcgacaatcgcgggacctatcataactcgcacattgacagagctcgtctccgtgaagtagcggaagcatttaagtccgcggatggcattaaaaaagcgcttaataaggcacaggaaaccccgtaccgtattaataagcgcatactggaactggtgcaagaagcacgggccatgggtgttgggataggcatgccgcgctcagtaccggagccgaaaccggagtggtacttggatggtgttccaaaagagaactacacagaggaagagcttgaccgttttggtgagtggaagacgcgcatgtccctgtggtacagcgcagaccgtaagcgtgtgtcgcaactgcgcagccttttgactacgttagaaatggcagaggaattcaaagatgagaaagctctgtacttcccaacctgcgtggattggcggtaccggttgtacttcaagtcctcgctgcaccctcaaggttctgatttgcagaaagcccttcttgagtttggcagaggaaaacctctgggtgatcgcggcttattctggctcaaggtgcatgtcgccacatgctttggttatgacaagaccttattcgaagaccgcgcagcttgggttgatgcgaactttgcagagattgagcagcttacagtttcaccgtttgattgccctgctttcacctccgcggacagcccttggtgcctattggccgccgctatcgacctggttaatgctgtgcgttctggatgcccagaagagcatattagccgaatcccagttgctatggacgctacaaactcaggtgggcagcatctctcagcgctcctgagagaccctgtgggcgggcgtctgacgaacctgtactgggagggtaactataagaaagctgacctgtacatggacgtgaagcgccgtacggacgagaaggtgatactggacctggacaaggaggatttcgttatccagagcacgtactggagagagaacgaaatcacccgcagtatgaccaagcgccccagtatgacctatttctacagcgctacggtgcgcagctgcagcgactacatcttcgaaggtgcttgcgccgagggatacgagggtgccgagactaacagcctgtggaacctgtcgtgctacctggcgccgcgtatgcgtaccgctatcgcagaggcgaacccagctgctgcggcagttatggggtacttgcagaacctcgctagacgcgtaccggcaagccagcatctgcagtggtatacgccgctgggtgggcttgtaatgaaccgttacacgcagcgtgaagaagtgcgggtacgcattgactgcatgaacctcaccgtcatgcgggtgcataaccgggatttcaagacctgtaacaagcgcaaggcagcctctgggattgccccgaactttgtgcatagcctggacagtacgcacttgatgatggttctgtgtgccgcggaagggttggacatcgtgcctattcacgactcgctggctacacatgcagctgacgttgacgctatgcaccgacacatccgcgaacagtttgtgagcctatacgaagagcatgacctgcttggggatattactcgcgcggcagcagcagctggggcggacttgacggatttggatatgccagaagtaggttccctggacatccggcaagtgctggaatcgcctttcttcttctgctgataaatgaagttaccggagtaggaatgaagttaaaacacactagtaaaacttccgattacactctcaaggttctgtataagtctgacgacattacagacgcagtgaagcaactgcacgaactgggccacggcattagtcggggcctggctccagagcagcactactggagagtgctgggaagtatattgggtaaacagtatatactaggagtctatgactcccaaggcggattagtcggtgctgtcagctactatccagaagctgtggaggactgtcattacgtagagcctgtgctgtatacagacttcttcgtactaaaaccggacaatggtgcggcagtgactgtgattatgcaggggatgcacgcgatagccaagtgcatgcgcgccgggcgtattgccattagccggagcacatcggataacacgtacaagacaacttatcatttagtgaggtcagaatgagtggtggtttaggtaaactgttaggtaaggccacggatatgctcggccttactgacaacgcaggattagaggcacagcagcgcttggcagagcagcaggccagcgcagctaaacaacaggctgccttagaggctaatagcgccgcagataacattgctgagattgacccagcaggggctgcctctgcatctgcagatgcaattacgtctgagcagaagaaacggcgacaagcagggcagagcaatcctctgggcctgtaagggggtagcttggaacaaaaagcaacattagcagagctctttaagaaggaccaggacgcgggtgtcttggatgcctctgagaagtttgcgcagtggacgctcggcactatctttacccgggacgattccctggacggtagacgcaggcccctggagcgtgattaccagagcacaggggcgcagctggtcaacactgcagccactaagattgtaggcgcgctgttcccgcaaggcactagcttcttccggttctccaagagttcggacctggacgagttcattagttcgctgggcagtgctgctacggcagaatctaagttggccgaggtcgagaacacggcgtcacagaaagtatttgagaaagacggttatgctgcgaagttgcaggctgtgaagctgctgctggttacaggtaacgcgttggagtatattgatgagcggacaggtaaatccatcgtctattcagtccgtaactttaccgttcgaagggatggaagcggtaacgtcctgcgactcattatcagagagcgcgcaagcgtccaggacctgccagagagtttccggaacaccttctaccgtgacaaagacccatacggcgacgttgatatctacactgccgcttgtcgcaaagttaagcggacagaggacggtgcagaggtagtaagctacgaggtgtaccaagaagcagacgggcaccgcattggagacagcagcacctatccggagctggagcttccctacaacgtgctggtgtggaaccttgttagcggcgaacactacgggcgcggcttggtagaggactacgccggggacttcgccagattatcggtactgtcggaagcgttgactaactacgaggttgagtctgcgaggttaatcccgctgattgacgcaagctctgggttagacgtggacgagttcgcaacgtcggagactggcgaggctgtgcaggtgggcggcggcggttccaacgggaacagcaaatcccccgtcactgcttacgagggtggctctgcccagaagattcagtggattgccagcaacattcagatgctcgaacagaaactgtcgcgtgcgtttatgtacaccggtaactcccggcaaggtgagcgcgtcacggcttacgagattcgccagaatgccaaagaggcggaagccgctatgggtggcgggttcagtattctgagcgacacatggctgcgtaagctggcgtacctgtacactgcactggtatatcctcgctttaagctgtacctcagcgaaggtgtagtgagcatcaacgttacggtgggtacctctgcactggctaaagccgcagcagcggataagctgctagaggcagcgcagtccatgcaactggctatcccggtgctggagcagattactccacgcttcaacaaggatgcgtgcgtagactggtacttcgacgcctacggtatcgtcagcgagccgttcatgtacacagaagagcagctgcaacagaagcaagaagttcaagatgcgtctgccgatgtatccgcaggtgcagcacaggaccaactccagggcttgacagcagcagacccaacagtagcaggtaagcagctgggcttattaccaagttaacaacaggggcatagatggataacgtagaaaacggtcagaacgtagaaactacacaggtagagaaccaaggcggccctaagattccgggcctaggtgctccccttaacgccccgaacaatcaaggcgtgcaggatgcgcccgcacctacccagcagcaacagggcaaagattcccctgaacctgctaagattcctctggatatcgaagccctaaaagcagccctggataagggtggcgatagcgctaaggagcagccccaggagctggctcagacaggcaatccgacgattgacgccggggtagctatgttgaagcaagtatctgggttaactgactctgatatggtgcgggcacttggtaaggccctggagtatcaggaccctaacctaatcgatacggccttcattaaggaacgtttcggcgagcacgctgcttacgcagagctgttggctaaggcgtacctggaagaccaggttggacaagccaccaaggcagtgcaggaagcttacgatattgtgggcgggaaggagaactgggaggtagcagcacagctgtttaattccaaggctcctgaacctctgcgtaacgcagctcgtgtactcgctaacgctggtgagcttaagcaggccgctgagttggtagcgggcttctgccgggatatgggtcttatcaagacacagaacccaatggtacggggcgtagccagcaacaacgcattatctgctgcggacttccgtgcagaatataccaaactccgtcaggaagcgggcaaccgtagcttggcatctccgcagttcagtcaacgttataatgatttgctcgcacgccgtgaggctggtaagcgcgtaggtctttaattttatttataaaggaaactaaggcatggctaacactatttataatggcaacctgactcgtccgcactggggcggcgcggcgtctgacgtagacattcacctggaagtgtatcagaacgaagtggatacccgcttccagtaccaggctctattcctgggactctccagccagcgctctatcagcggttctaacacctaccgtattgaccgcttgaacacctcctcggtgaagggtcgtcgctccggcgaggcgctggatagcacaccggttcgtaacgataagatgattatcgtggtggatacggtgctgtatatccgtaacccgattgactaccaggatgactggaccggtccggacttcctaaccgagatgggccagaacaacggctctgagttcgcagagaccttcgaccaggcgcacctgattcagctcatcaagggccgttcctgggttgctccggcgcacctgaaaccggcgttcaacgacggtatagaggtaggcgcagctatcctggttccgggtaccactaccgccacgcagctgacccaggctgagatggaggctaacgccatgaacatcaacctggcgcacaaggctggtattgatgagctcatcaagcgcaagaccccgctggcggatatggtcactctggtggatgtcgatacctattcgcgtctgctggagcatccgaagctcctgaacatcgaattcggtccgtccaacaacgacggttacaaagaccgtcgtgtagtgaagatgaacggcgtacctgtagtagagtgcaccgagttcccgaccgaggctggtacgcatccgctgggctctgcttacactgtcaccgcagacgacgcgctgtgccgtatggtgactttcagcaagtccaagaccctggtgactgttgaagctaagccgttcacctcccgtatctgggacgatacgcgcgagttcagcaacgtactggactgctacgcgatgtacaacataggcctgcgtcgtccggacaccgctgcagtgactaagttcaccttcaccaccaagtcctaattggaggttcaatggcagtaatcgctacgttcggtctggagactctccaggccaatgcagctcagcgggaggcggttaaggccgccaccgatgtagcgaagaacatccaggtggcctcggtcgagtctggccgcaaggctaccaagaaaacccgtaaggcggctgatgcagccgctgatactgcggaagagtaatacgcgcccctggtgccttcgggtgccaggggctttttttttgtccctgtcttaaaggtccaaggggtctttaatagaggaacaaatatgagagaattagacgctgtgaacctgacgctggaagccctgggggagtcccgcgttatggacatcaacactagtaaccctagcgctggattagctcgctctgcacttgcacgtaaccgtcgtgggttgctcagcacaggattctggtttaacgtggtcgagcgtgaagttacgcccaccaccgacggcctgattaaggtgccgtggaaccagctggctgtatatgacgcctgctcagaatccaagtacggggtacgtgacgggaacctatacgacctggtagagcagaaccaatacttcgatgcgcctgtgcgtattcgtgtggtactggatttggcctttgaggacctgccggagcacgccgctatgtgggtggctaactacaccactgcgcaggtatacttaaatgacctgggcggtgacagcaactacgctaattacgcacaggaagctgagcggtacaagagcatggtgctgcgcgagcatctgcgcaatcagaagttcagcaccagcaagacccgttttgcacgcagaatccgccgcgctcgttttatggtctaaggagaggttatggcgcaatcattagaaggtactattcagagcttgctgcagggcgtttcccagcaggttccgagagagcgccaaccaggacaactgggggcgcagctgaatatgctcagcgacccggtttccggtatccgccgtagaccgccgggtgagattgtatgggaaagcacaatcgataaccctgggcttgactccctgttcactgaatacgtcgagcgtggcactgacggtaggcacctgctgattaacaccagcaacggtaactggtggttgctggctaagaatggaaagaccatccttaattccggcaacgacccgtacttcgttaccaccgtaggccagacctctttgcagaccgcaagcattgccggactgacttatatcctgaatacggagatggctcctagcacaaccgtggacaatactgggcgtatcgaccccagcaccacggggttcttctacgttaagtctgcagcattccagaaacgctggaacgtcacagttacctccgcaggggtagactactcaggggactacaccgccccagctgctggcagcaccagcggtaacgctgaggaggtatcaggtgcctacgttgctcagcagctgcgggactctcttgtagctaatggcatgcccgccgggaacgtgagcgtacgcggtgcgtacctgttcttctatggactgagcaactgcgcggtgtcctctgacgccggtgatacttacgctggggtatccaaccagtcccgtgtagatcaggagcaggacctgcctgcacagctcccagcgcaagctgacggagcaatgtgccgtgtaggtacagcctcgtctgagacagcgtggtatcagttcagctacagcacccgcacctggtctgaggtgggggcgtacggcagcatcaccaagattacgaacatgcccagagaacttgccgcggatgacaatattattgcgcgggattgggaagggcgcttagcaggcaacgacgataacaacggtaatccggggttcgtcgagaatggctacattactggcattgcagctttccagggtcgcctggttctgcttagcggcagctctgtggatatgtccgcctcgggcctgtatcagcgcttctaccgctctactgtgacgtcactgctggatacggaccgtatcagtattagctctgcgtctgcgcaggattctgtgtaccgtaccgctgtacagtttaacagggacctggtcctgtttgctaacagcatgcaggccgttgtgccgggttcagcagtgctcacccccactaacgcaagtattagcattaccagcacctatgagtgcgatagtcgcgttactccggtcatggcagggcagacagtaatttacccgaacaagcgcaacgacagctacgcgggtattcttgagttgatcccatcgccgtatacttcatcgcagtatactacacaggattctacggtgcacttaccgcggtatatcccaggcagggtattgcagatgcaaaactccagtgtcaccaatatggccttctcgcgcatgtctggggagcgtagtagcttgctggtctacgagttcatgtggggcggaagtgacggcgccaagatgcaggcggcgtggcataagtggtcgttcccgtatccaatcctgagcgtacaagcgctggaggatgaagtgttcttgtacatgcaagggcccagtcccagcaacaagcttttgattgtgtctatggacccgcgtgaaggttaccagctgggttcggagtatcgcgaagcgtactcggatttgcagaagcaagttcaagtacaggacgggatattcaccgttccggcagtactgcgtccagttgggtgggctgaccgctatgaggaagagcttatcctaacttacttgcccagtaaccctatgggacctactgaggttggcataaaggagattgccggggagaacaccctgcgggttgtacgcggtgtacctgatggcacctacgtaatcgggaggcgttaccgcagtacgttcacgctaactacacctattctgcgggaccagaatgacaagctcgtggggagtgggcacgtgcgcctgctgcgcctggatgtggcggtacgtaactctgggcacttctatgtgcaggtactagacaccccacgggatgtcaactggggcggggaactgacaggtatcctgatgaactcaaaagagctgacgctcgggcaggtcctgcgtatggacctggctacgattaccgtgccatgccgtactaacgcagacacaaccgaggtgtcattatttactgagggttctatggaactgaatgtgctggatatctcgtacatcctgcgctacaaccaacgcagacggagaatttaatatgtggtggatggttgcggccatggccgctaagaccgttctggggcatggtgctcagattgaagtgtccaaggccaggaacaaggctgtgattcaacagacagccaaacagctaaacgacatcgcgctacagcgagcccagtccagggaccggactgaggtatctctgtttaacatccagcagcagaagctgcaggcacagagccaagtagggctgcaggcagcagcttccggtactatgggggcctctgttaaagacgccgtagccacagtgaacactgtagccggacgacaagaggccagcgtgcgtgaccagcaggcaactcaggaagagggtttccgtctaatgacggacaaggccgtggacagcggcctggctaacatggacatggaggacccctacgataacatgtttaactcgttgttgagtgtcggggcatctgccgttgggcagtacgctggtaacgctgcgtcgtctactgactctggtagctcaacacccggaagtggtgcagcagctactcagaacatggcgtcctcctatgatttatgggggagcaaaggtaacagctcagttcatacctggtaacttaagaggaatgtcaaatgcctgtgattcaacccagtagacaggggttaagtatcggaggagtgcaactgcagtccaacgatgttagcttaccgtcaacggtaagtgaggtgtctgttgatacctccaaagcaaaacgcctagctgccctgtcagggttcgtgcaggacttcggcgtagggtttgacgaagcagtaaaagaaaacgctgcagccgcaacggtgcgcggcgcaatggatgcccagggcgcagtagatgcaatggcttccaaagatgaggctgtacagaagcagaacatcttcgtacgtgaggcctatcaggatggctacgtatccgccgccgcgtacgactctctagccaagtggcgcacagatagcatcgcacgagctaagaaagctgctgagtctggtctgactgacgaggaattccagcagcaggagcaagagcacgtacagtcaatggcagacaagctcgggatgtatctcccggacatgtccaaacagtctgccacgaatatactgcagcagctccgtgctaccagcatggcgaactacacagccttccagaaaggtagagctgcgtttgccctggcgcaggctgaccgtgcactcgaccgcggccttagctcgtccagtgatgagttctatcagcgcctgcaggcgggacagggtgccgctgcgcagatgtctatcaagaccggtttagatagcatactggctgctgagcacttggataagagcaagaagctggaccgggccaagcagtatctggtcagcgtggcgcagcagacgcaggacc

SEQ ID NO: 48 - DNA, 44842 bp, Unknown
  source: /note="Description of Unknown: M16-9-1c Bacteriophage Sequence"
cgcgccgctagttcgtcatcgaactcgtcgcgaaggtcctgcatctcctcggaatctgcgtccgcggtgatgtcgttgtccttcaagaacttagcgataaccgatttatctgcggcggggagcggcacctcgtcttccttggactgcttgatttcttcaatcaaggcctcagtgaacatgcggtgcagctccgagaggcgactgcgtttagccgcccctgccattatcttaccctcatagctctaatataaccctgggcagtgcaggtcctggtaaaggtggcctgcgctaccaggtatacagtggttgttgcactcaacagtagacggcgcgacataccctgtctggaagaattcccagctgctaacgtggtggttatagaatataagtcgtaccagtttccaggtaacactgcactggtgctactaactccaaaactgagagcagtaacgttgccgctattagtgactaacagggcactctcaagctcgtactcccccgccggcaggctcaaggacagaacgttcaatggggtgccgctggtaacacttacggctgcagaggttgcggcactcagtacttcccccactacaccggcggctgcagctgcaccgtcagtgcggccggatatacccccactcaatcctgttaatgcggtgatgtctccgttgctgccggacgccgctgctcccaggttagtcctagcagtggcggcatcgccagctccggtgcccccctttgtaattggaaggctgccagttgcccctaaggtggcattgccagaaccatcaaaactggccggtgtagtggatgtcaaatctaccaccaaagtccttgctgtggctagcttcgcagctgaatcagcggcaccagtagtgttgccagtaccgccttgagctttactcagcggtgtagttaatccacttaagctcgtgatatcagagttagcaccctttgctgccttggtcgctactgctgcttggtaatccagaattatctgtgcatcggcattagccctggctgacgcctcttcccctaatgccgtagctgtagcgtaagtttccgaaagctctgcatcataccccaatctggcagacactagagtaccagctggaagtacctctgcaaacagtagagtgttatccaccacctcaaaactgtagcccggaatctgatttacgccttgtacgtacactatagcctttgtgaaagacaatccaggcgtaacttcgtcagtagcctcggccagtatagtataccagggatagcttaccgtaggctcccccgagataaaggtctgctctaggttggtagtacgaacatcgagcgcatcgtctgcggctttgcgcgcggcggcttcggcatcaatacggacacctagtgccgcatcaccagtatctacatagttcttggttgccacatcctgcaggtcttctgggtccgctacgttagtgatgcggtacccgttcatgcttatattcccgtagaatccggggatagctcggccttccacaagctcttgggctaggtgtaagaattgcgtgttttgagaatctacgttcacctcaatgaacggagagccgctggcgaactcaatatacaagtactcccgctcagtcttgcgaatgagcagcaccgtagtgtccgccgttaaggctgtgttcagcctgatattagtagagctggtccaggtgtacccagtggtttcctctccgtctaggtatacatgaatataggacttgtccaaatactcaatatcgcactggatatcctgggtaccagctggcttgatttgttcttgccagctgaacgccatattaatcgtctccgaagttattgatgatagctcgcgtaggtgcgaattcctggattaacggtacctgcttagtgaaggtcttgatgtccatattaccagtagccaggtcctgtacggccccgagcagccctgtgacataacccatagacgccaacgagtggcggggagaatcccccaggaagatatcctgcagtaaggataccccgccgatggcactcatacccgttacggactcactgatgagtttctgggtgtctacgtccttcccatccatgccatgcttagccatagtagccagcagcatcaacgggaactggtatgccataatgtgggctacaccaatccacccagcatcgttcagctctctacgcagaatcttgttagtggcagccagtgcgaagctctggtaccctacgatgactttgccgatagggttgaactgtgcaaagtgtgaggtctctccagtacgaatctgctgtaccaggtagtccatcatacgcgcccctacaacctcaacttgcatctgcaggtccggctggaacatggcgcccgggttagccttattggcagcgatagcgcggtccgcaacatctcgggtaagcccgaaacgctccagacgcttaaacgcctcagcatcacccttgaacatctgcgtaagctcgtccgccacaataccggagttcaggttaacctgcagccgatgcaccatgctcataccgttgacgtggcgtgcagcctgcccaacgttctgagtgacgttgaaccaggaggcctgacgggtcaggtccaggttatcgtcagcgtacgtattcagccagcggaagcgcatctccttctggatatttcccctcagcacagtgtctaggcgggcagccatatccggagtcttgatagctacggcaccttccttgaaccaaggttggtctcgcatactgcgcagcacacgggccataccaaactccttcatagccaacgcagtgtcggtcagctgatacaggccggagttcttgagcatagtggcgttagccatgttcccggctgcgcgcagcaagtccggaagctgcccagcgtcagcaggtgccccacccaggataaagtcgatggtgtcattgacggtcttctcccacttagcagaatctgccagtacgtgcttggactcgtcaatcatcttagcgagctgccccaggtcctgtacgcctgcataggccataccgacacgcccagacatacggttagtgtacccgtgcataaccttggctacgtcagtatccatcaggtcctgcatacgcatgctctttccgttaatcaggtactctttgtccatgttgaaccgagtacgctgacgcaggttccgcgcaggggatgtgctgcctgattctcgtacgttaccagccaggaagctctggattgcagactcttctacaccagcgctgcgcatagccatgacgacctcatcgttacccatgccgttaatcagctgcttccacatagggccagactgtcccgcacggccgttgtagataccgtcaaccatctccttggcaacacgctgcactacctctgactccatgctagggtacacgtcccgcagggcggcccggaacagggctcggtagtcgtccagagtgttaccctgcgcgataccttggcgcatcttgtcgtagctgtactggcgcgggaagtagtagtcggatttaaccaacgcaccatcatccactagaccggcattgagcatatgctcgtgccacttgctagcccagccagagcggcggtaagcatcaaccagcggagcaatctctgcatccggcaccggcacagcgcggccgtttacgtcagcactgtaggcagcatccaggtacttgctcaggcggtcctccagcgcagcccgctcagcgcggaaattactccgatggaagaagcgtgagagcacccctacacccttatccttcaacgcgcctaggatagcatcttcaactacgctggcgcgggcatccatctccaaagtgaggttacgcttgtagtctaccactgacgggcgacggccgcctactgcagacgcatccgacactagcagtttagccaagtcttcgttgccttgggcgatattatcgtacagtgcaaacatagtggagagcttcttcttagcgccgtccagcatagcttgtgcacgcttagcctcgttgagggtagtgctgcccgccaggtcctggaaagcctcactacggaagctctgggcttggtctgcataatccttagctgtccacttaactgcatcctcatacgcatccagtacatcctccaaggcagagcctttggccttgatgcccagagcgttcatgatgtactcacccagttggcggagcatgctattgccggtgggagactgcgtacgtgccaggtgctcaacccactcagggctgtcgcctaagcctgccagcatctcgtgcacattacttgcgtaatatcgcatacgcggtgtcagggtggaatcagccgcaataacagcgcgcacttcctccaggcgtttagcaatctcgggattactgtcaatagcgcgcgcagtagcggcatgaatcagttcgtgcacggccaccttgcttgtatctgcatccatagcgcgcagcgcatcaccgactgtagtccaggtgctgccgttagcttgcttaggcgcgcgcagggatatctctccccgcttagctaaatcttgttgtgcataagtgtagcggctgcggtttgcggagcctgctactagtttaaaatcaatgtcatttacagcatcgcccagcgtgtccagaatagccttctgtcctgctgtcaagtgctcagacttcctcaagaactgaactacgtgctgtgctttcatgttcacggaggcggtattgtttctcgatacttggatgctttcatccagtgtcttagtgagaatttcctctccctctcctactccggtaacattagcatccctagctgtacgagttgtaggcgcttctgggtcgaacataggctcacgcccagtacgagccttggcggcagctttagcagccctagacatatcccagagctggtctaacccagctacgcccgctatcagtgcagttaccgcagcagactgccccagttggtcctgtgcatagaatgcagtacctacatcagcagcgcgtatagcggtacgtgcagctaagcccgcacggccagcaataccagcagcagacatcggggccaggatgaacggggaatcccctaccaacatacccgcgaacccagctactgtgttgtcagccattaagcggtcacggtcacgctgctcaagcatctgctgcatgcggtagttgtaatcttctactgacacggagtcatgcaggtactcaatctcttcctgatttggggcgtacagcttagcccgagtatcgctactcagggtctgcttggcattaaagttcgggtctcggtcaaatgccggggcagaggccttgcgtatagctgcggcgatgatgctgttgcccatacccgaggcaaagctctctgcggctgtagtagctggggtcttggcctgtgccagtaatgaggcacgccccagtgcgttcagaccgttgtccccggcatcgttccaatctacgcgctcaggcgcagatttaagtgttgcgcccttagcagaatccttttcctgtggattcggttcttggttcagaaactgagccataatatctcctaaaagaattttgataaggggaggccccgaagggcctctggttagtgcgttgcttcgaagagccaatcacgtaggttttgttccaggtacttcttacgcccaggttgggcctgcttgtacgccggggtattccgcagcgcttgccaagccctaccctgggcctcagatacagggtactgatacgcccccaccggggacttagcagccttgcgtacctgtgccatcgcctctgctacggggccggagctaccgttaccaccgtgatagttcaggtccaccataacctttaacgcctcgtcggaggcagtcaaaccctgtcccttgagttgcttctgcacgttcggtatgtactgctcctccagtgaggatttgaggatactgataccgtcgtcaatggtaactttctgggggacgggcatgccagagttaacgtgcaggccgaagcctacgctacccttacccttgccttctcggaacccttcgaacttcatagtagtggctaggatgtcactaaacagtgatggttccagccctaccgagttacggccatttacttgtacgctgacggcacgcccgttgtcgtggtcgtagaaggtggcaggacgtacacctacttgctcgcttccaatcttcatctctccagccagtgctgagtcatacgcagcctgcgcagtcgtctgaacgtctcgaaggttcacagacatcgtctggaaggtgcccttcttgtcgaacacggttacggtcatgttctgacctgcgttgccagcggtggcggcctgcactactacacgctctatgttgctggggtctgacatatactgaacctggttctgtatatgctgctgcagggaggccttgaactgctcttggtcgcccttataatcacccatgatagattgcatagaggtgccagcgggcagatacacatgcctaggtgccccggcaatgtccagctccagcttacgggattggatattgccttttagcatcgtattgatgtcgtcagcgtccttccctacaagggattccggattgtggttatacacataacggtactcatcttccatagcagctcgcgcttcctggcgctgtgcgtctgcatccccgaagaagctgaaccagttagccgtgccgcttgggtctaccatcttgtccgtggggttactttggatattgctgtagcgcccactcgccttattacgagcctggcggcgaagatcgtccaagatagtgttactggcattatttgggttttgcgtaacagctttctgcaccactccacgccactcagatgggacctcagacagcagcgccatcttccctaagtccgtactggtgctataagcctgtgcccacaagttgatgctattgacgttctcgcgggaaacctcgccatcttcaccgagctggtccagcgtagtcagcgtacgtgccatatccgaagacatacgcttgtgcgcctcgtttacggcccacgcatccttgctgttgcttccgtatgccagcagctgcaggttcccttcgggggtatccggaaagctcttgagcagctgagtacgtgccttatctaagtcccctttgaacatgcccgccagagtagagcttggcatattcccagtaattgctgtgcgcaatgcttgggcgtctgctgccttctctcgaatggtctgggctttgttccagaactccatgctggtcccggcgctaagtacatcagatgccgacagctcaatgacacgactacgaatacgctgcatagtctgttcttgctgctcaggtgtctgcccctcaagagactgtattgcatcagagatttcgaaacgggcctgtgtctcaatctgagcacctgcgcgcttgaactcctgatacagtgccgcgttgacatccacggagttgacgccgagttccttggtggccatttcctgcagctggttaattaccagtgggtcctgcgtctgctgcgctacgctaaccagatactgcttggctctgtccagcttcttgttcttgtccaagtgctcggcagccaggatactgtctaatccggtcttgatagacatctgcgcggcggcaccctgtcctgcctgcagacgctgatagaactcatcgctggacgcactcagtccacggtctagggcacggtcagcctgggccagggcgaacgcagcacgtcctttctggaaggctgtatagttagccatgctggtagcgcggagctgctgcagtatactcgtagcagactgcttggacatatccgggagatacaccccgagcttgtctgccattgactgtacgtgctcttgctcctgctgctggaattcctcgtcagtcagccctgcctcggcagctttcttagcccgggctatgctgtctgtgcgccacttagctagagtgtcgtacgctgcggcggatacgtagccgtcctgataggcttcgcgcacgaagatgttttgcttctgtacagcctcgtccttggaggccattgcatctactgcgccctgagcatccatagcgccgcgcacggtggcggctgcggcgttttcttttactgccgcgtcgaaacctacgccgaagtcctgcacgaatccagacagggcggctaggcgttttgctttggaggtatcaacagatacttcacttaccgttgacggcaagctaacatcgttggattgcagttgcacgccaccgatatttaacccctgtctactgggttgaatcacaggcatttagtattcctcctaatttaccaggtgtgaactgggctattgcccttactcccccataagtcataggaggatgccatgctctgcgtagctgacgctccgctaccaggcgaagagctaccagagtcagtagacgacgcagcgttaccagcgtactgcccaacggcagatgccccgacactcaacaacgagttaaacatgttatcgtaggggtcctccatgtccatgttagccaggccgctatccacggccttatctgtcattagacggaagccctcttcctgagttgcctgctggtcacgcacgctggcctcttgccgcccggctacagtgttcaccgtggctactgcgtctttaacagaggctcccatagtgccggaagctgctgcctgcagtcctacttggctctgtgcctgcagcttctgctgctgaatgttaaacagagacacctcagtccggtccctggactgggcgcgctgtagcgcgatgtcgtttagctgtttggctgtctgttgaatcacagccttgttcctggccttggacacttcaatctgagcaccctgccccagaacggtcttagcggccatggccgcaaccatccaccacatattaaatcctccgtctgcgttggttgtagcgcaggatgtacgatatatccaacacgttcagttccatagaaccgtcagtaaatagtgacacctcggttgtgtctgcgttagtgcggcatggtacggtaatcgtagccaggtccatacgcagggcctgcccaagcgtcagctcctttgagttcatcaagataccagtcagttccccaccccaattgacgtcccgcggggtgtctagtacctgtacgtcgaagtgcccggagttacgtactgccacgtccaggcgcagcaggcgcacatgcccacttccctcgagcttgtcattctggtcccgtagaataggcgtagttagcgtgaacgtactacggtaacgtctcccgattacataagtgccatcaggtacaccgcgcacaacccgtagggtgttctccccagcaatctccttgatgccaacctcagtaggccccatagggttgctgggtaggtacgttaggataagctcttccttgtagttgtccgcccacccaaccgggcgcaataccgacgggacagtgaacaccccgtcctgcacttgaacttgcttctgcaaatccgagtaggcttcgcggtactctgagcccagctgataaccttcgcgcgggtccatagacacaatcaaaagcttgttgctgggactgggcccttgcatgtacaagaacacctcatcctccagcgcctgtacgctcaggattgggtacgggaacgaccacttatgccacgccgcctgcatcttagcgccgtcacttccgccccacatgaactcgtagaccagcaggctgttacgctctccagacatgcgcgagaaggccatattggtgacgctggagttttgcatctgcaacaccctaccggggatataccgaggtaggtgcaccgtggcatcctgcgtagtgtactgtgccgcggtgtaaggtgatgggattagctccaatatacccgcgtagctgtcgttgcgcttgttcgggtagattactgtctgccccgccattaccggagtcacacggctgtcacaatcgtaggtgctggtaatactaatgcttgcgttagttggcgtaagtactgccgaacccggcacaaccgcctgcatgctgttagcaaataggaccaagtcccggttgaactgcacagcggtgcggtacacagaatcctgggcagacgcagagctaatgctgatacggtccgtatccagcagtgacgtcacagtagagcggtagaatcgctgatacaggcccgaggcggacatatccacagagctaccactaagcaggaccaggcggccctggaaagctgcaataccagtgatgtagccattctcgacgaatcctggattactgttgttatcgtcgttaccagctaagcgcccctcccaatcccgcgcaatgatgttgtcatccgcggcgagctctctgggcatgttcgtaatcttggtgatgctatcgtacgcccccacctcggaccaggtgcgggtgctgtagctgaactgataccacgccgtctcagacgaggctgtacctacacggcacattgccccgtcagcttgcgccgggagctgtgcaggaaggtcctgctcctggtctacacgtgactggttggataccacggcataagtatcacccgcgtcagaggataccacgcagttgctcaacccgtagaagaacaggtacgcaccacgtacgctcacgttcccggagggcagcccgttcgctacaagagagtcccgcagctgctgggcaacgtaggcacctgatacctcctcagcgttaccgctcgtgctgccagcagccggtgcggtgtagtccccagtgtagtccacccccgcagaggtaacggtgacgttccagcgtttctggaatgctgcggatttaacgtagaagaacccggtggtgctggggtcgatgcgcccagtattgtccacggttgtgttcggggccatctccgtattcaggatataagtcagcccggcaatgcttgcggtctgcaaagaggtctggcctacggtggtaacaaagtacgggtcattgccggaattaaggatggtctttccattcttagccagcaaccaccagttaccgttgctggtgttaatcagcaggtgcctaccgtcagtcccacgctctacgtattcagtgaacagggaatcaagcccagggctatcgattgtgctttcccagacaatctcacccggcggcctacggcggatacctgaaaccgggtcgctgagcatattcagctgcgcccccagttgcccgggctggcgctctcttggaacctgctgggagacgccctgcagcaggctctgaatggtaccctctagggactgggccatatactctccttaaaccataaaacgagcacggcggattctgcgtgcaaagcgggtcttgctggtgctgaacttctgattgcgcagatgctcgcgcagcaccatgctcttgtaccgctcagcttcctgtgcgtaattagcgtagttgctgtcgccacccaggtcgtttaagtatacctgcgcagtggtgtagttagccacccacatagcggcgtgctccggcaggtcctcaaaggccaaatccaggaccacacgaatacgcacaggtgcatcgaagtattggttctgctctaccaggtcgtatagattcccgtcacgtaccccgtacttggattctgagcaggcgtcatatacagccagctggttccatggcaccttaatcaggccgtcggtggtgggcgtaacttcacgctctaccacgttaaaccagaatcccgtgctgagtaacccacgacggttacgtgcgagtgcagagcgagctaatccagcgctagggttactagtgttgatgtccataacgcgagactccccaagggcttccagcgtcaggttaacagcgtctaattctctcatatttgttcctctattaaagaccccttggacctttaagacagggacaaaaaaaaaaaagcccctggcacccgaaggcaccaggggcgcgtattactcttccgcagtatcagcggctacgtcagccgccttacgggttttcttggtagccttgcggccagattcaaccgaagccacctggatgttcttagctacatcggtggcggccttaaccgcctcccgctgagctgcattggcctggagagtctccagaccgaacgtagcgattactgccattgaacctccaattaggacttggtggtgaaggtgaacttggtcactgcagcggtgtccggacgacgcaggccgatgttgtacatcgcgtagcagtccagcacgttgctgaactcacgctcatcgtcccagatacgggaggtgaacggcttagcctcaacagtcaccagggtcttggacttgctgaaagtcaccatgcggcacagcgcatcgtcagaggtgacggtgtaggcgctacccagcgggtgcgtaccggcctcggttgggaactcggtgcactcaaccacaggcacgccgttcatcttaactacacggcggtctttgtaaccgtcgttgttggatgcgccaaattccaggttcaggagcttcggatgctccagcagacgcgaataggtatcgacatccaccagggtaatcatgtccgacagcggggtcttgcgcttgatgagttcatcaataccagccttgtgggccaggttgatgttcatggcgttagcctccatctcagcctgggtcagctgtgtggcggtagtggtgccaggaaccaggatagcagcgcccacctcaataccgtcgttgaacgccggtttcaggtgcgccggagcaacccaggaacggcccttgattagctgaatcaggtgcgcctggtcgaatgtctctgcgaactcggagccgttgttctggcccatctcggtcaggaagtccggaccggtccagtcgtcctggtagtcaatcgggttacggatatacagcaccgtatccaccacgataatcatcttatcgttacggaccggggtgctatccagcgcctcaccagagcgacgacccttcaccgaggaggtgttcaggcggtcaatacggtaggtgttggaaccgctgatagagcgctggctggagaggcccaggaacagagcctggtactggaagcgggtatccacttcgttctggtacacttccaggtgaatatctacgtcagacgccgcgccgccccagtgggcccgggtcaggttgccattataaatagtgttggccatgctttagtttcctttataaataaaattaaagacctacgcgcttaccagcttcacggcgtgcgagcaaatcgttataacgttgactgaactgtggagacgccaagctacggttgcccgcttcctgacggagtttggtatattctgcgcggaattccgcagcagatagtgcattgttgctggctacaccgcgtaccattgggttctgtgtcttgataagacccatatcccggcagaagcttgccaccaactcagcggcctgcttgagctcacccgagttagcgagtgcacgagccgcgttacgaagaggttcaggggccttggaattaaacagctgcgctgctacctcccagttctccttaccgcccacgatatcgtaagcttcctgtactgccttggtggcttgaccaacctggtcttccaggtacgctttagccagcaactctgcataagcagcgtgctctccgaaacgttccttaatgaaggccgtatcgattaggttagggtcctgatactccagggccttaccaagtgcccgcaccatatcagagtcagttaacccagagactttctgcaacatagctacaccggcgtcaatcgtcgggttgcctgtcttagccagctcctggggctgctctttagcgctatcgccacccttatccagggccgcttttagggcttcgatatccagaggaatcttagcagggtcaggggaatctttgccctgttgctgctgggtaggggtctgtgcatcctgcacgccttgattgttcggggcgctaaggggagcacctaggcccggaatcttagggccgccttggttctctacctgtgtagtttctacgttctgaccgttttctacgttatccatctatgcctctgttgttaacttggtaataagcccagctgcttacctgctactgtcgggtctgctgctgtcaagccctggagttggtcctgtgctagacctgcggacgtatcggcagacgcatcctgaacctgttgcttctgctgcagctgctcttcggtgtacatgaacggctcgctaacgataccgtaggcgtcgaagtaccaatctacgcacgcatctttgttgaagcgcggagtaatctgctcaagcaccgggatagccagctgcatggattgcgccgcctctaacagcttgtccgctgccgcggctttagcgagtgcagaggtgcccaccgtaacgttgatgctcactacaccttcgctgaggtacagcttaaagcgaggatacaccagtgcggtgtacaggtacgccagcttacgcagccatgtgtcgctcagaatactgaacccgccgcccatagcggcttccgcctccttggcattctggcgaatctcgtaggccgtgacgcgctcgccctgccgggagttaccggtgtacatgaacgcacgtgacagtttctgttcgagcatctggatgttgctggcaatccactgaatcttctgggcagagccgccctcgtaagcagtgacgggggatttgctgttcccgttggaaccgccaccacccacctgcacagcctcacccgtctccgacgttgagaactcgtccacgtctaacccagagcttgcgtcaatcagcgggattaacctcgcagactcaacctcgtagttagtcaacgcttccgacagtactgataatcgggcgaagtccccggcgtagtcctctaccaagccgcgcccatagtgttcgccgctaacaaggttccacaccagcacgttgtaaggaagctccagctctggataggtgctgctgtctccgatacggtgcccgtctgcttcttggtacacctcgtagcttactacttctacgccttcctctgtccgcttaaccttgcgacaagcggcagtgtagatatcaacgtcgccgtatgggtctttgtcacggtagaaggtgccgcggaaatcttctggcaggtcctggacgcttgcgcgctctctgataatgagtcgcaggacgttcccgctgccatcccttcgaacggtaaagttacggactgagtagacgatggatttacctgtccgctcatcaatatactccaacgcgttacctgtaaccagcagcagcttcacagcttgcaacttcgcagcataaccgtctttctcaaatactttctgtgacgccgtgttctcgacctcggccagcttagattctgctgtagctgcgctgcccagcgaactaatgaactcgtccaggtccgaactcttggagaaccggaagaagctggtgccctgtgggaacagggcccctacaatcttagtggctgcagtgttgaccagctgcgcgccggtgctctgatagtctcgctccagcggcctgcgtctaccgtccagggaatcgtcccgggtaaagatcgtgctgagcgtccactgcgcgaacttctcagaggcatccaagacgcccgcgtcctggtccttcttaaagagttctgctaatgttgctttttgttccaagctacccccttacaggcccagaggattgctctgccctgcttgtcgccgtttcttctgctcagacgtaattgcatctgcagatgcagaggcagcccctgcggggtcaatctcagcaatgttatctgcggcgctattagcctctaaggcagcctgttgtttagctgcgctggcctgttgctctgccaagcgctgctgcgcctctaatcctgcgttgtcagtaaggccgagcatatccgtggccttgcctaacagtttacctaaaccaccactcattctgacctcactaaatgataagttgttttgtacgtgttactagacgtgctccggctaatggcgatacgcccagcgcgcatgcacttggctattgcgtgcaggccctgcataatcacagacactgccgcgccgttgtccggtttcaatacgaagaagtctgtatatagcacaggctctacgtaatgacagtcctctacagcctctgggtagtagctgacggcaccgactaagtcgccttgggagtcatagactcctagtatatactgtttacccagtatacttcccaacaccctccagtagtgctgctcaggagccaggccccgactaatgccgtggcccagttcgtgcagttgcttcactgcgtctgtaatatcgtcagacttatacagaaccttgagagtgtaatcggaagttttaccagtgtgttttaacttcattcctactccggtaacattaaattttagtagggtacccaaactggtataccggcctttctacataactcaaccataccagcggtaccccttccaccaggaaaggcgacgcagtattctggaaaggccaaggatatcatggcggcgttcctgcgcatacctgcagatttaccctgcacatcccacagggcaggcatacgcagaacaaaaataccggattccagggcccacctgtctgccagtgcgtccgcccctctggcatttccatgtatcactacagatggtttgtttggcagcatatccattgcggtctttagtgctaagtagtctgtgtaatctcgcccaccagttactagtactcgcataccataccctcagcagaagaagaaaggtgattccagtacctgccggatgtccagagtaccaacctctggcatatccaggtccgtcaagtccgcaccagctgctgccgccgcgcgggtgatatccccaagaaggtcatgctcttcgtagagacgcacaaactgctcgcggatgtgccggtgcatagtatcaacatcggctgcgtgtgtagccagggagtcgtgaatcggcacaatgtccagaccctcggcggcacatagaaccatcatcaagtgcgtactatccaggctgtgcacaaagttcggggcaatccccgaggctgccttgcgcttgttacaggtcttgaaatcccgattatgcacgcgcatgattgtgaggttcatacagtcaattcgtacccgcacttcttcacgctgtgtgtagcggttcattacgagcccgcccagcggcgtataccactgcaggtgctggcttgccggtacacgcctagcgaggttctgcaagtacgacataactgccgcagcagcagggtttgcctcctctatagcggcgcgcatacgcggggctaggtagcacgacagattccatagactgttagtgtcggtaccttcatacccctcagcgcaagcgccttcaaagatgtagtcactgcagctgcgcaccgtggcgctgtagaagtaggtcatactggggcgcttggtcatgctgcgggtgatttcgttctctctccagtaagtgctctggataacgaaatcctccttgtccaggtccagtatcaccttctcgtccgtacggcgcttcacatccatatacaggtccgctttcttgtcgttaccctcccagtacaggttcgtcagacgaccgcccacagggtctctcaggagcgctgagaggtgctgcccacctgagttcgtagcgtccatagctactgggattcggctaatatactcttctgggcatccagaacgaatagcattaaccaggtcgatagcggcggccaagaaacaccagggggagtccgccttggcaaaagcagggcaatcaaacggagagattgtgagttgctcaatctctgcaaagttcgcatcagcccaagctgcacggtcttcggatagggttttgtcataaccaaagcatgtagcgacgtgcactttgagccaaaataggccacgctcccccagcggcttaccacgtccgaattcaagtagggctttctgcaaatcagaaccttgggggtgcagcgaggacttgaagtacaggcggtagcgccagtccacacaagtcgggaagtacagggctttctcatctttgaattcctctgccatctccaacgtagtcagaaggctgcgtagttgcgatacgcgcttacggtcagcactgtaccacagggacatacgcgtcttccactcaccgaagcggtcaagctcttcctctgtgtagttctctttaggaaccccgtccagataccactccggtttaggctccggtactgagcgaggcatacctatcccaacacccagggcccgtgcttcttgcaccagttccagtatgcgcttattaatacggtacggggtttcctgtgccttattaagcgcctttttgatgccatccgcggatttaaatgcttccgctacttcacggagacgtgcgcggtcgatatgagaattatgataggtgccgcgattgtcgataggggtgagatatccaccatcccacagagtagtgtgctgcaccggcggtaccagcataggtggcttcatggttacggtatcagcggactctaccagtttctggaaggcctccataacgtcgtcagccggatagagcatgctcagattcccgctacagttcttccactggaacagtcccgtctcaaacactgcggcacacagcagacgccctacggagatgttctgggcattggtccaaggctcgtgcccatagtgtacgttctcggcactggcacggagcgtacgcaggatgtgcgtaggggacttcgtacggcgctctgtgagatactcatatactcggtccatgtacgctggggctacgttgcgtaactgcagagccagtagctctgactgtacgtttctgcccagtgcggacattaccgcctgtgcagtctgacggcgactggcggactcgccaggggcgacgctgaacgcctcaaacattgtgcacaggctcagggtggtcaggacatccaaggggattaagcgcaggaaccgacggtacttcccaccaatgcctggggctttgacatttcgcatctcatcgatagctgcagcagccacctcatatgcagaggtgagcatacgctgcgtcatcggcaggttcataatcccaccattctgcaatgcgtccgtaatcagcttacgtgcccgctcgattccgcgaatcttataggtctcttcaagctccagctggcgtttcaccagtgcttcctctggtactacaaccgtattcagggcgctaatcataggcgcttagtctccttggttatgtccggtacttctaactactgattgcggctgacccagagattatacatctccaggtagtctttagcggagctttcgtcgccccgctctactgctttctgccacatcccgtggcaccactcactcggccgcactatccatctgctccagttctagaataaataatgcacaacaagcggcatgcgccaggtgcggcaacccgctctccgagtccagtgtttcccccagagcatgtgccgtgaggtgccgcagtagcgcggccttgtatcgggacttaccttcggctaccgtgtgccaactgtgtgccgcatacttctgggccccgaaggtcagcacatcactgatacgcagcaacgcattcgggcacccgtccagtagcaagtccattcgaggtttgtctgcgtcatacttcatgcctgtacctactgcactcatgctaattcctccaccccgtgggattttaagtctgttcgatgtgctgctgcaccatagtcgcatacagcgtaagtggtaatacccagtccgcggaaatgctcaatcaccgcggggctgtcatcccaagccgccacaatgttttctaaccccacttggttgcgcaggaactcctctttgataatgacatcctttcggttgtcactgtgcggcctcataaccagctcggagtacataacgaagttccgctccagccaggcctctgtttccgctcgtactatatcagagcgccccgtcaagataataactcgcaaccctgctcgcaccatgatgttgcacacttcaatagtgctgtggatagggctatcatacttcgaggcccggttgaactcattccaactgtcagtcagatacaaatccacagtaggcagcaagtgcaagcggtgcgcgccatcagctagtgtaccgtccaaatcaaagattactgtcttcatttaatagcccctccccgtgctttttgtcgcgccgctctactaccctctgccacatctcatgacaccatgcactaagcgtcaatgcacttacctcggtgttgctcatacagttctgggtacttatcggacttagcaatgtcctgctccagtgtatccttgttaccggcgcagagtctgtattttaatctgttaccgagacaatagccgtagaactgctcttgcgtcatgctgcgtgcaattacctctattgcctccaggtccgggaagaactggtagtgccgaggagagttcactgagtcagaaacagcctcgctcttcgaatggaagagctggaagaactccgctcgccaagaggtcccacactcggctaaggttataagtccgtcttctgcgcacgtcactaatctgggggagtctaggtctacctgtagctgttcacagatgtccttccagataccccctacgtgactcgctttgcgcacaaccaaatcacctgcatagaatttagtggattcaatcatttaacagtctcccgtgctttgcgtcgtgccctggccttgcgggccttgagcttctgtgcttgtgctagttcttccggcgtcttgtgcgtatagtatagcatatccgtaggttctcggtctaagtaatcggcgaccctacgtagagattcagcaatagccccagaagattgcatgctaccaacaatccagcgcccagcggcagatgccactttgccttcccctccattgcacgagcgatgaagagcaccccgaatacgcccagtaatatgacagtggtcaacgacaacagaatcaccagttacccccttgattgtgaagtccaaaggtttgccgcagaggaggcatatacctccctggtctttggcaagcttaatagccacagagcgaatctgtgctcgagttattttacgcagcgccatgaaatccctcttaacatacgatataccgtactttgagccatacccaggcgtctagctatagcgttgctaccccattcccggtccccaggaatgtgcatttgccgcagatagcgcaccgtaccttcgttcaaacgtgagcggccgctgctggaaccctttgctgatttgcttttgtgggtccctccatgcaggtgctcagggttaatgcagcgagaatttccacaggtgtgctgtactacttcgggccactctcctgtgtgttcatagtacgccttcctgtgtgcggttgtaggttggcgtttaccgtcaataagcacccacgcggataggaacccagtctttggccgcccctttctcccatggtctatacaaggtgtactcattaccatacctcaatccccccaactacatccagcatagcattgtcgtgaatgagagaatccaaatgctcaaccgttcttcgatgtgttttgggtgctcgttcacgcagcgcatccagaatagtttcaagttcatcgtgtttcccctcgtagtataactcaatcgcccgcaggctcatttccttcgcagacatcttcgccattgtctgggtgctcctgtatccactgtatatgctgtttatggtactcgtgcagcgaatgcacccagtcacgcagactgggagtagtcaacagtgacatcagatactgataggcagaatctgacggggagcgccgcaggaacaggcattctgcctctgcgagtacgtcttggttgtttcgagcgtaagccgctacgacgaattctgcggcgtcctgctctgaggtaatagggtagatagcatcaaaggccgttcgcttgccacagggcttcccatcaagcaacgtgatgcctttgacgttatctgcgtcgtcccctgctagcatctgccaccagaagaacttcaacccgtgtgctcgtacaggcatagcctgggtgtcatcccacttaacccatccgaatgggtcctccagtgcaggccacactgtacctgtcggtatatcgaaccgagccatagggccgagccaagaatccttgtcctgggacatcaggattccccggtctccgaagctgtacgaatccattacaaagaggtcgtcggcctcgaagtagtcactgctgactacctgaataccctgctcagaatactggtctgggttctcaatcaggtgccgcttcaacggtgccttgagcggtagctcctgtcgattagcgcgctgcccctgatagggcttagccgtaggcaggtgccagcgcaagcacttagcacatcccgcaggcgtcaggtacgccactgcctctgagcagccgaccaggaacatatcctcaagcaccagctgatagaagcggcgtattgcggtatccaaacgttttactgtagcggcggctttgtacacgcaaaaatccgcatcgtacagcagaatcttcccagagttctgcggagctaactgctcgctaagctgggacaagtcaaccccgttgataatcatcagcgccccgtaatatcgcgggccttcttgtcggcccagttaacccaacgttctgcccactttgccttgctcagcttatcgccaaggtagcacagtcccgccaatggaatcagcgggagaatcaaagctacgtaaattgcgcgagatacgtacaacatacttaagcctccagttcagacagcaccagcacggtgccgagcatgtccccgattacttccggagtacgcaggctctggtctacgtcgtagatacaggagccaatctccgccaggccaacgctgagcgtgcccactacgcggataagtacaaggtcgtctcctcgtaacttatcggcatgtgccgccagatcgttgtgctcccggaaggctgtagcggccaggtccaggtccattccgtacagggccgccagctcatctagtgcgttgtagatgtcgtccagactaatattaagcaccccatacgccgctgcatcgtataccgctgagccgaccgtaatggcaaggttctcgtacgcttctaatactttatccattagtcaaatcctttcagtttgtgtttttgaatgaaggcgtaggctttggtctcagtggccgtggcctctgcgcccagggcatatgcacggcgccgggacttggcgcactggcgattcaagtgataacgctgcgcactaatctcgggacccagaaggcttgccctgtatgcgtgagagttagctgcccagcgccagtcgtctgctcgcttctgcaaacgctgtgcgcgcagaagcagaaacacagcgtactgttctttggcccatgtgattatgcgcatttatacccccaggaagttagctacttcgtcacgcttggcacgcaggttatcagcatgacaagcatgcgcttctgctacctctttgctgtgcttggaggcctctactcgcgcctcggattgagcggccagacgtactgcgtcgtctgcgaatttaactgacagctgctcgttaaactgcgctttggcatctgctcgtttagcttctgctgtgtaggctgcactcaggagtttgataaggatgttgatgatgttcataggcttcctctaaggccccaggaggggccgtattagtttcgattagggtttattaggcttgaggtgcagcgggcgctgctggagctacaggcgctacaggagccgcaggagccactggagcagctggggctgccggcgcagcgggagccgccggtgcagaaggagcagcaggtgcctgcatagctgccggactcggaacagagccagcgttcagcataatatccagagcactgcccgggaagtctacggccttgtacatatcctcctgaatccagttcttgctcttaccgtcgtcgaaggtgccttcgatgtgtaggctgtcccaggtctctttggttgggttgttccacaggaacagcttaatctcggaggcatccagcgctggcatcttaataggttcaccggtgttcgggtcgaacttaggaatcgggcggataccggacaggtccacgatgttcgacttcttacccgcggcgctggtgtgctcatcaatcgggaaggtgaaggcctggcccagacgctgcgctgcatgcttaatgctattgtcgtagttgagcttgtcgaagaacttcttgaagcctgctcgctcaaagttactgatagccatcgggtacgggcggatacgcttcacttcgccgttggggccgaacactacaatgccgatacgtacgttagccactgcaggcttaccggtaggcttaccacccttggtcggcaggcgcttaccgatttccacatactcggtgaagtaaccgtaatattcacccttcggcagcagcacgtcctcgtacgcaccaccctgtgcggtttcccgcatatccacatcttgggtttcgattgctgcgtctaccagagcgttcagggatgccagtacattcgtagtcatataattacgtcctcgtttagtttaaatgatatttacgtgcagatgcaggtccggcctagcgattcttaagtgcggatttaatgcctgcagccgcggctgctgccacaccgcctgccgccaggattgccaacagcaaagctacaccgccgtagaacggaagcagtacccaccaccaggaccaggcgataacgccagtcagtttcagggttacaaagataaggcccagtacagaacagattcccattttcatcgacactcctaattaggttttgattatgtcaccaacttttaaactaagagctgaggcttcatctttataccaccgctctgtctcagatttgtgcccccagcagtcatactccagggttacacgatacacctggtattgctcatcccatacaggagcatctactcgggtgacagttgaatccagtacattcatttgcttctccctacccaacgaccatcgtcgtcgagcagcatcggaattaactgcgggcaaccctcggtgattaccatcacacccaggattggtttcttgcgggtgagtctgccataagcaaaggccatgctcttgcggtcaatcaagcaccctgcatacgcaccaaagtacagcgccgttgaagaagcagcatactgaacctcgaagcgtccatgctcatgccccaacaccagagaggtgcgctcatgggatgcattgcgcatgaaatcaccgctgacttgatgctggaaacggacaggccccagcggtgtgttgagcacccaagcgtcggcccacgaccacgccggagcaccatgctcagggaataagatgtcccggtacttcttgataaattgcactggcaaaccgtgagctttagcgcggcgatatacgagtgagccgtgattggaatcgcaaaccagcaggttcgggaatagttcatgcagctcctccagtacgagcttggctttctccagctccacccctgcgctatccaggttagggtcagagtcgtggaagctgatagcgtgcccgtcggtttcgtcacccacctgcactaccatgtccgggcagtacgcatcacgtacgctctcaaggaacggcattgcgtctacgtgggtatacggagcgtgcaggtccccgacaaccagaatgcggtggcacatatccggcacctttgtattcccgatatcgtccgttgggcttggttggattagcttacgcgcctcctgcagcccgcggttggcactggccttgctgcccttgttatccatgaagatgctgcgccagtagcgtacaagctggcgagacacgattacgtcccccctgcgaaatttgttattgtacgcaatagctgcatcagtgttatttaggaaactgccaagaatttgttggtgctcttctttggtccacagtttgattagacttactttagccaaggttgcctctcttgtgttgttcctactcgtatcacattaattctcggggaatcacagaatcaagccagagtcaacaaataattttatttaattatttagttgaccctagcatatttccatgctaccctaaccccctacaccacccaagggtccacctatcactactccgcgatgagcttgtactctccagcgaagaaggtgatgccgtccccaggcttctctgagttgctgtccggattgagtagctccacctcgccgaattcaacgtcgtaagatatcacgcgatgctgcgtacccggtgcaaagtaggcacgatgtcgtgggtcgataggctccggcccaagttccagcatctccacaatactgccaggtttaatattcattctaccttctccttactgtacatgctcgtacccatttcagcttccgccgggaagggcacctcgccaatgataccgtagttaggccagagctggtggatacgcttaggtgcatcctccatgcactgcttaaccagcaggctcgcctcacgtccaacctccgggttggcgctgtccagatacaatgcatcgtgtacgttcgtaatcaggcacacctgattgtcgaaccagtcacgggccaagagtgcacgcagaaccataccagccgccaccgccatcaggaagaatgcttccccttggcaccagtagttcgccatctcggtttccttgtagtccatgaccttctgcttacgctgcccaggcacaacctccttccactgctctttctgacggaagctgtagcgggcaccagcagggctggtccacgtcccaatgcggtagattcgatagctgccgtcgtccgcctgctcccggtacatgcgaccctccgcaccggtacgctctacctcttccttaacaacagcgcggaagccaattgtttgcgggaacagcgcagcctcgttgtccaagaaagcctgtgcaaattccaccgtacatccagtagcaaacgcaatccccttagccgtagcgccatactgggctgcaaagctaggagccttaatacttgtacgcattgccttccaaagcggatgcagctcgtgcttcttgttgtggcagcgctcatatacttcttcatacggcagtccctcgcggaaagcgaggcggtaacagtgcatatccgtacctgcctgtagcaagcccagcagtttcttatcccctgtatgcacgcaggacataaccacttccagcgcagagtagtcaacctcagtgatgcggccgttatcaccgaatcggctggtgaatacctgcttcaccttggatttagccaccccatccccgtcctcatccgggcggggtaggttctgcaggttcgggttagaactactaaggcgcccggttacagtggcacaagtattcagccggtggtgtatgataccggaaccatctgggcgttcgggtattacgtactgcagcattcccttccgctctttgacttctccgtttgcatccagaacttcccgtaaatagtaggtaccggtgtccttctcaagcgccgccagctcattcaccaacttacagaactcgaacccttggcgggccagcgcctccattgcgtctgtgctggtgctgtatactggcgtaccgtcctgcagggtgcgcgcctgtcggaactctccacgctccgcatacttctcccggataacttccggcagctcctggatgttcactaggcccgggcagaagtaaaggtcatcctcccacttaagtttctcctcctctgtatcaaggcggaatacttttggtagccccttgttcttaccggacttgtacgtggttgcacctggcggtgcgggcacgtcatccacggcaacccaagtgtccccgacttgccagtagtcggccttgacgtactggggagggtcatagggcaccttcttgcgatacttgataggcccgccgtacaccagtgcagacatatgaaagtccgagccgaagttgaaatccagagtctccggtaggtccttcgggatatactgctgcagctcctgcttaatctcacagatgcgctgctcctgctcctcctggttcttgcgcgcaattggcatattaacgaacaggccgaaccattcgcagtacgcccaagccagcaaggcatccatacgctcccacacgtactgcatctgattgcgctgggtgaacgtagcacactggccgtagaagcacagggccgtgttctttatatcaccattgactaggtaatccctgagaagaatggggtctatctgcgaggtcagaacaccctgttcccacaatatttttaccccatcaatcttatgctccccaccatactttggcgcagtttcatccaaggatgggtacatactctgaaagtcagacacaatatactccccgtgcattgtgtcgaatacgcggccgccgcgctttaggaattcctcaaagtgttgccgctgatatgttaaaaaccagctaatttcgaaggctgcgttgtgggccacgatgcaccagcaatcagaaggtatgcggaaccacagatgctccccggctacgtcgtcaaggaattcctgcttgctgttgaatctgatatcaaaggtcggttctacggtaactgtgccgtcatcctcggtccggtctatgcggtaggccgaatgcactacatagttgtcagggcagtaggggctagccttgctaccatagtaaggattattctcgacctcaaggtctatagtcataatactgctagtcatactgcaaccccgtgattatggtgataccccgccgcctcagctgccagtctacgacactctacggcttgctctatactgctaaatgaacctaattgtttatttcctagggttgctatccaacgacctctcttcctgtgcacccctacatagccgctgcggttgcttctatatagggacttgttctgcatgttcttctcaggaagcactgccctcaagttatctggggtatcttctaacctgttatgatttatgtggtctatatggtggcctgctcgcagcggaccgttgtgcatctcatatactatcaaacttcttttgtatagcttattatgcagcttaacgtaccagtatccatgtactttgttcagagttcctgcctcggaacctgcggcgcagtttaggtggctgcgtccgcgcccacttctaacctcgtgcttccagtagagtttgccgtctttgtaggtaaaccaaatatcccaattcatttccacttagccctccgagccttgttgatagccagatgcacaatcagctggctgctgtccagtgcgaatcgtttacggaaagtacctgcagatgcagcgtacgccttgattacctcgtcgtctaggtagttgatgtctgacggtttaagcatactagtaaatctcccagcagtgatataggccctacaatatcccactctctctgattgtaacgtgccccgagttccacggtacaaaattccccggtaacgcggtgtcgcaccacgtaactaccgcgtataagtcctgtgtaatccgctttttggataacccctgtatagtctacttgcataaaccctcctgtgtacctacatagcgccctcgtagaaggcgctagggaagtcacttgattggtggcggaggttcgatagcctccagcagcggctgctgcagtaggtaagtgttgtactcctgtatcgcttgtactgccaacccgcgcaggcgcagtgcttcgtttacgtcccaagcagcaccggtggatacaagagagaacgcataagcatcaaagttgaatgtgctctccttagattcagtcagtcctatgtaggcgccgctttcacttacggcgcacacagtgtaagtcctgccaatcttcacgccagtgcggtagaatatatcacgcggcacaacggtgctgcgctttactttatcgccaactttaaacttagacattaatttggccctcatcaaatctacaacgacccggctcgaatcccacctcgaattgcaggagcgattctttaccagacagtgccatcttgttcttcggagtactgataccacggacgttttgcatgtgcggctgctcgttcctgtccaagcatcccatcataatcgccaagtccaaggcaccctgcacgccaatcttgctctgcttcatagcggtgagtggcgggaacagcatgttgtaaccttcgagtgaaagttgcatagtgcctacaatagcgcagtcgttctcgcacccaaggatacgcagctcctgccatttcgcctcaaggttctggtgctcactctccatagtgccgccacggatattcgccaccatgtcgatgatgattaccgcggggcgcatctcctccatgagcgtggatatctgcgccatcgtcaatgagtgcgcagccttgacacgaatccggtcagccctgcctactttcttgaggtaggctggcacgaactcttgcttactgtgccggtccttaatctccgccagagtccaatgcagcgccgcttgatataccctcggcactgtgcgcgtcgctgggccctcgttaaccaaccagaggatagggcggtccccgtatacttccggctgctgctgcatctgctcagcaaagtccacagcaatagcagcaagcaggctagttttaccagagtccacaggagcagccactgcgatgcagtccccgccgcgtaagcctcggatgctgctagcgagttgctcgaacacgcccagtttaagaccgccgctctcgtcagtcgcggcaagtatttcatcaacacttccgctctcccattcaagcagcgaatcatgaacagcagcgccgtccccgtacttgcgctgcaagtgcttcatctccagaaggtaatcaacctcctcgccatcttggtagcgctgcgtcagcgctgctacctccccgctgtaggccagctcattcagggtctggacaatgcccaccacagaatcctgcggcacggcttgtactccccgcataagctcgtccatgattaccctctcttcccgggacaagtgccccgcccggaggttgagcatgctctgcatcgcatcccattgcacctcctggtgctccgggtaagtgttccagtacaaccccacccagtccagaaggttcgaagtgtccggcgcaagcatagacttgggtatctgctctcgcagccggttccacaccttctgcgtgcacattgcacgcacaactattagatccaattagagcctccaagttttagctttcaatacatcgtgcactgctgacacacttacaccaaggctagcagctatggccggtgtgccgtgttccctgctgtaccgcctgtaggtcttcctgatatagtccacctgctgcgctgttagcttggagtacccattctgctcccctttagaaactccacgtctagccctacccctggcaatacagtcatggacgttatccttgaccgtacctaattctaaatgctcgggattaatacatctcgggttgtcacacttatggcgcacaactagccccgctatgctctccggagatatatcgttcgccgagcaacacacctttctatgcagaggtatcttccgccctttgaacgtggtatttccgtaaccctttggtccgcctttctgtttgtgctctttacacgcgcctaataccatctaataactcctgtattgttgcctcttttgggtccccgtcgtagtagatttcgtggcacgacataaagggacgtagcgcacggcgtatcatggccgcgccggagtgtcccgcttggtcattatccatggacagtatcactgtcggtttgttctgtatcagccacgcccttaactgcacgggcaagcgagtacccagcatagctatagcctgcacgttcattgcagagtagttcgtaatcgcgtgctgatatttgatcgctgatagatagtcctcggtgagcacgacctttagaggtgcggccgcagctacagccggtgctgcggcaggtgccgcggcagcgaacggtattggctggccgtacattacccacttcggttgctgtcgggcatgcactgcacggcccagagcagcgcttccgacacggaagattatccgctgtttctctttgctccattctgcatcctccaccatttcaggcatgattccctttgtggtcaggaatccgtaaataaaactctgcgtttccgcaggcgcttggctaatgcaaattgcatctgcaggtgcagagggctgcaccctcggctcttcctgtaactgtatgcgctggtactgcttgtgctccttgcccacttgcttgcagcggtggcaatagtattcccaggcatccgggttattgtagagcaccccggcggcgtccctgccgcagcaccgaaagcgcgccctctgccccacggccaggcgcttgcacgctctaagccagggctggtccattacttctgctcgcgcttaaccgacatagccatgcggcgcaggtcgtgtgccaactgcagggctgaatcggggtcgatgttaatcccaatctcaacctttgcccgagtgcttcccttcttaggaactaccccgatgtacattaaaccttccccatccccattatccttctcaagaactaggcgttggtcatttcccgggtcgcgcttagagttcatgtaggccaccttgtccgggactggcggcagctcatccttcgggtcttgatatagctcgaagttataggcgtaccacgggtaggggtcggctcccccatctgtaaagttatccaactgcagccagtggccgcttgtagttatatctgtaattacgtagtaagcaaaatcccctaggtacgacttgaacgacgaagtgtttttgtgtgctttgcgaacaactttatcaccaactttaaacttagacataatcaaccctccacaatattatcgtatccgccccagtcttctacgactcgggtgcctagttcaatcagctcctgtttgaagccataatcggagaacaccatgatgtactccgccgccttctctgggttctcctgcacccagctaaccaattgctgtttagatagctgtgacacttcccggaacgcggccagtaattgcgggtcctcgtccgggggcatgtcccacggctgccgtgaactgagcgttggtgcagagagccattggtctggctccattaccttcgggtctcgctcaatcggtaggtgcgagaacgtaccatcttgcagtacccgctcaagcacttgccccaggatgttcaggtccagtacctcatccggggtgtgctcgtgcatgtaccctacacctacgttggtgcactcaggaatgataccaacgaactcggctgagtcagtgtacacccccttctgtaagtgctgctccgtgcgtcccaggcgctctgctaggatcttggcaaaggtatcagagcagcagcgcatgtaccgttggtgcgtaatgattccgtcgccgcgccggtcaaagctaatcatcgccttgaccccagtccaaaacccagtgtcatcattgaccgatgcagcgctgccttcgcagccaacctcttcatccacgaagaagcagtagcgtccgtgcacgccccgtcgcagcatctccagcatcaggtagataccggctccgcagtctgcgcctaagcagtcagcctgctgcggattctttacgaacagaacacccttgttagtgcagccgacgtccggcgcagcgctggttggacgggccaccgtatcgaggtgcgacgtaaatgccacgtcgctttgctctgagtcccccaccagcacgaagtagtttccgtgcttgtcctttacgtagtgcataccactaccaagcgcctgcataagcagcggctcgaaccacttggtacttgcccagctaggccggtgcgtttgcagtatctgcaagagcagctgcatatcaatcccgtgaggattcaagaacattaagctgcctcctctacttcttcttcatcgtcgttgcccagatacttctctcccaagcaatcggctgcatattcagtgagaattagcccgtgcactggatgttcttctgcgtgctcaataagcacctgccggtcctgtgcaaacaccagttcttcttggtcatgcactaccccttctaccgaacagtgctcaatgtccgcgtcatatacataggcgtcgtggtaatcagaccaagtgcagctccagcgattatgcagcccttctcggccaactacatatacaaagtccccatcttcgacgcagccgtcgcagaccatttcaccgtcggcggtttcgtgcatatcatcaatggagtagcgcccctcgcagcagcagcaccgagcagattcagtgcctacgtagatgtatccatcggcttcttgcgcctcgtactcgtagtcatcacggattacaaaggcgtcactgccttcttcatcaacaccgcactggctgctatcgaggtacggcatcagcaccgcaccggtgtgttgcgggtgtggtatacgcgccagcattaccccttcgagacactcagtgtttctgatgtacccatgtccgcgcaggattgcatccgcagcgttgccataagcacgaacatactcgttagtttctggcctcacgattgctcgcgcctgcacttcgaagtcgtcaccgaacagctccccggtgtactggatgaacaggcgcagcccattatccggcagcccgtgactggtagtagcgtacgcccgcacagggctatgctcaaaggagtacccgctcatgcagctacccgggccgttctcgtaggcgtcgtaccattcctgctcggtcttgcacaggtacgttttagggtctacgttcatagccttgaggtcttcgatagcatcgcggaagtccacaccatttccgtagtagttagcgagccacttacctacgcgcatctctacgcagcggtactcagtaactgcggcgaagtccttgtgcattcgaggctgccccagcatcacgatgggctcaccgttgcggaaaccaaagcccaaaggcacggcgaatctagacactacgaaaccgtgcaacttcatgagcagcgccgcggcgctcatgtcacggatgtggcgtccgtaattgtagccagtgtactcccggcgctgccgctcttctggtgcaagcataatgcgctcgaataactgcacggcctgcttgtgcaccttgtagccggtgaactcttccacgcacgcaaccacgcgctcaaccactacatcatcaccctcatagaagtcgcggcggcgttcccagaacttgctgtcgatggtgattcgcgccggagaaaggagttcgtagaaagttccggaccggtacaagtccaccttttgcaacggcccactaaccctcatcacctcgcggtattttgggtgcagtatcccgcctatagttacctctaaacccgaggtgtacatgccgacagtacgtagacccataagtgcctgcagtggaccctcattgtgagggtagtctacaccttgcatttgcaagtcctggaacggggtccagtaatcaccgctggaatacatcgaacatttaattggcagtgtgtttgcaccttccggcaacactactttccattcgataggtgctgtgacagtttctttgatagtctcttgcattttaatttgctcctgaatagattcaatgagttcgtcgttaactgccaagtcagcgcgcataccacgcagcgagctgtctttgcttataatacgagcgcacagccgccctaaatcttgtataggctccacgatatccgtaccgtagcagtgctgcaaccacatcgaacttaatgtgctcttgcaactgccgcgcggcagactctgtatactcgcggtacgtggtgagcaccaccgtagagtcctgcctacgaacacggaggagtctacgctcgaccggtatgatttgcttgagttcattaggaacctctttgaatgtttcccaagtgcagccgcacttgccctgcgtttccagcagacgccagcatagcagcgctgtttcgtctactgttagcataggcttctcttaggaacgcagtttcgtgacaccaacacaaaagccggagaggtgataacgtcacctgctcggtaactgctccgcattaatcccgcagaggttaaaagtatgcggcgctcattaattgccccctctaaagggatgagataatacagaccgctataggtctctcggtacacgtcatacttcatactacacctcgtacattaaagcgcaggcagtagcctcgcaaggtcatacccaggcgctgcgcttgcttctcgtagtgctggcgcagcgctgccttcgcgctgtactctcgcgccagtccttcgattgttggttgctgcctacacatcagcagcgtctcaggattctttccgtgcataccttacctcaaatatcgttgttgctcttaccgtccaccgtgagcgttacagcggcgtccgggtactgctcctgcaccgccgcaaggatacgcgcgcccagctctttgcaaccaccctcggggtcttcaaagaggtcatactcagggcgcggctgcggttcctgcgccgccggttgctgcaactgcactgtgcaatagggcaccgggttgtttacgtcgttgcccagcaccagcatagcgctggtcacaatgatgttgaacacgttaaccataaagttgtctccagtcgttgataatgccaagattcacggcgtccagcacagtgcgggcagccatttcggtgtaggtatccacaaattctaaaggggattcctgattagtgtctttgtcagagaatataaccacagtgtagctgtattcttcgtatatccgattgcaccacacgggccagagttcatggcccggatagaccagtattgctttcatatgaaacctcatacgccagttgcattcacatagcgccccgtaggacgctataggcttgctactaggccacttccttcaaagttgcgtccagcacagcacgtacatccacgccctgattaatgagcatactcaccaaatctgcgtcgcttacgccagtctctttggccttcttaatggcgtttttaacgcgccccagcgcttgcaagcgcactgcatcagcgtccagcgcgtcattcttcacctgctccgcttcggcagcgtacagggccatacaggagctatagaagctggcaacaataacttcgcggccctgcttgtcagcttgtttgtagtcaagacgcatagtgtccagttcgattcccagcttctcagccgacgcatagcacttcttagcgttgaactcgtacttaccggactctttgttgaacttgatgggtaatagcgtacgcagcaccatatcaaagtcagcagcgtcactgcgctgcatatccgtagcccaggaaacgttgctgctgataagaccgtggaagagcgcgctgatagtgatgttacgctttgcttccactacgtcgcccagcgctttacgaatgctacccgcagcggtgagcttgaatactttaccagttgaatgggtcataatacacctctttgattgatttactatcggttaatttcacatagcgccccgtaggacgctataggctattaaccttcaccgtagccaaccatttggcacctccctagttgcttagataattacttcacatagcaccccataggatgctataggctgtaattagtgcccaaattgggagttaacagtaggccacccactaggctgtttactgccgcccttttgtttttgctttcccctcaccctgtgctcaccgctcaacccttgtttgctgggcttcacagtaagcggcacgttatcggtagggttaagtgataactgcatattccgccgtaatgctaggcgttttgctttgcgcataatctcacctctcagagtacataatctagcgcagccttgttactgctacgctatgttatatgctctttgcggggtacactccgcgccttgttccctcgattcagaggagcgagctgctctcgcctcggcagtatggtttgcctcagaaccccggtgataacgtccggcacgcttactctttttaactgattatctaggctcggtcgtcatcgtaccagtcaaggtactgggcctccccgcgaaccagcttactgcttgctatctaagttactcagtgaatcagaacttgtcaagcgtttatttcttactacttgctggctgtccagctcggggtattcggtagttcccaaccagcctgtttccctaaactccgatgagcatcacttcttaggggttatctcgctgttagcctctcagcgccctatcgtggttagggttccaatcgcgcatttactgttacacgacatattcagttactgcttggactcaatctagcttatgcccttcgcggtgtcaactctttttatcgagtgtctaacccttcgcactatctagctttaatccagcggagcctcccggctcggccccggttagcacctcagcgcctcccggtgattgaactatagacccattgaaccaaaagaagcaagcacttttttaagctttttatcaccgggagcaaaaagggtaagcagggtaaatacttagaaccacatcagggatagccctatgctggcactagctgtagccactgctagccattacgagccaatactatctaatactacaaagagcagaacgcagtggcgtaacgagagtgaagccacgtagtgatgcggtgactgtgtaggtatgtcagcctactgcgtaggcacagggacatactagggagtgcatagtgagtagtagtgtatatagtgtccctaaacccctcctactccggttacttcatttcataatagctttcgaatgaaagtaagagcaaagggatagcattgggatagcgctggatagcgctggatagcgctggagtgtgccgggtagtggaagtgcgccctagtggggagcgcgcagcgtagcatagaatcggcacaatgtaaagcactaaagatagccagtggatagcctagtgcatactagggatagcactagggatagcactacagcgcactagctggcccactaggtgccacactgtgacgcacaaaataagcaaggcagagcacgcccctatggcccacagggagcgcacagggatagccctagcgcctcatagcacgcactgagagcgcacaggaagcgccctagtgaacgcacaaggacaggcatagggtagcactagcgatagccctagaacgcagcacaggcccgctgaggccctctggtgcgcactagcaggcccacccagtgccccccccccccctaaattgacgctaggtaccccctatgggggcaattggcgtcgttgagggtgagggaggggctcgcgtgagtctaataaatttcaggtccaggtatagacctgctcgcctagactgggcctgggttttacgctgtgcattagaagtgcagcaccaagctagcccgagtagccccgggggtaattggagcagccccaggattaaacagagtaactttgtaggagctgtacccactgtagctactgacaccggctagcagcccatcaacagacccgttaaataccggagaactcaaaccgacaggggcttgagtaatcccgtatgggagagtctgtacagggctagataccagcgtaccggcagctacagcacctggggtccacgcaaagctaaatggaacagaacgagcgcgctctactgtaataccatccaggctcagtgtgtttccggtgctgttggtgaagcgcaaatctccgtccccagttaggctgttacccaagtaaaagtctacatcgaaccaccctggaccagccggtaccgcagcaacagaggagccgccactacccactgctaaggttatgttaccagtagcgccggggttgtagactcgcaaggatactcgcactatagacccgagaaggtgcagcggcaactggtaccgacgcatctcctgacccgcaggaacatccagtgctacagtactagcagccccagccctagtggtacgactagcagcggcagccccgcgcatgtacgcctgcccgataaacccagggccgaacggactatccccgcgcactacgttcatgttcccgctgtatacgcgaggcgggttgatgcggcaagccctagtactactcagtgaccaggatagaacactgctggcatctgcaatgttcgcatcattgtcgaaggcatctacataaccaccttcaatggtccagaattctccttcgcacccatacgccttgttatcagaaataacaataggaccaacagctccagacctaatacgaatacacccggcatacaggttatggtcggagtctgggcggaagtgcgcaaaaccattacgggtaatccaagagcgtgacagctgtccaaagtccagtacgtgctgcgtggttgtgttagctccgtacggtacactatcccactcaaacttattatccgtaatccacaccaggtccgggttactgtttgctgtactcttaatccacgcaccagagcacaacccgaatgtgttattctgaatgtgcaggttattgacgttattattaggaatacctatgtaatcccctaggagtataacactgccgttagaggcacccatcctgcagaataagtttcctgagatgtgactctccatacagtcacgcaacaccagcgcagatcccgctaagttattaaaagcagagttctccgccccaaaatagctccaggaggtgacttcaaccataagtcccgaatcactgctgacagccccttgcagtcgcattctgaggaatccgcccccagttccacgtgtacttgtaccgtcaaagtagaacatcttagcagctgtgctaggtttaatgaatacagccccaagcgggttgacgccctctaggccatcacctataaacagcatagggttagttaggtggcagtccccaacataataagaccccacaggtacgcgcagcacctttacacctttagcggaaacccgctcaatagctgctgcgtagttgccggaagaatccggtcggagtccggtaagtaccggggcatccttcgctaagtagtcagctactctgcaccacaaatcgtcttggctgtagtaccgtgtttgtacgttctctactagtgccatgtgtcccctcttatcgtttcaattcagccagggctgtgcttacgttcttatactgattcccgatggctttgctctgccactgcctgcgctcccataggccccagcacactctattgcgctgcccgttaatatactgggagcagtcaaaggtccagcggttgccgcccttatacacccaaccggtgcccggggacttctgctggtacttgctaatataacgccagtccagtacagccttcccggctgccgcataatcaaggctcttgagatgccgcttcacggcactgccattgaagccagctacacctacgttataaatgaagtctatagacccaaccagggctacgtcagagagctgcataggaagcccgtcaagggcctttgcgtgttcccctgctgattgtatcagttgcttctgacaatcgctcagcgtggctctctggcccattttaacgcccttggtctcgccatagcagattgtagggacaccggcgctatccttgtaggcggtaaggctcaggccctcgttgtgctggactacgccggtaatggcaccgccgagcatagtggcccccgtgagggccgcaataaccttagtccttaaactcatatttaatagtccccttacgtgcctgctcctctaggagcttgaatgtacgtcgcttgtaatacgcattccacgccagggttagcactgcgcacaccgtcgcagtgatgaagctgatagtgctccagttccagctcattaactctgccaaccaacctcctgataccgtagcgccggtaactgctgcacctgcccgggtagcgaggtccgacccaaccatgtctcctaccttaatcatcctgctgccccttcttcctgaatagcttacgaatcaccagaatgaccactaggaagaccaggggaatgctggccccagctaatccggcgaggataagactgtaactatcattgttaaccacctgcaggcgttctgcctggattgtcccggtgctaatagtttgtacctgcttcttactggacgtgtccagggtgcctacgttagaatctgatacatcggttttgttggtggtgctggcgtccaccttgttgttcaggccaacggtttgcttggtgttttcggcaccaacctgagcagacacatccggcttagaaccaactaagccggtgagtgcagaggtcgccgagcaaccagtcagagtaaccgcgagcagtaacccagcgaccagtttacgcattagctagcagccttcactgcggctactgcggcttcaagcgcagcaatcttggtgtcgaaggcggctccagtctgggctacgttctgcggctgcgtaaggatagcatacaggtccttaccgagaatgttcagctgacgcagcagctcctgctgttgcgctgaggttgcttttgcaattgccatagtattactccttactcaatagagattgctgtgattacaccatcttctacagtgatagtcgctgctacggtggcagtagcctctgcctcccgagcggtggtgaacgtaatgggtacggttacttccgcaccattactgaccaccactacagtgccgccgtcagaggcccctgcagcagagagtgccgctactgctacagccccggctgcatctacatccggacccagagtatctaatgggccagtatcatgtgctaaggttgttgctttatcaagtgctactgctgcattacgtactgcctggcgctgtgccagtgttgcttctgcaaatgccattatcttcttcctctatgttgtttacctctgccccggttctgtaaccgtgcagctacaccccgaaggcccttagacactttgctctgtgcccaatccagcgggttatcaatgaaggcccgagccatcttctcagactcacgctcagccaccactttctcatcttccaccaggtgcccgttcagcgtagccaccatcatggcgattgcgtcagcgcggtcatccttagccagactaccacggtcgtacgtaatgccagacaactgcgcgaacgcagagtacagccaacgcctgtcgcgggaatacgccatacaggtactaatatcatcgtgaatagcacgctcatgcactaccaggcggtgacgacgagtaactgggctgattgtgtcgatgatacgacgctctttctgagtggagttgttcagatcccgtacaccgataccggcgagacgtcgctcccgtaaccggttcaggataagcatagacacggtgccatgccccatgttgctctccaccaccatatccgggatgtctagctctacgcacaggtcaatcagtttatcaatgttctcttcgctgatacctccttggaagccgcctacggagaataggtgaatgtacgagttcgcagcgccgccagcagcgtaggacacttcgtctccgccacaaccagccgggtctactaccagcaccttatgctggtacggcaggtgcatgtccccgtagaatgccgggaagtacatctgctggcccataatcccctcatgctcgtgctggtacaggtaccggcggtccgcaatgtaggagaatgtctccggggaggaatcctggctaccggagtaaaccagcatatccgaaagcttgatacgcgtacgcatttggtcggacagggtggtgtcaagcatgtactgcagctggaagccttccggaccgaagtccagctccttctcaatcagcgcatcctcgtcatagcgcccggtgtcagtgctctcgcctaacgtcccgtcgacgccgaagccggtgcgtttatagccgcgctcaataagctcccggatataaggggcaagtgtacttccatatcgctcctccatttcaacagacggaatgcgcccgggccacacgcggacctcgaagccacgtcccggcagggtcttatagatactgtccttggtctgtggtgtgcccaggtacagcgtatccccgtgcgtacagatagccgcaaagtctttcgaaatcatcagcagctgctcgcgctgggtttgtgttaaaccgttcttggtggtctcgatatcatctggaatcagcaggtccgcgcgcttaccctgcagggatgcagtgatacctacacaggctacgctggcggacttatccagaggtttcaggtcgcagttgacatcataaccttcgaatgaagtacggtccccacgagtagggtcagccttcaaatagcacagcagcggccaggtttccagcatacgaatgattaagttcgctacatcagacgcctgcttctctgcaccagacacaatcaggatacggcaggattggtcctgtatgagcctccagacagcgtagagcgcagctagtgtagacttagcctcaccacgctgcgcggccaccatgcgcttcctagggcccttctgcatgtactctgcaatgtcggcctgcatgtccgtgagcgtaaaaccaaggaagcgcataccgatgtatgcgaattcccgaaagtcactgagggcagccgccatcatcatggcgatatcctcgcgctcctctttgggaatactgcgcggattcgcactataaccagtaagtttctggttgagcatgcgcagtcttcgtgcagtcttcaccgataccattatacaattccttctagtaagtcctcagagtctgagccaccaactttatttagaatctcttgcttacgcgcctctctacgcgccgctagttcgtcatcgaactcgtcgcgaaggtcctgcatctcctcggaatctgcgtccgcggtgatgtcgttgtccttcaagaacttagcgataaccgatttatctgcggcggggagcggca

SEQ ID NO: 49 - DNA, 44842 bp, Unknown
  source: /note="Description of Unknown: MCoc9-1c Bacteriophage Sequence"
ctacgtaattacagatataactacaagcggccactggctgcagttggataactttacagatgggggagccgacccctacccgtggtacgcctataacttcgagctatatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatgtcggttaagcgcgagcagaagtaatggaccagccctggcttagagcgtgcaagcgcctggccgtggggcagagggcgcgctttcggtgctgcggcagggacgccgccggggtgctctacaataacccggatgcctgggaatactattgccaccgctgcaagcaagtgggcaaggagcacaagcagtaccagcgcatacagttacaggaagagccgagggtgcagccctctgcacctgcagatgcaatttgcattagccaagcgcctgcggaaacgcagagttttatttacggattcctgaccacaaagggaatcatgcctgaaatggtggaggatgcagaatggagcaaagagaaacagcggataatcttccgtgtcggaagcgctgctctgggccgtgcagtgcatgcccgacagcaaccgaagtgggtaatgtacggccagccaataccgttcgctgccgcggcacctgccgcagcaccggctgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccatggataatgaccaagcgggacactccggcgcggccatgatacgccgtgcgctacgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacctctgcatagaaaggtgtgttgctcggcgaacgatatatctccggagagcatagcggggctagttgtgcgccataagtgtgacaacccgagatgtattaatcccgagcatttagaattaggtacggtcaaggataacgtccatgactgtattgccaggggtagggctagacgtggagtttctaaaggggagcagaatgggtactccaagctaacagcgcagcaggtggactatatcaggaagacctacaggcggtacagcagggaacacggcacaccggccatagctgctagccttggtgtaagtgtgtcagcagtgcacgatgtattgaaagctaaaacttggaggctctaattggatctaatagttgtgcgtgcaatgtgcacgcagaaggtgtggaaccggctgcgagagcagatacccaagtctatgcttgcgccggacacttcgaaccttctggactgggtggggttgtactggaacacttacccggagcaccaggaggtgcaatgggatgcgatgcagagcatgctcaacctccgggcggggcacttgtcccgggaagagagggtaatcatggacgagcttatgcggggagtacaagccgtgccgcaggattctgtggtgggcattgtccagaccctgaatgagctggcctacagcggggaggtagcagcgctgacgcagcgctaccaagatggcgaggaggttgattaccttctggagatgaagcacttgcagcgcaagtacggggacggcgctgctgttcatgattcgctgcttgaatgggagagcggaagtgttgatgaaatacttgccgcgactgacgagagcggcggtcttaaactgggcgtgttcgagcaactcgctagcagcatccgaggcttacgcggcggggactgcatcgcagtggctgctcctgtggactctggtaaaactagcctgcttgctgctattgctgtggactttgctgagcagatgcagcagcagccggaagtatacggggaccgccctatcctctggttggttaacgagggcccagcgacgcgcacagtgccgagggtatatcaagcggcgctgcattggactctggcggagattaaggaccggcacagtaagcaagagttcgtgccagcctacctcaagaaagtaggcagggctgaccggattcgtgtcaaggctgcgcactcattgacgatggcgcagatatccacgctcatggaggagatgcgccccgcggtaatcatcatcgacatggtggcgaatatccgtggcggcactatggagagtgagcaccagaaccttgaggcgaaatggcaggagctgcgtatccttgggtgcgagaacgactgcgctattgtaggcactatgcaactttcactcgaaggttacaacatgctgttcccgccactcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgcttatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagcggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgaattgggatatttggtttacctacaaagacggcaaactctactggaagcacgaggttagaagtgggcgcggacgcagccacctaaactgcgccgcaggttccgaggcaggaactctgaacaaagtacatggatactggtacgttaagctgcataataagctatacaaaagaagtttgatagtatatgagatgcacaacggtccgctgcgagcaggccaccatatagaccacataaatcataacaggttagaagataccccagataacttgagggcagtgcttcctgagaagaacatgcagaacaagtccctatatagaagcaaccgcagcggctatgtaggggtgcacaggaagagaggtcgttggatagcaaccctaggaaataaacaattaggttcatttagcagtatagagcaagccgtagagtgtcgtagactggcagctgaggcggcggggtatcaccataatcacggggttgcagtatgactagcagtattatgactatagaccttgaggtcgagaataatccttactatggtagcaaggctagcccctactgccctgacaactatgtagtgcattcggcctaccgcatagaccggaccgaggatgacggcacagttaccgtagaaccgacctttgatatcagattcaacagcaagcaggaattccttgacgacgtagccggggagcatctgtggttccgcataccttctgattgctggtgcatcgtggcccacaacgcagccttcgaaattagctggtttttaacatatcagcggcaacactttgaggaattcctaaagcgcggcggccgcgtattcgacacaatgcacggggagtatattgtgtctgactttcagagtatgtacccatccttggatgaaactgcgccaaagtatggtggggagcataagattgatggggtaaaaatattgtgggaacagggtgttctgacctcgcagatagaccccattcttctcagggattacctagtcaatggtgatataaagaacacggccctgtgcttctacggccagtgtgctacgttcacccagcgcaatcagatgcagtacgtgtgggagcgtatggatgccttgctggcttgggcgtactgcgaatggttcggcctgttcgttaatatgccaattgcgcgcaagaaccaggaggagcaggagcagcgcatctgtgagattaagcaggagctgcagcagtatatcccgaaggacctaccggagactctggatttcaacttcggctcggactttcatatgtctgcactggtgtacggcgggcctatcaagtatcgcaagaaggtgccctatgaccctccccagtacgtcaaggccgactactggcaagtcggggacacttgggttgccgtggatgacgtgcccgcaccgccaggtgcaaccacgtacaagtccggtaagaacaaggggctaccaaaagtattccgccttgatacagaggaggagaaacttaagtgggaggatgacctttacttctgcccgggcctagtgaacatccaggagctgccggaagttatccgggagaagtatgcggagcgtggagagttccgacaggcgcgcaccctgcaggacggtacgccagtatacagcaccagcacagacgcaatggaggcgctggcccgccaagggttcgagttctgtaagttggtgaatgagctggcggcgcttgagaaggacaccggtacctactatttacgggaagttctggatgcaaacggagaagtcaaagagcggaagggaatgctgcagtacgtaatacccgaacgcccagatggttccggtatcatacaccaccggctgaatacttgtgccactgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcttgctacaggcaggtacggatatgcactgttaccgcctcgctttccgcgagggactgccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtacacgatgcattgtatctggacagcgccaacccggaggttggacgtgaggcgagcctgctggttaagcagtgcatggaggatgcacctaagcgtatccaccagctctggcctaactacggtatcattggcgaggtgcccttcccggcggaagctgaaatgggtacgagcatgtacagtaaggagaaggtagaatgaatattaaacctggcagtattgtggagatgctggaacttgggccggagcctatcgacccacgacatcgtgcctactttgcaccgggtacgcagcatcgcgtgatatcttacgacgttgaattcggcgaggtggagctactcaatccggacagcaactcagagaagcctggggacggcatcaccttcttcgctggagagtacaagctcatcgcggagtagtgataggtggacccttgggtggtgtagggggttagggtagcatggaaatatgctagggtcaactaaataattaaataaaattatttgttgactctggcttgattctgtgattccccgagaattaatgtgatacgagtaggaacaacacaagagaggcaaccttggctaaagtaagtctaatcaaactgtggaccaaagaagagcaccaacaaattcttggcagtttcctaaataacactgatgcagctattgcgtacaataacaaatttcgcaggggggacgtaatcgtgtctcgccagcttgtacgctactggcgcagcatcttcatggataacaagggcagcaaggccagtgccaaccgcgggctgcaggaggcgcgtaagctaatccaaccaagcccaacggacgatatcgggaatacaaaggtgccggatatgtgccaccgcattctggttgtcggggacctgcacgctccgtatacccacgtagacgcaatgccgttccttgagagcgtacgtgatgcgtactgcccggacatggtagtgcaggtgggtgacgaaaccgacgggcacgctatcagcttccacgactctgaccctaacctggatagcgcaggggtggagctggagaaagccaagctcgtactggaggagctgcatgaactattcccgaacctgctggtttgcgattccaatcacggctcactcgtatatcgccgcgctaaagctcacggtttgccagtgcaatttatcaagaagtaccgggacatcttattccctgagcatggtgctccggcgtggtcgtgggccgacgcttgggtgctcaacacaccgctggggcctgtccgtttccagcatcaagtcagcggtgatttcatgcgcaatgcatcccatgagcgcacctctctggtgttggggcatgagcatggacgcttcgaggttcagtatgctgcttcttcaacggcgctgtactttggtgcgtatgcagggtgcttgattgaccgcaagagcatggcctttgcttatggcagactcacccgcaagaaaccaatcctgggtgtgatggtaatcaccgagggttgcccgcagttaattccgatgctgctcgacgacgatggtcgttgggtagggagaagcaaatgaatgtactggattcaactgtcacccgagtagatgctcctgtatgggatgagcaataccaggtgtatcgtgtaaccctggagtatgactgctgggggcacaaatctgagacagagcggtggtataaagatgaagcctcagctcttagtttaaaagttggtgacataatcaaaacctaattaggagtgtcgatgaaaatgggaatctgttctgtactgggccttatctttgtaaccctgaaactgactggcgttatcgcctggtcctggtggtgggtactgcttccgttctacggcggtgtagctttgctgttggcaatcctggcggcaggcggtgtggcagcagccgcggctgcaggcattaaatccgcacttaagaatcgctaggccggacctgcatctgcacgtaaatatcatttaaactaaacgaggacgtaattatatgactacgaatgtactggcatccctgaacgctctggtagacgcagcaatcgaaacccaagatgtggatatgcgggaaaccgcacagggtggtgcgtacgaggacgtgctgctgccgaagggtgaatattacggttacttcaccgagtatgtggaaatcggtaagcgcctgccgaccaagggtggtaagcctaccggtaagcctgcagtggctaacgtacgtatcggcattgtagtgttcggccccaacggcgaagtgaagcgtatccgcccgtacccgatggctatcagtaactttgagcgagcaggcttcaagaagttcttcgacaagctcaactacgacaatagcattaagcatgcagcgcagcgtctgggccaggccttcaccttcccgattgatgagcacaccagcgccgcgggtaagaagtcgaacatcgtggacctgtccggtatccgcccgattcctaagttcgacccgaacaccggtgaacctattaagatgccagcgctggatgcctccgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcgccggcagccccagctgctccagtggctcctgcggctcctgtagcgcctgtagctccagcagcgcccgctgcacctcaagcctaataaaccctaatcgaaactaatacggcccctcctggggccttagaggaagcctatgaacatcatcaacatccttatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctaactctcacgcatacagggcaagccttctgggtcccgagattagtgcgcagcgttatcacttgaatcgccagtgcgccaagtcccggcgccgtgcatatgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggatatgttcctggtcggctgctcagaggcagtggcgtacctgacgcctgcgggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatataccgacaggtacagtgtggcctgcactggaggacccattcggatgggttaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcgtatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggccagggcacgacgcaaagcacgggagactgttaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggagttcttccagctcttccattcgaagagcgaggctgtttctgactcagtgaactctcctcggcactaccagttcttcccggacctggaggcaatagaggtaattgcacgcagcatgacgcaagagcagttctacggctattgtctcggtaacagattaaaatacagactctgcgccggtaacaaggatacactggagcaggacattgctaagtccgataagtacccagaactgtatgagcaacaccgaggtaagtgcattgacgcttagtgcatggtgtcatgagatgtggcagagggtagtagagcggcgcgacaaaaagcacggggaggggctattaaatgaagacagtaatctttgatttggacggtacactagctgatggcgcgcaccgcttgcacttgctgcctactgtggatttgtatctgactgacagttggaatgagttcaaccgggcctcgaagtatgatagccctatccacagcactattgaagtgtgcaacatcatggtgcgagcagggttgcgagttattatcttgacggggcgctctgatatagtacgagcggaaacagaggcctggctggagcggaacttcgttatgtactccgagctggttatgaggccgcacagtgacaaccgaaaggatgtcattatcaaagaggagttcctgcgcaaccaagtggggttagaaaacattgtggcggcttgggatgacagccccgcggtgattgagcatttccgcggactgggtattaccacttacgctgtatgcgactatggtgcagcagcacatcgaacagacttaaaatcccacggggtggaggaattagcatgagtgcagtaggtacaggcatgaagtatgacgcagacaaacctcgaatggacttgctactggacgggtgcccgaatgcgttgctgcgtatcagtgatgtgctgaccttcggggcccagaagtatgcggcacacagttggcacacggtagccgaaggtaagtcccgatacaaggccgcgctactgcggcacctcacggcacatgctctgggggaaacactggactcggagagcgggttgccgcacctggcgcatgccgcttgttgtgcattatttattctagaactggagcagatggatagtgcggccgagtgagtggtgccacgggatgtggcagaaagcagtagagcggggcgacgaaagctccgctaaagactacctggagatgtataatctctgggtcagccgcaatcagtagttagaagtaccggacataaccaaggagactaagcgcctatgattagcgccctgaatacggttgtagtaccagaggaagcactggtgaaacgccagctggagcttgaagagacctataagattcgcggaatcgagcgggcacgtaagctgattacggacgcattgcagaatggtgggattatgaacctgccgatgacgcagcgtatgctcacctctgcatatgaggtggctgctgcagctatcgatgagatgcgaaatgtcaaagccccaggcattggtgggaagtaccgtcggttcctgcgcttaatccccttggatgtcctgaccaccctgagcctgtgcacaatgtttgaggcgttcagcgtcgcccctggcgagtccgccagtcgccgtcagactgcacaggcggtaatgtccgcactgggcagaaacgtacagtcagagctactggctctgcagttacgcaacgtagccccagcgtacatggaccgagtatatgagtatctcacagagcgccgtacgaagtcccctacgcacatcctgcgtacgctccgtgccagtgccgagaacgtacactatgggcacgagccttggaccaatgcccagaacatctccgtagggcgtctgctgtgtgccgcagtgtttgagacgggactgttccagtggaagaactgtagcgggaatctgagcatgctctatccggctgacgacgttatggaggccttccagaaactggtagagtccgctgataccgtaaccatgaagccacctatgctggtaccgccggtgcagcacactactctgtgggatggtggatatctcacccctatcgacaatcgcggcacctatcataattctcatatcgaccgcgcacgtctccgtgaagtagcggaagcatttaaatccgcggatggcatcaaaaaggcgcttaataaggcacaggaaaccccgtaccgtattaataagcgcatactggaactggtgcaagaagcacgggccctgggtgttgggataggtatgcctcgctcagtaccggagcctaaaccggagtggtatctggacggggttcctaaagagaactacacagaggaagagcttgaccgcttcggtgagtggaagacgcgtatgtccctgtggtacagtgctgaccgtaagcgcgtatcgcaactacgcagccttctgactacgttggagatggcagaggaattcaaagatgagaaagccctgtacttcccgacttgtgtggactggcgctaccgcctgtacttcaagtcctcgctgcacccccaaggttctgatttgcagaaagccctacttgaattcggacgtggtaagccgctgggggagcgtggcctattttggctcaaagtgcacgtcgctacatgctttggttatgacaaaaccctatccgaagaccgtgcagcttgggctgatgcgaactttgcagagattgagcaactcacaatctctccgtttgattgccctgcttttgccaaggcggactccccctggtgtttcttggccgccgctatcgacctggttaatgctattcgttctggatgcccagaagagtatattagccgaatcccagtagctatggacgctacgaactcaggtgggcagcacctctcagcgctcctgagagaccctgtgggcggtcgtctgacgaacctgtactgggagggtaacgacaagaaagcggacctgtatatggatgtgaagcgccgtacggacgagaaggtgatactggacctggacaaggaggatttcgttatccagagcacttactggagagagaacgaaatcacccgcagcatgaccaagcgccccagtatgacctacttctacagcgccacggtgcgcagctgcagtgactacatctttgaaggcgcttgcgctgaggggtatgaaggtaccgacactaacagtctatggaatctgtcgtgctacctagccccgcgtatgcgcgccgctatagaggaggcaaaccctgctgctgcggcagttatgtcgtacttgcagaacctcgctaggcgtgtaccggcaagccagcacctgcagtggtatacgccgctgggcgggctcgtaatgaaccgctacacacagcgtgaagaagtgcgggtacgaattgactgtatgaacctcacaatcatgcgcgtgcataatcgggatttcaagacctgtaacaagcgcaaggcagcctcggggattgccccgaactttgtgcacagcctggatagtacgcacttgatgatggttctatgtgccgccgagggtctggacattgtgccgattcacgactccctggctacacacgcagccgatgttgatactatgcaccggcacatccgcgagcagtttgtgcgtctctacgaagagcatgaccttcttggggatatcacccgcgcggcggcagcagctggtgcggacttgacggacctggatatgccagaggttggtactctggacatccggcaggtactggaatcacctttcttcttctgctgagggtatggtatgcgagtactagtaactggtgggcgagattacacagactacttagcactaaagaccgcaatggatatgctgccaaacaaaccatctgtagtgatacatggaaatgccagaggggcggacgcactggcagacaggtgggccctggaatccggtatttttgttctgcgtatgcctgccctgtgggatgtgcagggtaaatctgcaggtatgcgcaggaacgccgccatgatatccttggcctttccagaatactgcgtcgcctttcctggtggaaggggtaccgctggtatggttgagttatgtagaaaggccggtataccagtttgggtaccctactaaaatttaatgttaccggagtaggaatgaagttaaaacacactggtaaaacttccgattacactctcaaggttctgtataagtctgacgatattacagacgcagtgaagcaactgcacgaactgggccacggcattagtcggggcctggctcctgagcagcactactggagggtgttgggaagtatactgggtaaacagtatatactaggagtctatgactcccaaggcgacttagtcggtgccgtcagctactacccagaggctgtagaggactgtcattacgtagagcctgtgctatatacagacttcttcgtattgaaaccggacaacggcgcggcagtgtctgtgattatgcagggcctgcacgcaatagccaagtgcatgcgcgctgggcgtatcgccattagccggagcacgtctagtaacacgtacaaaacaacttatcatttagtgaggtcagaatgagtggtggtttaggtaaactgttaggcaaggccacggatatgctcggccttactgacaacgcaggattagaggcgcagcagcgcttggcagagcaacaggccagcgcagctaaacaacaggctgccttagaggctaatagcgccgcagataacattgctgagattgaccccgcaggggctgcctctgcatctgcagatgcaattacgtctgagcagaagaaacggcgacaagcagggcagagcaatcctctgggcctgtaagggggtagcttggaacaaaaagcaacattagcagaactctttaagaaggaccaggacgcgggcgtcttggatgcctctgagaagttcgcgcagtggacgctcagcacgatctttacccgggacgattccctggacggtagacgcaggccgctggagcgagactatcagagcaccggcgcgcagctggtcaacactgcagccactaagattgtaggggccctgttcccacagggcaccagcttcttccggttctccaagagttcggacctggacgagttcattagttcgctgggcagcgcagctacagcagaatctaagctggccgaggtcgagaacacggcgtcacagaaagtatttgagaaagacggttatgctgcgaagttgcaagctgtgaagctgctgctggttacaggtaacgcgttggagtatattgatgagcggacaggtaaatccatcgtctactcagtccgtaactttaccgttcgaagggatggcagcgggaacgtcctgcgactcattatcagagagcgcgcaagcgtccaggacctgccagaagatttccgcggcaccttctaccgtgacaaagacccatacggcgacgttgatatctacactgccgcttgtcgcaaggttaagcggacagaggaaggcgtagaagtagtaagctacgaggtgtaccaagaagcagacgggcaccgtatcggagacagcagcacctatccagagctggagcttccttacaacgtgctggtgtggaaccttgttagcggcgaacactatgggcgcggcttggtagaggactacgccggggacttcgcccgattatcagtactgtcggaagcgttgactaactacgaggttgagtctgcgaggttaatcccgctgattgacgcaagctctgggttagacgtggacgagttctcaacgtcggagacgggtgaggctgtgcaggtgggtggtggcggttccaacgggaacagcaaatcccccgtcactgcttacgagggcggctctgcccagaagattcagtggattgccagcaacatccagatgctcgaacagaaactgtcacgtgcgttcatgtacaccggtaactcccggcagggcgagcgcgtcacggcctacgagattcgccagaatgccaaggaggcggaagccgctatgggcggcgggttcagtattctgagcgacacatggctgcgtaagctggcgtacctgtacaccgcactggtgtatcctcgctttaagctgtacctcagcgaaggtgtagtgagcatcaacgttacggtgggcacctctgcactcgctaaagccgcggcagcggacaagctgttagaggcggcgcaatccatgcagctggctatcccggtgcttgagcagattactccgcgcttcaacaaagatgcgtgcgtagattggtacttcgacgcctacggtatcgttagcgagccgttcatgtacaccgaagagcagctgcagcagaagcaacaggttcaggatgcgtctgccgatacgtccgcaggtctagcacaggaccaactccagggcttgacagcagcagacccgacagtagcaggtaagcagctgggcttattaccaagttaacaacagaggcatagatggataacgtagaaaacggtcagaacgtagaaactacacaggtagagaaccaaggcggccctaagattccgggcctaggtgctccccttagcgccccgaacaatcaaggcgtgcaggatgcacagacccctacccagcagcaacagggcaaagattcccctgaccctgctaagattcctctggatatcgaagccctaaaagcggccctggataagggtggcgatagcgctaaagagcagccccaggagctggctaagacaggcaacccgacgattgacgccggtgtagctatgttgcagaaagtctctgggttaactgactctgatatggtgcgggcacttggtaaggccctggagtatcaggaccctaacctaatcgatacggccttcattaaggaacgtttcggagagcacgctgcttatgcagagttgctggctaaagcgtacctggaagaccaggttggtcaagccaccaaggcagtacaggaagcttacgatatcgtgggcggtaaggagaactgggaggtagcagcgcagctgtttaattccaaggcccctgaacctcttcgtaacgcggctcgtgcactcgctaactcgggtgagctcaagcaggccgctgagttggtggcaagcttctgccgggatatgggtcttatcaagacacagaacccaatggtacgcggtgtagccagcaacaatgcactatctgctgcggaattccgcgcagaatataccaaactccgtcaggaagcgggcaaccgtagcttggcgtctccacagttcagtcaacgttataacgatttgctcgcacgccgtgaagctggtaagcgcgtaggtctttaattttatttataaaggaaactaaagcatggccaacactatttataatggcaacctgacccgggcccactggggcggcgcggcgtctgacgtagatattcacctggaagtgtaccagaacgaagtggatacccgcttccagtaccaggctctgttcctgggcctctccagccagcgctctatcagcggttccaacacctaccgtattgaccgcctgaacacctcctcggtgaagggtcgtcgctctggtgaggcgctggatagcaccccggtccgtaacgataagatgattatcgtggtggatacggtgctgtatatccgtaacccgattgactaccaggacgactggaccggtccggacttcctgaccgagatgggccagaacaacggctccgagttcgcagagacattcgaccaggcgcacctgattcagctaatcaagggccgttcctgggttgctccggcgcacctgaaaccggcgttcaacgacggtattgaggtgggcgctgctatcctggttcctggcaccactaccgccacacagctgacccaggctgagatggaggctaacgccatgaacatcaacctggcccacaaggctggtattgatgaactcatcaagcgcaagaccccgctgtcggacatgattaccctggtggatgtcgatacctattcgcgtctgctggagcatccgaagctcctgaacctggaatttggcgcatccaacaacgacggttacaaagaccgccgtgtagttaagatgaacggcgtgcctgtggttgagtgcaccgagttcccaaccgaggccggtacgcacccgctgggtagcgcctacaccgtcacctctgacgatgcgctgtgccgcatggtgactttcagcaagtccaagaccctggtgactgttgaggctaagccgttcacctcccgtatctgggacgatgagcgtgagttcagcaacgtgctggactgctacgcgatgtacaacatcggcctgcgtcgtccggacaccgctgcagtgaccaagttcaccttcaccaccaagtcctaattggaggttcaatggcagtaatcgctacgttcggtctggagactctccaggccaatgcagctcagcgggaggcggttaaggccgccaccgatgtagctaagaacatccaggtggcttcggttgaatctggccgcaaggctaccaagaaaacccgtaaggcggctgacgtagccgctgatactgcggaagagtaatacgcgcccctggtgccttcgggtgccaggggctttttttttttgtccctgtcttaaaggtccaaggggtctttaatagaggaacaaatatgagagaattagacgctgttaacctgacgctggaagcccttggggagtctcgcgttatggacatcaacactagtaaccctagcgctggattagctcgctctgcactcgcacgtaaccgtcgtgggttactcagcacgggattctggtttaacgtggtagagcgtgaagttacgcccaccaccgacggcctgattaaggtgccatggaaccagctggctgtatatgacgcctgctcagaatccaagtacggggtacgtgacgggaatctatacgacctggtagagcagaaccaatacttcgatgcacctgtgcgtattcgtgtggtcctggatttggcctttgaggacctgccggagcacgccgctatgtgggtggctaactacaccactgcgcaggtatacttaaacgacctgggtggcgacagcaactacgctaattacgcacaggaagctgagcggtacaagagcatggtgctgcgcgagcatctgcgcaatcagaagttcagcaccagcaagacccgctttgcacgcagaatccgccgtgctcgttttatggtttaaggagagtatatggcccagtccctagagggtaccattcagagcctgctgcagggcgtctcccagcaggttccaagagagcgccagcccgggcaactgggggcgcagctgaatatgctcagcgacccggtttcaggtatccgccgtaggccgccgggtgagattgtctgggaaagcacaatcgatagccctgggcttgattccctgttcactgaatacgtagagcgtgggactgacggtaggcacctgctgattaacaccagcaacggtaactggtggttgctggctaagaatggaaagaccatccttaattccggcaatgacccgtactttgttaccaccgtaggccagacctctttgcagaccgcaagcattgccgggctgacttatatcctgaatacggagatggccccgaacacaaccgtggacaatactgggcgcatcgaccccagcaccaccgggttcttctacgttaaatccgcagcattccagaaacgctggaacgtcaccgttacctctgcgggggtggactacactggggactacaccgcaccggctgctggcagcacgagcggtaacgctgaggaggtatcaggtgcctacgttgcccagcagctgcgggactctcttgtagcgaacgggctgccctccgggaacgtgagcgtacgtggtgcgtacctgttcttctacgggttgagcaactgcgtggtatcctctgacgcgggtgatacttatgccgtggtatccaaccagtcacgtgtagaccaggagcaggaccttcctgcacagctcccggcgcaagctgacggggcaatgtgccgtgtaggtacagcctcgtctgagacggcgtggtatcagttcagctacagcacccgcacctggtccgaggtgggggcgtacgatagcatcaccaagattacgaacatgcccagagagctcgccgcggatgacaacatcattgcgcgggattgggaggggcgcttagctggtaacgacgataacaacagtaatccaggattcgtcgagaatggctacatcactggtattgcagctttccagggccgcctggtcctgcttagtggtagctctgtggatatgtccgcctcgggcctgtatcagcgattctaccgctctactgtgacgtcactgctggatacggaccgtatcagcattagctctgcgtctgcccaggattctgtgtaccgcaccgctgtgcagttcaaccgggacttggtcctatttgctaacagcatgcaggcggttgtgccgggttcggcagtacttacgccaactaacgcaagcattagtattaccagcacctacgattgtgacagccgtgtgactccggtaatggcggggcagacagtaatctacccgaacaagcgcaacgacagctacgcgggtatattggagctaatcccatcaccttacaccgcggcacagtacactacgcaggatgccacggtgcacctacctcggtatatccccggtagggtgttgcagatgcaaaactccagcgtcaccaatatggccttctcgcgcatgtctggagagcgtaacagcctgctggtctacgagttcatgtggggcggaagtgacggcgctaagatgcaggcggcgtggcataagtggtcgttcccgtacccaatcctgagcgtacaggcgctggaggatgaggtgttcttgtacatgcaagggcccagtcccagcaacaagcttttgattgtgtctatggacccgcgcgaaggttatcagctgggctcagagtaccgcgaagcctactcggatttgcagaagcaagttcaagtgcaggacggggtgttcactgtcccgtcggtattgcgcccggttgggtgggcggacaactacaaggaagagcttatcctaacgtacctacccagcaaccctatggggcctactgaggttggcatcaaggagattgctggggagaacaccctacgggttgtgcgcggtgtacctgatggcacttatgtaatcgggagacgttaccgtagtacgttcacgctaactacgcctattctacgggaccagaatgacaagctcgtgggaagtgggcatgtgcgcctgctgcgcctggacgtggcagtacgtaactccgggcacttcgacgtacaggtactagacaccccgcgggacgtcaattggggtggggaactgactggtatcttgatgaactcaaaggagctgacgcttgggcaggccctgcgtatggacctggctacgattaccgtaccatgccgcactaacgcagacacaaccgaggtgtcactatttactgacggttctatggaactgaacgtgttggatatatcgtacatcctgcgctacaaccaacgcagacggaggatttaatatgtggtggatggttgcggccatggccgctaagaccgttctggggcagggtgctcagattgaagtgtccaaggccaggaacaaggctgtgattcaacagacagccaaacagctaaacgacatcgcgctacagcgcgcccagtccagggaccggactgaggtgtctctgtttaacattcagcagcagaagctgcaggcacagagccaagtaggactgcaggcagcagcttccggcactatgggagcctctgttaaagacgcagtagccacggtgaacactgtagccgggcggcaagaggccagcgtgcgtgaccagcaggcaactcaggaagagggcttccgtctaatgacagataaggccgtggatagcggcctggctaacatggacatggaggacccctacgataacatgtttaactcgttgttgagtgtcggggcatctgccgttgggcagtacgctggtaacgctgcgtcgtctactgactctggtagctcttcgcctggtagcggagcgtcagctacgcagagcatggcatcctcctatgacttatgggggagtaagggcaatagcccagttcacacctggtaaattaggaggaatactaaatgcctgtgattcaacccagtagacaggggttaaatatcggtggcgtgcaactgcaatccaacgatgttagcttgccgtcaacggtaagtgaagtatctgttgatacctccaaagcaaaacgcctagccgccctgtctggattcgtgcaggacttcggcgtaggtttcgacgcggcagtaaaagaaaacgccgcagccgccaccgtgcgcggcgctatggatgctcagggcgcagtagatgcaatggcctccaaggacgaggctgtacagaagcaaaacatcttcgtgcgcgaagcctatcaggacggctacgtatccgccgcagcgtacgacactctagctaagtggcgcacagacagcatagcccgggctaagaaagctgccgaggcagggctgactgacgaggaattccagcagcaggagcaagagcacgtacagtcaatggcagacaagctcggggtgtatctcccggatatgtccaagcagtctgctacgagtatactgcagcagctccgcgctaccagcatggctaactatacagccttccagaaaggacgtgctgcgttcgccctggcccaggctgaccgtgccctagaccgtggactgagtgcgtccagcgatgagttctatcagcgtctgcaggcaggacagggtgccgccgcgcagatgtctatcaagaccggattagacagtatcctggctgccgagcacttggacaagaacaagaagctggacagagccaagcagtatctggttagcgtagcgcagcagacgcaggacccactggtaattaaccagctgcaggaaatggccaccaaggaactcggcgtcaactccgtggatgtcaacgcggcactgtatcaggagttcaagcgcgcaggtgctcagattgagacacaggcccgtttcgaaatctctgatgcaatacagtctcttgaggggcagacacctgagcagcaagaacagactatgcagcgtattcgtagtcgtgtcattgagctgtcggcatctgatgtacttagcgccgggaccagcatggagttctggaacaaagcccagaccattcgagagaaggcagcagacgcccaagcattgcgcacagcaattactgggaatatgccaagctctactctggcgggcatgttcaaaggggacttagataaggcacgtactcagctgctcaagagctttccggatacccccgaagggaacctgcagctgctggcatacggaagcaacagcaaggatgcgtgggccgtaaacgaggcgcacaagcgtatgtcttcggatatggcacgtacgctgactacgctggaccagctcggtgaagatggcgaggtttcccgcgagaacgtcaatagcatcaacttgtgggcacaggcttatagcaccagtacggacttagggaagatggcgctgctgtctgaggtcccatctgagtggcgtggagtggtgcagaaagctgttacgcaaaacccaaataatgccagtaacactatcttggacgatcttcgccgccaggctcgtaataaggcgagtgggcgctacagcaatatccaaagtaaccccacggacaagatggtagacccaagcggcacggctaactggttcagcttcttcggggatgcagacgcacagcgccaggaagcgcgagctgctatggaagatgagtaccgttatgtgtataaccacaatccggaatcccttgtagggaaggacgctgacgacatcaatacgatgctaaaaggcaatatccaatcccgtaagctggagctggacattgccggggcacctaggcatgtgtatctgcccgctggcacctctatgcaatctatcatgggtgattataagggcgaccaagagcagttcaaggcctccctgcagcagcatatacagaaccaggttcagtatatgtcagaccccagcaacatagagcgtgtagtagtgcaggccgccaccgctggcaacgcaggtcagaacatgaccgtaaccgtgttcgacaagaagggcaccttccagacgatgtctgtgaaccttcgagacgttcagacgactgcgcaggctgcgtatgactcagcactggctggagagatgaagattggaagcgagcaagtaggtgtacgtcctgccaccttctacgaccacgacaacgggcgtgccgtcagcgtacaagtaaatggccgtaactcggtagggctggaaccatcactgtttagtgacatcctagccactactatgaagttcgaagggttccgagaaggcaagggtaagggtagcgtaggcttcggcctgcacgttaactctggcatgcccgtcccccagaaagttaccattgacgacggtatcagtatcctcaaatcctcactggaggagcagtacataccgaacgtgcagaagcaactcaagggacagggtttgactgcctccgacgaggcgttaaaggttatggtggacctgaactatcacggtggtaacggtagctccggccccgtagcagaggcgatggcacaggtacgcaaggctgctaagtccccggtgggggcgtatcagtaccctgtatctgaggcccagggtagggcttggcaagcgctgcggaataccccggcgtacaagcaggcccaacctgggcgtaagaagtacctggaacaaaacctacgtgattggctcttcgaagcaacgcactaaccagaggcccttcggggcctccccttatcaaaattcttttaggagatattatggctcagtttctgaaccaagaaccgaatccacaggaaaaggattctgctaagggcgcaacacttaaatctgcgcctgagcgcgtagattggaacgatgccggggacaacggtctgaacgcactggggcgtgcctcattactggcacaggccaagaccccagctactacagccgcagagagctttgcctcgggtatgggcaacagcatcatcgccgcagctatacgcaaggcctctgccccggcatttgaccgagacccgaactttaatgccaagcagaccctgagtagcgatactcgggctaagctgtacgccccaaatcaggaagagattgagtacctgcatgactccgtgtcagtagaagattacaactaccgcatgcagcagatgcttgagcagcgtgaccgtgaccgcttaatggctgacaacacagtagctgggttcgcgggtatgttggtaggggattccccgttcatcctggccccgatgtctgctgctggtattgctggccgtgcgggcttagctgcacgtaccgctatacgcgctgctgatgtaggtactgcattctatgcacaggaccaactggggcagtctgctgcggtaactgcactgatagcgggcgtagctgggttagaccagctctgggatatgtctagggctgctaaagctgccgccaaggctcgtactgggcgtgagcctatgttcgacccagaagcgcctacaactcgtacagctagggatgctaatgttaccggagtaggagagggagaggaaattctcactaagacactggatgaaagcatccaagtatcgagaaacaataccgcctccgtgaacatgaaagcacagcacgtagttcagttcttgaggaagtctgagcacttgacagcaggacagaaggctattctggacacgctgggcgatgctgtaaatgacattgattttaaactagtagcaggctccgcaaaccgcagccgctacacttatgcacaacaagatttagctaagcggggagagatatccctgcgcgcgcctaagcaagctaacggcagcacctggactacagtcggtgatgcgctgcgcgctatggatgcagatacaagcaaggtggccgtgcacgaactgattcatgccgctactgcgcgcgctattgacagtaatcccgagattgctaaacgcctggaggaagtgcgcgctgttattgcggctgattccaccctgacaccgcgtatgcgatattacgcaagtaatgtgcacgagatgctggcaggcttaggcgacagccctgagtgggttgagcacctggcacgtacgcagtctcccaccggcaatagcatgctccgccaactgggtgagtacatcatgaacgctctgggcatcaaggccaaaggctctgccttggaggatgtactggatgcgtatgaggatgcagttaagtggacagctaaggattatgcagaccaagcccagagcttccgtagtgaggctttccaggacctggcgggcagcactaccctcaacgaggctaagcgtgcacaagctatgctggacggcgctaagaagaagctctccactatgtttgcactgtacgataatatcgcccaaggcaacgaagacttggctaaactgctagtgtcggatgcgtctgcagtaggcggccgtcgcccgtcagtggtagactacaagcgtaacctcactttggagatggatgcccgcgccagcgtagttgaagatgctatcctaggcgcgttgaaggataagggtgtaggggtgctctcacgcttcttccatcggagtaatttccgcgctgagcgggctgcgctggaggaccgcctgagcaagtacctggatgctgcctacagtgctgacgtaaacggccgcgctgtgccggtgccggatgcagagattgctccgctggttgatgcttaccgccgctctggctgggctagcaagtggcacgagcatatgctcaatgccggtctagtggatgatggtgcgttggttaaatccgactactacttcccgcgccagtacagctacgacaagatgcgccaaggtatcgcgcagggtaacactctggacgactaccgagccctgttccgggccgccctgcgggacgtgtaccctagcatggagtcagaggtagtgcagcgtgttgccaaggagatggttgacggtatctacaacggccgtgcgggacagtctggccctatgtggaagcagctgattaacggcatgggtaacgatgaggtcgtcatggctatgcgcagcgctggtgtagaagagtctgcaatccagagcttcctggctggtaacgtacgagaatcaggcagcacatcccctgcgcggaacctgcgtcagcgtactcggttcaacatggacaaagagtacctgattaacggaaagagcatgcgtatgcaggacctgatggatactgacgtagccaaggttatgcacgggtacactaaccgtatgtctgggcgtgtcggtatggcctatgcaggcgtacaggacctggggcagctcgctaagatgattgacgagtccaagcacgtactggcagattctgctaagtgggagaagaccgtcaatgacaccatcgactttatcctgggtggggcacctgctgacgctgggcagcttccggacttgctgcgcgcagccgggaacatggctaacgccactatgctcaagaactccggcctgtatcagctgaccgacactgcgttggctatgaaggagtttggtatggcccgtgtgctgcgcagtatgcgagaccaaccttggttcaaggaaggtgccgtagctatcaagactccggatatggctgcccgcctagacactgtgctgaggggaaatatccagaaggagatgcgcttccgctggctgaatacgtacgctgacgataacctggacctgacccgtcaggcctcctggttcaacgtcactcagaacgttgggcaggctgcacgccacgtcaacggtatgagcatggtgcatcggctgcaggttaacctgaactccggtattgtggcggacgagcttacgcagatgttcaagggtgatgctgaggcgtttaagcgtctggagcgtttcgggcttacccgagatgttgcggaccgcgctatcgctgccaataaggctaacccgggcgccatgttccagccggacctgcagatgcaagttgaggttgtaggggcgcgtatgatggactacctggtacagcagattcgtactggagagacctcacactttgcacagttcaaccctatcggcaaagtcatcgtagggtaccagagcttcgcactggctgccactaacaagattctgcgtagagagctgaacgatgctgggtggattggtgtagcccacattatggcataccagttcccgttgatgctgctggctactatggctaagcatggcatggatgggaaggacgtagacacccagaaactcatcagtgagtccgtaacgggtatgagtgccatcggcggggtatccttactgcaggatatcttcctgggggattctccccgccactcgttggcgtctatgggttatgtcacagggctgctcggggccgtacaggacctggctactggtaatatggacatcaagaccttcactaagcaggtaccgttaatccaggaattcgcacctacgcgagctatcatcaataacttcggagacgattaatatggcgttcagctggcaagaacaaatcaagccagctggtacccaggatatccagtgcgatattgagtatttggacaagtcctatattcatgtatacctagacggagaggaaaccactgggtacacctggaccagctctactaatatcaggctgaacacagccttaacggcggacactacggtgctgctcattcgcaagactgagcgggagtacttgtatattgagttcgccagcggctctccgttcattgaggtgaacgtagattctcaaaacacgcaattcttacacctagcccaagagcttgtggaaggccgagctatccccggattctacgggaatataagcatgaacgggtaccgcatcactaacgtagcggacccagaagacctgcaggatgtggcaaccaagaactatgtagatactggtgatgcggcactaggtgtccgtattgatgccgaagccgccgcgcgcaaagccgcagacgatgcgctcgatgttcgtactaccaacctagagcagacctttatctcgggggagcctacggtaagctatccctggtatactatactggccgaggctactgacgaagttacgcctggattgtctttcacaaaggctatagtgtacgtacaaggcgtaaatcagattccgggctacagttttgaggtggtggataacactctactgtttgcagaggtacttccagctggtactctagtgtctgccagattggggtatgatgcagagctttcggaaacttacgctacagctacggcattaggggaagaggcgtcagccagggctaatgccgatgcacagataattctggattaccaagcagcagtagcgaccaaggcagcaaagggtgctaactctgatatcacgagcttaagtggattaactacaccgctgagtaaagctcaaggcggtactggcaacactactggtgccgctgattcagctgcgaagctagccacagcaaggactttggtggtagatttgacatccactacaccggccagttttgatggttctggcaatgccaccttaggggcaactggcagccttccaattacaaaggggggcaccggagctggcgatgccgccactgctaggactaacctgggagcagcggcgtccggcagcaacggagacatcaccgcattaacaggattgagtgggggtatatccggccgcactgacggtgcagctgcagccgccggtgtagtgggggaagtactgagtgccgcaacctctgcagccgtaagtgttaccagcggcaccccattgaacgttctgtccttgagcctgccggcgggggagtacgagcttgagagtgccctgttagtcactaatagcggcaacgttactgctctcagttttggagttagtagcaccagtgcagtgttacctggaaactggtacgacttatattctataaccaccacgttagcagctgggaattcttccagacagggtatgtcgcgccgtctactgttgagtgcaacaaccactgtatacctggtagcgcaggccacctttaccgggacctgcactgcccagggttatattagagctatgagggtaagataatggcaggggcggctaaacgcagtcgcctctcggagctgcaccgcatgttcactgaggccttgattgaagaaatcaagcagtccaaggaagacgaggtgccgctccccgccgcagataaatcggttatcgctaagttcttgaaggacaacgacatcaccgcggacgcagattccgaggagatgcaggaccttcgcgacgagttcgatgacgaactagcggcgcgtagagaggcgcgtaagcaagagattctaaataaagttggtggctcagactctgaggacttactagaaggaattgtataatggtatcggtgaagactgcacgaagactgcgcatgctcaaccagaaacttactggttatagtgcgaatccgcgcagtattcccaaagaggagcgcgaggatatcgccatgatgatggcggctgccctcagtgactttcgggaattcgcatacatcggtatgcgcttccttggttttacgctcacggacatgcaggccgacattgcagagtacatgcagaagggccctaggaagcgcatggtggccgcgcagcgtggtgaggctaagtctacactagctgcgctctacgctgtctggaggctcatacaggaccaatcctgccgtatcctgattgtgtctggtgcagagaagcaggcgtctgatgtagcgaacttaatcattcgtatgctggaaacctggccgctgctgtgctatttgaaggctgaccctactcgtggggaccgtacttcattcgaaggttatgatgtcaactgcgacctgaaacctctggataagtccgccagcgtagcctgtgtaggtatcactgcatccctgcagggtaagcgcgcggacctgctgattccagatgatatcgagaccaccaagaacggtttaacacaaacccagcgcgagcagctgctgatgatttcgaaagactttgcggctatctgtacgcacggggatacgctgtacctgggcacaccacagaccaaggacagtatctataagaccctgccgggacgtggcttcgaggtccgcgtgtggcccgggcgcattccgtctgttgaaatggaggagcgatatggaagtacacttgccccttatatccgggagcttattgagcgcggctataaacgcaccggcttcggcgtcgacgggacgttaggcgagagcactgacaccgggcgctatgacgaggatgcgctgattgagaaggagctggacttcggtccggaaggcttccagctgcagtacatgcttgacaccaccctgtccgaccaaatgcgtacgcgtatcaagctttcggatatgctggtttactccggtagccaggattcctccccggagacattctcctacattgcggaccgccggtacctgtaccagcacgagcatgaggggattatgggccagcagatgtacttcccggcattctacggggacatgcacctgccgtaccagcataaggtgctggtagtagacccggctggttgtggcggagacgaagtgtcctacgctgctggcggcgctgcgaactcgtacattcacctattctccgtaggcggcttccaaggaggtatcagcgaagagaacattgataaactgattgacctgtgcgtagagctagacatcccggatatggtggtggagagcaacatggggcatggcaccgtgtctatgcttatcctgaaccggttacgggagcgacgtctcgccggtatcggtgtacgggatctgaacaactccactcagaaagagcgtcgtatcatcgacacaatcagcccagttactcgtcgtcaccgcctggtagtgcatgagcgtgctattcacgatgatattagtacctgtatggcgtattcccgcgacaggcgttggctgtactctgcgttcgcgcagttgtctggcattacgtacgaccgtggtagtctggctaaggatgaccgcgctgacgcaatcgccatgatggtggctacgctgaacgggcacctggtggaagatgagaaagtggtggctgagcgtgagtctgagaagatggctcgggccttcattgataacccgctggattgggcacagagcaaagtgtctaagggccttcggggtgtagctgcacggttacagaaccggggcagaggtaaacaacatagaggaagaagataatggcatttgcagaagcaacactggcacagcgccaggcagtacgtaatgcagcagtagcacttgataaagcaacaaccttagcacatgatactggcccattagatactctgggtccggatgtagatgcagccggggctgtagcagtagcggcactctctgctgcaggggcctctgacggcggcactgtagtggtggtcagtaatggtgcggaagtaaccgtacccattacgttcaccaccgctcgggaggcagaggctactgccaccgtagcagcgactatcactgtagaagatggtgtaatcacagcaatctctattgagtaaggagtaatactatggcaattgcaaaagcaacctcagcgcaacagcaggagctgctgcgtcagctgaacattctcggtaaggacctgtatgctatccttacgcagccgcagaacgtagcccagactggagccgccttcgacaccaagattgctgcgcttgaagccgcagtagccgcagtgaaggctgctagctaatgcgtaaactggtcgctgggttactgctcgcggttactctgactggttgctcggcgacctctgcactcaccggcttagttggttctaagccggatgtgtctgctcaggttggtgccgaaaacaccaagcaaaccgttggcctgaacaacaaggtggacgccagcaccaccaacaaaaccgatgtatcagattctaacgtaggcaccctggacacgtccagtaagaagcaggtacaaactattagcaccgggacaatccaggcagaacgcctgcaggtggttaacaatgatagttacagtcttatcctcgccggattagctggggccagcattcccctggtcttcctagtggtcattctggtgattcgtaagctattcaggaagaaggggcagcaggatgattaaggtaggagacatggttgggtcggacctcgctacccgggcaggtgcagcagttaccggcgctacggtatcaggaggttggttggcagagttaatgagctggaactggagcactatcagcttcatcactgcgacggtgtgcgcagtgctaaccctggcgtggaatgcgtattacaagcgacgtacattcaagctcctagaggagcaggcacgtaaggggactattaaatatgagtttaaggactaaggttattgcggccctcacgggggccactatgctcggcggtgccattaccggcgtagtccagcacaacgagggcctgagccttaccgcctacaaggatagcgccggtgtccctacaatctgctatggcgagaccaagggcgttaaaatgggccagagagccacgctgagcgattgtcagaagcaactgatacaatcagcaggggaacacgcaaaggcccttgacgggcttcctatgcagctctctgacgtagccctggttgggtctatagacttcatttataacgtaggtgtagctggcttcaatggcagtgccgtgaagcggcatctcaagagccttgattatgcggcagccgggaaggctgtactggactggcgttatattagcaagtaccagcagaagtccccgggcaccggttgggtgtataagggcggcaaccgctggacctttgactgctcccagtatattaacgggcagcgcaatagagtgtgctggggcctatgggagcgcaggcagtggcagagcaaagccatcgggaatcagtataagaacgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgaccggattcttccggcaactacgcagcagctattgagcgggtttccgctaaaggtgtaaaggtgctgcgcgtacctgtggggtcttattatgttggggactgccacctaactaaccctatgctgtttataggtgatggcctagagggcgtcaacccgcttggggctgtattcattaaacctagcacagctgctaagatgttctactttgacggtacaagtacacgtggaactgggggcggattcctcagaatgcgactgcaaggggctgtcagcagtgattcgggacttatggttgaagtcacctcctggagctattttggggcggagaactctgcttttaataacttagcgggatctgcgctggtgttgcgtgactgtatggagagtcacatctcaggaaacttattccgcaggatgggtgcctctaacggcagtgttatactcctaggggattacataggtattcctaataataacgtcaataacctgcacattcagaataacacattcgggttgtgctctggtgcgtggattaagagtacagcaaacagtaacccggacctggtgtggattacggataataagtttgagtgggatagtgtaccgtacggagctaacacaaccacgcagcacgtactggactttggacagctgtcacgctcttggattacccgtaatggttttgcgcacttccgcccagactccgaccataacctgtatgccgggtgtattcgtattaggtctggagctgttggtcctattgttatttctgataacaaggcgtatgggtgcgaaggagaattctggaccattgaaggtggttatgtagatgccttcgacaatgatgcgaacattgcagatgccagcagtgttctatcctggtcactgagtagtactagggcttgccgcatcaacccgcctcgcgtatacagcgggaacatgaacgtagtgcgcggggatagtccgttcggccctgggtttatcgggcaggcgtacatgcgcggggctgccgctgctagtcgtaccactagggctggggctgctagtactgtagcactggatgttcctgcgggtcaggagatgcgtcggtaccagttgccgctgcaccttctcgggtctatagtgcgagtatccttgcgagtctacaaccccggcgctactggtaacataaccttagcagtgggtagtggcggctcctctgttgctgcggtaccggctggtccagggtggttcgatgtagacttttacttgggtaacagcctaactggggacggagatttgcgcttcaccaacagcaccggaaacacactgagcctggatggtattacagtagagcgcgctcgttctgttccatttagctttgcgtggaccccaggtgctgtagctgccggtacgctggtatctagccctgtacagactctcccatacgggattactcaagcccctgtcggtttgagttctccggtatttaacgggtctgttgatgggctgctagccggtgtcagtagctacagtgggtacagctcctacaaagttactctgtttaatcctggggctgctccaattacccccggggctactcgggctagcttggtgctgcacttctaatgcacagcgtaaaacccaggcccagtctaggcgagcaggtctatacctggacctgaaatttattagactcacgcgagcccctccctcaccctcaacgacgccaattgcccccatagggggtacctagcgtcaatttaggggggggggggggcactgggtgggcctgctagtgcgcaccagagggcctcagcgggcctgtgctgcgttctagggctatcgctagtgctaccctatgcctgtccttgtgcgttcactagggcgcttcctgtgcgctctcagtgcgtgctatgaggcgctagggctatccctgtgcgctccctgtgggccataggggcgtgctctgccttgcttattttgtgcgtcacagtgtggcacctagtgggccagctagtgcgctgtagtgctatccctagtgctatccctagtatgcactaggctatccactggctatctttagtgctttacattgtgccgattctatgctacgctgcgcgctccccactagggcgcacttccactacccggcacactccagcgctatccagcgctatccagcgctatcccaatgctatccctttgctcttactttcattcgaaagctattatgaaatgaagtaaccggagtaggaggggtttagggacactatatacactactactcactatgcactccctagtatgtccctgtgcctacgcagtaggctgacatacctacacagtcaccgcatcactacgtggcttcactctcgttacgccactgcgttctgctctttgtagtattagatagtattggctcgtaatggctagcagtggctacagctagtgccagcatagggctatccctgatgtggttctaagtatttaccctgcttaccctttttgctcccggtgataaaaagcttaaaaaagtgcttgcttcttttggttcaatgggtctatagttcaatcaccgggaggcgctgaggtgctaaccggggccgagccgggaggctccgctggattaaagctagatagtgcgaagggttagacactcgataaaaagagttgacaccgcgaagggcataagctagattgagtccaagcagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttctgattcactgagtaacttagatagcaagcagtaagctggttcgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccctaccgataacgtgccgcttactgtgaagcccagcaaacaagggttgagcggtgagcacagggtgaggggaaagcaaaaacaaaagggcggcagtaaacagcctagtgggtggcctactgttaactcccaatttgggcactaattacagcctatagcatcctatggggtgctatgtgaagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactatgcgtcttgactacaaacaagctgacaagcagggccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggaagtggcctagtagcaagcctatagcgtcctacggggcgctatgtgaatgcaactggcgtatgaggtttcatatgaaagcaatactggtctatccgggccatgaactctggcccgtgtggtgcaatcggatatacgaagaatacagctacactgtggttatattctctgacaaagacactaatcaggaatcccctttagaatttgtggatacctacaccgaaatggctgcccgcactgtgctggacgccgtgaatcttggcattatcaacgactggagacaactttatggttaacgtgttcaacatcattgtgaccagcgctatgctggtgctgggcaacgacgtaaacaacccggtgccctattgcacagtgcagttgcagcaaccggcggcgcaggaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtaaggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgcctgcgctttaatgtacgaggtgtagtatgaagtatgacgtgtaccgagagacctatagcggtctgtattatctcatccctttagagggggcaattaatgagcgccgcatacttttaacctctgcgggattaatgcggagcagttaccgagcaggtgacgttatcacctctccggcttttgtgttggtgtcacgaaactgcgttcctaagagaagcctatgctaacagtagacgaaacagcgctgctatgctggcgtctgctggaaacgcagggcaagtgcggctgcacttgggaaacattcaaagaggttcctaatgaactcaagcaaatcataccggtcgagcgtagactcctccgtgttcgtaggcaggactctacggtggtgctcaccacgtaccgcgagtatacagagtctgccgcgcggcagttgcaagagcacattaagttcgatgtggttgcagcactgctacggtacggatatcgtggagcctatacaagatttagggcggctgtgcgctcgtattataagcaaagacagctcgctgcgtggtatgcgcgctgacttggcagttaacgacgaactcattgaatctattcaggagcaaattaaaatgcaagagactatcaaagaaactgtcacagcacctatcgaatggaaagtagtgttgccggaaggtgcaaacacactgccaattaaatgttcgatgtattccagcggtgattactggaccccgttccaggacttgcaaatgcaaggtgtagactaccctcacaatgagggtccactgcaggcacttatgggtctacgtactgtcggcatgtacacctcgggtttagaggtaactataggcgggatactgcacccaaaataccgcgaggtgatgagggttagtgggccgttgcaaaaggtggacttgtaccggtccggaactttctacgaactcctttctccggcgcgaatcaccatcgacagcaagttctgggaacgccgccgcgacttctatgagggtgatgatgtagtggttgagcgcgtggttgcgtgcgtggaagagttcaccggctacaaggtgcacaagcaggccgtgcagttattcgagcgcattatgcttgcaccagaagagcggcagcgccgggagtacactggctacaattacggacgccacatccgtgacatgagcgccgcggcgctgctcatgaagttgcacggtttcgtagtgtctagattcgccgtgcctttgggctttggtttccgcaacggtgagcccatcgtgatgctggggcagcctcgaatgcacaaggacttcgccgcagttactgagtaccgctgcgtagagatgcgcgtaggtaagtggctcgctaactactacggaaatggtgtggacttccgcgatgctatcgaagacctcaaggctatgaacgtagaccctaaaacgtacctgtgcaagaccgagcaggaatggtacgacgcctacgagaacggcccgggtagctgcatgagcgggtactcctttgagcatagccctgtgcgggcgtacgctactaccagtcacgggctgccggataatgggctgcgcctgttcatccagtacaccggggagctgttcggtgacgacttcgaagtgcaggcgcgagcaatcgtgaggccagaaactaacgagtatgttcgtgcttatggcaacgctgcggatgcaatcctgcgcggacatgggtacatcagaaacactgagtgtctcgaaggggtaatgctggcgcgtataccacacccgcaacacaccggtgcggtgctgatgccgtacctcgatagcagccagtgcggtgttgatgaagaaggcagtgacgcctttgtaatccgtgatgactacgagtacgaggcgcaagaagccgatggatacatctacgtaggcactgaatctgctcggtgctgctgctgcgaggggcgctactccattgatgatatgcacgaaaccgccgacggtgaaatggtctgcgacggctgcgtcgaagatggggactttgtatatgtagttggccgagaagggctgcataatcgctggagctgcacttggtctgattaccacgacgcctatgtatatgacgcggacattgagcactgttcggtagaaggggtagtgcatgaccaagaagaactggtgtttgcacaggaccggcaggtgcttattgagcacgcagaagaacatccagtgcacgggctaattctcactgaatatgcagccgattgcttgggagagaagtatctgggcaacgacgatgaagaagaagtagaggaggcagcttaatgttcttgaatcctcacgggattgatatgcagctgctcttgcagatactgcaaacgcaccggcctagctgggcaagtaccaagtggttcgagccgctgcttatgcaggcgcttggtagtggtatgcactacgtaaaggacaagcacggaaactacttcgtgctggtgggggactcagagcaaagcgacgtggcatttacgtcgcacctcgatacggtggcccgtccaaccagcgctgcgccggacgtcggctgcactaacaagggtgttctgttcgtaaagaatccgcagcaggctgactgcttaggcgcagactgcggagccggtatctacctgatgctggagatgctgcgacggggcgtgcacggacgctactgcttcttcgtggatgaagaggttggctgcgaaggcagcgctgcatcggtcaatgatgacactgggttttggactggggtcaaggcgatgattagctttgaccggcgcggcgacggaatcattacgcaccaacggtacatgcgctgctgctctgatacctttgccaagatcctagcagagcgcctgggacgcacggagcagcacttacagaagggggtgtacactgactcagccgagttcgttggtatcattcctgagtgcaccaacgtaggtgtagggtacatgcacgagcacaccccggatgaggtactggacctgaacatcctggggcaagtgcttgagcgggtactgcaagatggtacgttctcgcacctaccgattgagcgagacccgaaggtaatggagccagaccaatggctctctgcaccaacgctcagttcacggcagccgtgggacatgcccccggacgaggacccgcaattactggccgcgttccgggaagtgtcacagctatctaaacagcaattggttagctgggtgcaggagaacccagagaaggcggcggagtacatcatggtgttctccgattatggcttcaaacaggagctgattgaactaggcacccgagtcgtagaagactggggcggatacgataatattgtggagggttgattatgtctaagtttaaagttggtgataaagttgttcgcaaagcacacaaaaacacttcgtcgttcaagtcgtacctaggggattttgcttactacgtaattacagatataactacaagcggccactggctgcagttggataactttacagatgggggagccgacccctacccgtggtacgcctataacttcgagctatatcaagacccgaaggatgag

SEQ ID NO: 50 - DNA, 44838 bp, Unknown
  source: /note="Description of Unknown: MCoc9-2c Bacteriophage Sequence"
attatggcataccagttcccgttgatgctgctggctactatggctaagcatggcatggatgggaaggacgtagacacccagaaactcatcagtgagtccgtaacgggtatgagtgccatcggcggggtatccttactgcaggatatcttcctgggggattctccccgccactcgttggcgtctatgggttatgtcacagggctgctcggggccgtacaggacctggctactggtaatatggacatcaagaccttcactaagcaggtaccgttaatccaggaattcgcacctacgcgagctatcatcaataacttcggagacgattaatatggcgttcagctggcaagaacaaatcaagccagctggtacccaggatatccagtgcgatattgagtatttggacaagtcctatattcatgtatacctagacggagaggaaaccactgggtacacctggaccagctctactaatatcaggctgaacacagccttaacggcggacactacggtgctgctcattcgcaagactgagcgggagtacttgtatattgagttcgccagcggctctccgttcattgaggtgaacgtagattctcaaaacacgcaattcttacacctagcccaagagcttgtggaaggccgagctatccccggattctacgggaatataagcatgaacgggtaccgcatcactaacgtagcggacccagaagacctgcaggatgtggcaaccaagaactatgtagatactggtgatgcggcactaggtgtccgtattgatgccgaagccgccgcgcgcaaagccgcagacgatgcgctcgatgttcgtactaccaacctagagcagacctttatctcgggggagcctacggtaagctatccctggtatactatactggccgaggctactgacgaagttacgcctggattgtctttcacaaaggctatagtgtacgtacaaggcgtaaatcagattccgggctacagttttgaggtggtggataacactctactgtttgcagaggtacttccagctggtactctagtgtctgccagattggggtatgatgcagagctttcggaaacttacgctacagctacggcattaggggaagaggcgtcagccagggctaatgccgatgcacagataattctggattaccaagcagcagtagcgaccaaggcagcaaagggtgctaactctgatatcacgagcttaagtggattaactacaccgctgagtaaagctcaaggcggtactggcaacactactggtgccgctgattcagctgcgaagctagccacagcaaggactttggtggtagatttgacatccactacaccggccagttttgatggttctggcaatgccaccttaggggcaactggcagccttccaattacaaaggggggcaccggagctggcgatgccgccactgctaggactaacctgggagcagcggcgtccggcagcaacggagacatcaccgcattaacaggattgagtgggggtatatccggccgcactgacggtgcagctgcagccgccggtgtagtgggggaagtactgagtgccgcaacctctgcagccgtaagtgttaccagcggcaccccattgaacgttctgtccttgagcctgccggcgggggagtacgagcttgagagtgccctgttagtcactaatagcggcaacgttactgctctcagttttggagttagtagcaccagtgcagtgttacctggaaactggtacgacttatattctataaccaccacgttagcagctgggaattcttccagacagggtatgtcgcgccgtctactgttgagtgcaacaaccactgtatacctggtagcgcaggccacctttaccgggacctgcactgcccagggttatattagagctatgagggtaagataatggcaggggcggctaaacgcagtcgcctctcggagctgcaccgcatgttcactgaggccttgattgaagaaatcaagcagtccaaggaagacgaggtgccgctccccgccgcagataaatcggttatcgctaagttcttgaaggacaacgacatcaccgcggacgcagattccgaggagatgcaggaccttcgcgacgagttcgatgacgaactagcggcgcgtagagaggcgcgtaagcaagagattctaaataaagttggtggctcagactctgaggacttactagaaggaattgtataatggtatcggtgaagactgcacgaagactgcgcatgctcaaccagaaacttactggttatagtgcgaatccgcgcagtattcccaaagaggagcgcgaggatatcgccatgatgatggcggctgccctcagtgactttcgggaattcgcatacatcggtatgcgcttccttggttttacgctcacggacatgcaggccgacattgcagagtacatgcagaagggccctaggaagcgcatggtggccgcgcagcgtggtgaggctaagtctacactagctgcgctctacgctgtctggaggctcatacaggaccaatcctgccgtatcctgattgtgtctggtgcagagaagcaggcgtctgatgtagcgaacttaatcattcgtatgctggaaacctggccgctgctgtgctatttgaaggctgaccctactcgtggggaccgtacttcattcgaaggttatgatgtcaactgcgacctgaaacctctggataagtccgccagcgtagcctgtgtaggtatcactgcatccctgcagggtaagcgcgcggacctgctgattccagatgatatcgagaccaccaagaacggtttaacacaaacccagcgcgagcagctgctgatgatttcgaaagactttgcggctatctgtacgcacggggatacgctgtacctgggcacaccacagaccaaggacagtatctataagaccctgccgggacgtggcttcgaggtccgcgtgtggcccgggcgcattccgtctgttgaaatggaggagcgatatggaagtacacttgccccttatatccgggagcttattgagcgcggctataaacgcaccggcttcggcgtcgacgggacgttaggcgagagcactgacaccgggcgctatgacgaggatgcgctgattgagaaggagctggacttcggtccggaaggcttccagctgcagtacatgcttgacaccaccctgtccgaccaaatgcgtacgcgtatcaagctttcggatatgctggtttactccggtagccaggattcctccccggagacattctcctacattgcggaccgccggtacctgtaccagcacgagcatgaggggattatgggccagcagatgtacttcccggcattctacggggacatgcacctgccgtaccagcataaggtgctggtagtagacccggctggttgtggcggagacgaagtgtcctacgctgctggcggcgctgcgaactcgtacattcacctattctccgtaggcggcttccaaggaggtatcagcgaagagaacattgataaactgattgacctgtgcgtagagctagacatcccggatatggtggtggagagcaacatggggcatggcaccgtgtctatgcttatcctgaaccggttacgggagcgacgtctcgccggtatcggtgtacgggatctgaacaactccactcagaaagagcgtcgtatcatcgacacaatcagcccagttactcgtcgtcaccgcctggtagtgcatgagcgtgctattcacgatgatattagtacctgtatggcgtattcccgcgacaggcgttggctgtactctgcgttcgcgcagttgtctggcattacgtacgaccgtggtagtctggctaaggatgaccgcgctgacgcaatcgccatgatggtggctacgctgaacgggcacctggtggaagatgagaaagtggtggctgagcgtgagtctgagaagatggctcgggccttcattgataacccgctggattgggcacagagcaaagtgtctaagggccttcggggtgtagctgcacggttacagaaccggggcagaggtaaacaacatagaggaagaagataatggcatttgcagaagcaacactggcacagcgccaggcagtacgtaatgcagcagtagcacttgataaagcaacaaccttagcacatgatactggcccattagatactctgggtccggatgtagatgcagccggggctgtagcagtagcggcactctctgctgcaggggcctctgacggcggcactgtagtggtggtcagtaatggtgcggaagtaaccgtacccattacgttcaccaccgctcgggaggcagaggctactgccaccgtagcagcgactatcactgtagaagatggtgtaatcacagcaatctctattgagtaaggagtaatactatggcaattgcaaaagcaacctcagcgcaacagcaggagctgctgcgtcagctgaacattctcggtaaggacctgtatgctatccttacgcagccgcagaacgtagcccagactggagccgccttcgacaccaagattgctgcgcttgaagccgcagtagccgcagtgaaggctgctagctaatgcgtaaactggtcgctgggttactgctcgcggttactctgactggttgctcggcgacctctgcactcaccggcttagttggttctaagccggatgtgtctgctcaggttggtgccgaaaacaccaagcaaaccgttggcctgaacaacaaggtggacgccagcaccaccaacaaaaccgatgtatcagattctaacgtaggcaccctggacacgtccagtaagaagcaggtacaaactattagcaccgggacaatccaggcagaacgcctgcaggtggttaacaatgatagttacagtcttatcctcgccggattagctggggccagcattcccctggtcttcctagtggtcattctggtgattcgtaagctattcaggaagaaggggcagcaggatgattaaggtaggagacatggttgggtcggacctcgctacccgggcaggtgcagcagttaccggcgctacggtatcaggaggttggttggcagagttaatgagctggaactggagcactatcagcttcatcactgcgacggtgtgcgcagtgctaaccctggcgtggaatgcgtattacaagcgacgtacattcaagctcctagaggagcaggcacgtaaggggactattaaatatgagtttaaggactaaggttattgcggccctcacgggggccactatgctcggcggtgccattaccggcgtagtccagcacaacgagggcctgagccttaccgcctacaaggatagcgccggtgtccctacaatctgctatggcgagaccaagggcgttaaaatgggccagagagccacgctgagcgattgtcagaagcaactgatacaatcagcaggggaacacgcaaaggcccttgacgggcttcctatgcagctctctgacgtagccctggttgggtctatagacttcatttataacgtaggtgtagctggcttcaatggcagtgccgtgaagcggcatctcaagagccttgattatgcggcagccgggaaggctgtactggactggcgttatattagcaagtaccagcagaagtccccgggcaccggttgggtgtataagggcggcaaccgctggacctttgactgctcccagtatattaacgggcagcgcaatagagtgtgctggggcctatgggagcgcaggcagtggcagagcaaagccatcgggaatcagtataagaacgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgaccggattcttccggcaactacgcagcagctattgagcgggtttccgctaaaggtgtaaaggtgctgcgcgtacctgtggggtcttattatgttggggactgccacctaactaaccctatgctgtttataggtgatggcctagagggcgtcaacccgcttggggctgtattcattaaacctagcacagctgctaagatgttctactttgacggtacaagtacacgtggaactgggggcggattcctcagaatgcgactgcaaggggctgtcagcagtgattcgggacttatggttgaagtcacctcctggagctattttggggcggagaactctgcttttaataacttagcgggatctgcgctggtgttgcgtgactgtatggagagtcacatctcaggaaacttattccgcaggatgggtgcctctaacggcagtgttatactcctaggggattacataggtattcctaataataacgtcaataacctgcacattcagaataacacattcgggttgtgctctggtgcgtggattaagagtacagcaaacagtaacccggacctggtgtggattacggataataagtttgagtgggatagtgtaccgtacggagctaacacaaccacgcagcacgtactggactttggacagctgtcacgctcttggattacccgtaatggttttgcgcacttccgcccagactccgaccataacctgtatgccgggtgtattcgtattaggtctggagctgttggtcctattgttatttctgataacaaggcgtatgggtgcgaaggagaattctggaccattgaaggtggttatgtagatgccttcgacaatgatgcgaacattgcagatgccagcagtgttctatcctggtcactgagtagtactagggcttgccgcatcaacccgcctcgcgtatacagcgggaacatgaacgtagtgcgcggggatagtccgttcggccctgggtttatcgggcaggcgtacatgcgcggggctgccgctgctagtcgtaccactagggctggggctgctagtactgtagcactggatgttcctgcgggtcaggagatgcgtcggtaccagttgccgctgcaccttctcgggtctatagtgcgagtatccttgcgagtctacaaccccggcgctactggtaacataaccttagcagtgggtagtggcggctcctctgttgctgcggtaccggctggtccagggtggttcgatgtagacttttacttgggtaacagcctaactggggacggagatttgcgcttcaccaacagcaccggaaacacactgagcctggatggtattacagtagagcgcgctcgttctgttccatttagctttgcgtggaccccaggtgctgtagctgccggtacgctggtatctagccctgtacagactctcccatacgggattactcaagcccctgtcggtttgagttctccggtatttaacgggtctgttgatgggctgctagccggtgtcagtagctacagtgggtacagctcctacaaagttactctgtttaatcctggggctgctccaattacccccggggctactcgggctagcttggtgctgcacttctaatgcacagcgtaaaacccaggcccagtctaggcgagcaggtctatacctggacctgaaatttattagactcacgcgagcccctccctcaccctcaacgacgccaattgcccccatagggggtacctagcgtcaatttaggggggggggggcactgggtgggcctgctagtgcgcaccagagggcctcagcgggcctgtgctgcgttctagggctatcgctagtgctaccctatgcctgtccttgtgcgttcactagggcgcttcctgtgcgctctcagtgcgtgctatgaggcgctagggctatccctgtgcgctccctgtgggccataggggcgtgctctgccttgcttattttgtgcgtcacagtgtggcacctagtgggccagctagtgcgctgtagtgctatccctagtgctatccctagtatgcactaggctatccactggctatctttagtgctttacattgtgccgattctatgctacgctgcgcgctccccactagggcgcacttccactacccggcacactccagcgctatccagcgctatccagcgctatcccaatgctatccctttgctcttactttcattcgaaagctattatgaaatgaagtaaccggagtaggaggggtttagggacactatatacactactactcactatgcactccctagtatgtccctgtgcctacgcagtaggctgacatacctacacagtcaccgcatcactacgtggcttcactctcgttacgccactgcgttctgctctttgtagtattagatagtattggctcgtaatggctagcagtggctacagctagtgccagcatagggctatccctgatgtggttctaagtatttaccctgcttaccctttttgctcccggtgataaaaagcttaaaaaagtgcttgcttcttttggttcaatgggtctatagttcaatcaccgggaggcgctgaggtgctaaccggggccgagccgggaggctccgctggattaaagctagatagtgcgaagggttagacactcgataaaaagagttgacaccgcgaagggcataagctagattgagtccaagcagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttctgattcactgagtaacttagatagcaagcagtaagctggttcgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccctaccgataacgtgccgcttactgtgaagcccagcaaacaagggttgagcggtgagcacagggtgaggggaaagcaaaaacaaaagggcggcagtaaacagcctagtgggtggcctactgttaactcccaatttgggcactaattacagcctatagcatcctatggggtgctatgtgaagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactatgcgtcttgactacaaacaagctgacaagcagggccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggaagtggcctagtagcaagcctatagcgtcctacggggcgctatgtgaatgcaactggcgtatgaggtttcatatgaaagcaatactggtctatccgggccatgaactctggcccgtgtggtgcaatcggatatacgaagaatacagctacactgtggttatattctctgacaaagacactaatcaggaatcccctttagaatttgtggatacctacaccgaaatggctgcccgcactgtgctggacgccgtgaatcttggcattatcaacgactggagacaactttatggttaacgtgttcaacatcattgtgaccagcgctatgctggtgctgggcaacgacgtaaacaacccggtgccctattgcacagtgcagttgcagcaaccggcggcgcaggaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtaaggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgcctgcgctttaatgtacgaggtgtagtatgaagtatgacgtgtaccgagagacctatagcggtctgtattatctcatccctttagagggggcaattaatgagcgccgcatacttttaacctctgcgggattaatgcggagcagttaccgagcaggtgacgttatcacctctccggcttttgtgttggtgtcacgaaactgcgttcctaagagaagcctatgctaacagtagacgaaacagcgctgctatgctggcgtctgctggaaacgcagggcaagtgcggctgcacttgggaaacattcaaagaggttcctaatgaactcaagcaaatcataccggtcgagcgtagactcctccgtgttcgtaggccggactctacggtggtgctcaccacgtaccgcgagtatacagagtctgccgcgcggcagttgcaagagcacattaagttcgatgtggttgcagcactgctacggtacggatatcgtggagcctatacaagatttagggcggctgtgcgctcgtattataagcaaagacagctcgctgcgtggtatgcgcgctgacttggcagttaacgacgaactcattgaatctattcaggagcaaattaaaatgcaagagactatcaaagaaactgtcacagcacctatcgaatggaaagtagtgttgccggaaggtgcaaacacactgccaattaaatgttcgatgtattccagcggtgattactggaccccgttccaggacttgcaaatgcaaggtgtagactaccctcacaatgagggtccactgcaggcacttatgggtctacgtactgtcggcatgtacacctcgggtttagaggtaactataggcgggatactgcacccaaaataccgcgaggtgatgagggttagtgggccgttgcaaaaggtggacttgtaccggtccggaactttctacgaactcctttctccggcgcgaatcaccatcgacagcaagttctgggaacgccgccgcgacttctatgagggtgatgatgtagtggttgagcgcgtggttgcgtgcgtggaagagttcaccggctacaaggtgcacaagcaggccgtgcagttattcgagcgcattatgcttgcaccagaagagcggcagcgccgggagtacactggctacaattacggacgccacatccgtgacatgagcgccgcggcgctgctcatgaagttgcacggtttcgtagtgtctagattcgccgtgcctttgggctttggtttccgcaacggtgagcccatcgtgatgctggggcagcctcgaatgcacaaggacttcgccgcagttactgagtaccgctgcgtagagatgcgcgtaggtaagtggctcgctaactactacggaaatggtgtggacttccgcgatgctatcgaagacctcaaggctatgaacgtagaccctaaaacgtacctgtgcaagaccgagcaggaatggtacgacgcctacgagaacggcccgggtagctgcatgagcgggtactcctttgagcatagccctgtgcgggcgtacgctactaccagtcacgggctgccggataatgggctgcgcctgttcatccagtacaccggggagctgttcggtgacgacttcgaagtgcaggcgcgagcaatcgtgaggccagaaactaacgagtatgttcgtgcttatggcaacgctgcggatgcaatcctgcgcggacatgggtacatcagaaacactgagtgtctcgaaggggtaatgctggcgcgtataccacacccgcaacacaccggtgcggtgctgatgccgtacctcgatagcagccagtgcggtgttgatgaagaaggcagtgacgcctttgtaatccgtgatgactacgagtacgaggcgcaagaagccgatggatacatctacgtaggcactgaatctgctcggtgctgctgctgcgaggggcgctactccattgatgatatgcacgaaaccgccgacggtgaaatggtctgcgacggctgcgtcgaagatggggactttgtatatgtagttggccgagaagggctgcataatcgctggagctgcacttggtctgattaccacgacgcctatgtatatgacgcggacattgagcactgttcggtagaaggggtagtgcatgaccaagaagaactggtgtttgcacaggaccggcaggtgcttattgagcacgcagaagaacatccagtgcacgggctaattctcactgaatatgcagccgattgcttgggagagaagtatctgggcaacgacgatgaagaagaagtagaggaggcagcttaatgttcttgaatcctcacgggattgatatgcagctgctcttgcagatactgcaaacgcaccggcctagctgggcaagtaccaagtggttcgagccgctgcttatgcaggcgcttggtagtggtatgcactacgtaaaggacaagcacggaaactacttcgtgctggtgggggactcagagcaaagcgacgtggcatttacgtcgcacctcgatacggtggcccgtccaaccagcgctgcgccggacgtcggctgcactaacaagggtgttctgttcgtaaagaatccgcagcaggctgactgcttaggcgcagactgcggagccggtatctacctgatgctggagatgctgcgacggggcgtgcacggacgctactgcttcttcgtggatgaagaggttggctgcgaaggcagcgctgcatcggtcaatgatgacactgggttttggactggggtcaaggcgatgattagctttgaccggcgcggcgacggaatcattacgcaccaacggtacatgcgctgctgctctgatacctttgccaagatcctagcagagcgcctgggacgcacggagcagcacttacagaagggggtgtacactgactcagccgagttcgttggtatcattcctgagtgcaccaacgtaggtgtagggtacatgcacgagcacaccccggatgaggtactggacctgaacatcctggggcaagtgcttgagcgggtactgcaagatggtacgttctcgcacctaccgattgagcgagacccgaaggtaatggagccagaccaatggctctctgcaccaacgctcagttcacggcagccgtgggacatgcccccggacgaggacccgcaattactggccgcgttccgggaagtgtcacagctatctaaacagcaattggttagctgggtgcaggagaacccagagaaggcggcggagtacatcatggtgttctccgattatggcttcaaacaggagctgattgaactaggcacccgagtcgtagaagactggggcggatacgataatattgtggagggttgattatgtctaagtttaaagttggtgataaagttgttcgcaaagcacacaaaaacacttcgtcgttcaagtcgtacctaggggattttgcttactacgtaattacagatataactacaagcggccactggctgcagttggataactttacagatgggggagccgacccctacccgtggtacgcctataacttcgagctatatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatgtcggttaagcgcgagcagaagtaatggaccagccctggcttagagcgtgcaagcgcctggccgtggggcagagggcgcgctttcggtgctgcggcagggacgccgccggggtgctctacaataacccggatgcctgggaatactattgccaccgctgcaagcaagtgggcaaggagcacaagcagtaccagcgcatacagttacaggaagagccgagggtgcagccctctgcacctgcagatgcaatttgcattagccaagcgcctgcggaaacgcagagttttatttacggattcctgaccacaaagggaatcatgcctgaaatggtggaggatgcagaatggagcaaagagaaacagcggataatcttccgtgtcggaagcgctgctctgggccgtgcagtgcatgcccgacagcaaccgaagtgggtaatgtacggccagccaataccgttcgctgccgcggcacctgccgcagcaccggctgtagctgcggccgcacctctaaaggtcgtgctcaccgaggactatctatcagcgatcaaatatcagcacgcgattacgaactactctgcaatgaacgtgcaggctatagctatgctgggtactcgcttgcccgtgcagttaagggcgtggctgatacagaacaaaccgacagtgatactgtccatggataatgaccaagcgggacactccggcgcggccatgatacgccgtgcgctacgtccctttatgtcgtgccacgaaatctactacgacggggacccaaaagaggcaacaatacaggagttattagatggtattaggcgcgtgtaaagagcacaaacagaaaggcggaccaaagggttacggaaataccacgttcaaagggcggaagatacctctgcatagaaaggtgtgttgctcggcgaacgatatatctccggagagcatagcggggctagttgtgcgccataagtgtgacaacccgagatgtattaatcccgagcatttagaattaggtacggtcaaggataacgtccatgactgtattgccaggggtagggctagacgtggagtttctaaaggggagcagaatgggtactccaagctaacagcgcagcaggtggactatatcaggaagacctacaggcggtacagcagggaacacggcacaccggccatagctgctagccttggtgtaagtgtgtcagcagtgcacgatgtattgaaagctaaaacttggaggctctaattggatctaatagttgtgcgtgcaatgtgcacgcagaaggtgtggaaccggctgcgagagcagatacccaagtctatgcttgcgccggacacttcgaaccttctggactgggtggggttgtactggaacacttacccggagcaccaggaggtgcaatgggatgcgatgcagagcatgctcaacctccgggcggggcacttgtcccgggaagagagggtaatcatggacgagcttatgcggggagtacaagccgtgccgcaggattctgtggtgggcattgtccagaccctgaatgagctggcctacagcggggaggtagcagcgctgacgcagcgctaccaagatggcgaggaggttgattaccttctggagatgaagcacttgcagcgcaagtacggggacggcgctgctgttcatgattcgctgcttgaatgggagagcggaagtgttgatgaaatacttgccgcgactgacgagagcggcggtcttaaactgggcgtgttcgagcaactcgctagcagcatccgaggcttacgcggcggggactgcatcgcagtggctgctcctgtggactctggtaaaactagcctgcttgctgctattgctgtggactttgctgagcagatgcagcagcagccggaagtatacggggaccgccctatcctctggttggttaacgagggcccagcgacgcgcacagtgccgagggtatatcaagcggcgctgcattggactctggcggagattaaggaccggcacagtaagcaagagttcgtgccagcctacctcaagaaagtaggcagggctgaccggattcgtgtcaaggctgcgcactcattgacgatggcgcagatatccacgctcatggaggagatgcgccccgcggtaatcatcatcgacatggtggcgaatatccgtggcggcactatggagagtgagcaccagaaccttgaggcgaaatggcaggagctgcgtatccttgggtgcgagaacgactgcgctattgtaggcactatgcaactttcactcgaaggttacaacatgctgttcccgccactcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgcttatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagcggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgaattgggatatttggtttacctacaaagacggcaaactctactggaagcacgaggttagaagtgggcgcggacgcagccacctaaactgcgccgcaggttccgaggcaggaactctgaacaaagtacatggatactggtacgttaagctgcataataagctatacaaaagaagtttgatagtatatgagatgcacaacggtccgctgcgagcaggccaccatatagaccacataaatcataacaggttagaagataccccagataacttgagggcagtgcttcctgagaagaacatgcagaacaagtccctatatagaagcaaccgcagcggctatgtaggggtgcacaggaagagaggtcgttggatagcaaccctaggaaataaacaattaggttcatttagcagtatagagcaagccgtagagtgtcgtagactggcagctgaggcggcggggtatcaccataatcacggggttgcagtatgactagcagtattatgactatagaccttgaggtcgagaataatccttactatggtagcaaggctagcccctactgccctgacaactatgtagtgcattcggcctaccgcatagaccggaccgaggatgacggcacagttaccgtagaaccgacctttgatatcagattcaacagcaagcaggaattccttgacgacgtagccggggagcatctgtggttccgcataccttctgattgctggtgcatcgtggcccacaacgcagccttcgaaattagctggtttttaacatatcagcggcaacactttgaggaattcctaaagcgcggcggccgcgtattcgacacaatgcacggggagtatattgtgtctgactttcagagtatgtacccatccttggatgaaactgcgccaaagtatggtggggagcataagattgatggggtaaaaatattgtgggaacagggtgttctgacctcgcagatagaccccattcttctcagggattacctagtcaatggtgatataaagaacacggccctgtgcttctacggccagtgtgctacgttcacccagcgcaatcagatgcagtacgtgtgggagcgtatggatgccttgctggcttgggcgtactgcgaatggttcggcctgttcgttaatatgccaattgcgcgcaagaaccaggaggagcaggagcagcgcatctgtgagattaagcaggagctgcagcagtatatcccgaaggacctaccggagactctggatttcaacttcggctcggactttcatatgtctgcactggtgtacggcgggcctatcaagtatcgcaagaaggtgccctatgaccctccccagtacgtcaaggccgactactggcaagtcggggacacttgggttgccgtggatgacgtgcccgcaccgccaggtgcaaccacgtacaagtccggtaagaacaaggggctaccaaaagtattccgccttgatacagaggaggagaaacttaagtgggaggatgacctttacttctgcccgggcctagtgaacatccaggagctgccggaagttatccgggagaagtatgcggagcgtggagagttccgacaggcgcgcaccctgcaggacggtacgccagtatacagcaccagcacagacgcaatggaggcgctggcccgccaagggttcgagttctgtaagttggtgaatgagctggcggcgcttgagaaggacaccggtacctactatttacgggaagttctggatgcaaacggagaagtcaaagagcggaagggaatgctgcagtacgtaatacccgaacgcccagatggttccggtatcatacaccaccggctgaatacttgtgccactgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcttgctacaggcaggtacggatatgcactgttaccgcctcgctttccgcgagggactgccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtacacgatgcattgtatctggacagcgccaacccggaggttggacgtgaggcgagcctgctggttaagcagtgcatggaggatgcacctaagcgtatccaccagctctggcctaactacggtatcattggcgaggtgcccttcccggcggaagctgaaatgggtacgagcatgtacagtaaggagaaggtagaatgaatattaaacctggcagtattgtggagatgctggaacttgggccggagcctatcgacccacgacatcgtgcctactttgcaccgggtacgcagcatcgcgtgatatcttacgacgttgaattcggcgaggtggagctactcaatccggacagcaactcagagaagcctggggacggcatcaccttcttcgctggagagtacaagctcatcgcggagtagtgataggtggacccttgggtggtgtagggggttagggtagcatggaaatatgctagggtcaactaaataattaaataaaattatttgttgactctggcttgattctgtgattccccgagaattaatgtgatacgagtaggaacaacacaagagaggcaaccttggctaaagtaagtctaatcaaactgtggaccaaagaagagcaccaacaaattcttggcagtttcctaaataacactgatgcagctattgcgtacaataacaaatttcgcaggggggacgtaatcgtgtctcgccagcttgtacgctactggcgcagcatcttcatggataacaagggcagcaaggccagtgccaaccgcgggctgcaggaggcgcgtaagctaatccaaccaagcccaacggacgatatcgggaatacaaaggtgccggatatgtgccaccgcattctggttgtcggggacctgcacgctccgtatacccacgtagacgcaatgccgttccttgagagcgtacgtgatgcgtactgcccggacatggtagtgcaggtgggtgacgaaaccgacgggcacgctatcagcttccacgactctgaccctaacctggatagcgcaggggtggagctggagaaagccaagctcgtactggaggagctgcatgaactattcccgaacctgctggtttgcgattccaatcacggctcactcgtatatcgccgcgctaaagctcacggtttgccagtgcaatttatcaagaagtaccgggacatcttattccctgagcatggtgctccggcgtggtcgtgggccgacgcttgggtgctcaacacaccgctggggcctgtccgtttccagcatcaagtcagcggtgatttcatgcgcaatgcatcccatgagcgcacctctctggtgttggggcatgagcatggacgcttcgaggttcagtatgctgcttcttcaacggcgctgtactttggtgcgtatgcagggtgcttgattgaccgcaagagcatggcctttgcttatggcagactcacccgcaagaaaccaatcctgggtgtgatggtaatcaccgagggttgcccgcagttaattccgatgctgctcgacgacgatggtcgttgggtagggagaagcaaatgaatgtactggattcaactgtcacccgagtagatgctcctgtatgggatgagcaataccaggtgtatcgtgtaaccctggagtatgactgctgggggcacaaatctgagacagagcggtggtataaagatgaagcctcagctcttagtttaaaagttggtgacataatcaaaacctaattaggagtgtcgatgaaaatgggaatctgttctgtactgggccttatctttgtaaccctgaaactgactggcgttatcgcctggtcctggtggtgggtactgcttccgttctacggcggtgtagctttgctgttggcaatcctggcggcaggcggtgtggcagcagccgcggctgcaggcattaaatccgcacttaagaatcgctaggccggacctgcatctgcacgtaaatatcatttaaactaaacgaggacgtaattatatgactacgaatgtactggcatccctgaacgctctggtagacgcagcaatcgaaacccaagatgtggatatgcgggaaaccgcacagggtggtgcgtacgaggacgtgctgctgccgaagggtgaatattacggttacttcaccgagtatgtggaaatcggtaagcgcctgccgaccaagggtggtaagcctaccggtaagcctgcagtggctaacgtacgtatcggcattgtagtgttcggccccaacggcgaagtgaagcgtatccgcccgtacccgatggctatcagtaactttgagcgagcaggcttcaagaagttcttcgacaagctcaactacgacaatagcattaagcatgcagcgcagcgtctgggccaggccttcaccttcccgattgatgagcacaccagcgccgcgggtaagaagtcgaacatcgtggacctgtccggtatccgcccgattcctaagttcgacccgaacaccggtgaacctattaagatgccagcgctggatgcctccgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcgccggcagccccagctgctccagtggctcctgcggctcctgtagcgcctgtagctccagcagcgcccgctgcacctcaagcctaataaaccctaatcgaaactaatacggcccctcctggggccttagaggaagcctatgaacatcatcaacatccttatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctaactctcacgcatacagggcaagccttctgggtcccgagattagtgcgcagcgttatcacttgaatcgccagtgcgccaagtcccggcgccgtgcatatgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggatatgttcctggtcggctgctcagaggcagtggcgtacctgacgcctgcgggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatataccgacaggtacagtgtggcctgcactggaggacccattcggatgggttaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgaggggaaacacgatgaacttgaaactattctggatgcgctgcgtgaacgagcacccaaaacacatcgaagaacggttgagcatttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcgtatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggccagggcacgacgcaaagcacgggagactgttaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggagttcttccagctcttccattcgaagagcgaggctgtttctgactcagtgaactctcctcggcactaccagttcttcccggacctggaggcaatagaggtaattgcacgcagcatgacgcaagagcagttctacggctattgtctcggtaacagattaaaatacagactctgcgccggtaacaaggatacactggagcaggacattgctaagtccgataagtacccagaactgtatgagcaacaccgaggtaagtgcattgacgcttagtgcatggtgtcatgagatgtggcagagggtagtagagcggcgcgacaaaaagcacggggaggggctattaaatgaagacagtaatctttgatttggacggtacactagctgatggcgcgcaccgcttgcacttgctgcctactgtggatttgtatctgactgacagttggaatgagttcaaccgggcctcgaagtatgatagccctatccacagcactattgaagtgtgcaacatcatggtgcgagcagggttgcgagttattatcttgacggggcgctctgatatagtacgagcggaaacagaggcctggctggagcggaacttcgttatgtactccgagctggttatgaggccgcacagtgacaaccgaaaggatgtcattatcaaagaggagttcctgcgcaaccaagtggggttagaaaacattgtggcggcttgggatgacagccccgcggtgattgagcatttccgcggactgggtattaccacttacgctgtatgcgactatggtgcagcagcacatcgaacagacttaaaatcccacggggtggaggaattagcatgagtgcagtaggtacaggcatgaagtatgacgcagacaaacctcgaatggacttgctactggacgggtgcccgaatgcgttgctgcgtatcagtgatgtgctgaccttcggggcccagaagtatgcggcacacagttggcacacggtagccgaaggtaagtcccgatacaaggccgcgctactgcggcacctcacggcacatgctctgggggaaacactggactcggagagcgggttgccgcacctggcgcatgccgcttgttgtgcattatttattctagaactggagcagatggatagtgcggccgagtgagtggtgccacgggatgtggcagaaagcagtagagcggggcgacgaaagctccgctaaagactacctggagatgtataatctctgggtcagccgcaatcagtagttagaagtaccggacataaccaaggagactaagcgcctatgattagcgccctgaatacggttgtagtaccagaggaagcactggtgaaacgccagctggagcttgaagagacctataagattcgcggaatcgagcgggcacgtaagctgattacggacgcattgcagaatggtgggattatgaacctgccgatgacgcagcgtatgctcacctctgcatatgaggtggctgctgcagctatcgatgagatgcgaaatgtcaaagccccaggcattggtgggaagtaccgtcggttcctgcgcttaatccccttggatgtcctgaccaccctgagcctgtgcacaatgtttgaggcgttcagcgtcgcccctggcgagtccgccagtcgccgtcagactgcacaggcggtaatgtccgcactgggcagaaacgtacagtcagagctactggctctgcagttacgcaacgtagccccagcgtacatggaccgagtatatgagtatctcacagagcgccgtacgaagtcccctacgcacatcctgcgtacgctccgtgccagtgccgagaacgtacactatgggcacgagccttggaccaatgcccagaacatctccgtagggcgtctgctgtgtgccgcagtgtttgagacgggactgttccagtggaagaactgtagcgggaatctgagcatgctctatccggctgacgacgttatggaggccttccagaaactggtagagtccgctgataccgtaaccatgaagccacctatgctggtaccgccggtgcagcacactactctgtgggatggtggatatctcacccctatcgacaatcgcggcacctatcataattctcatatcgaccgcgcacgtctccgtgaagtagcggaagcatttaaatccgcggatggcatcaaaaaggcgcttaataaggcacaggaaaccccgtaccgtattaataagcgcatactggaactggtgcaagaagcacgggccctgggtgttgggataggtatgcctcgctcagtaccggagcctaaaccggagtggtatctggacggggttcctaaagagaactacacagaggaagagcttgaccgcttcggtgagtggaagacgcgtatgtccctgtggtacagtgctgaccgtaagcgcgtatcgcaactacgcagccttctgactacgttggagatggcagaggaattcaaagatgagaaagccctgtacttcccgacttgtgtggactggcgctaccgcctgtacttcaagtcctcgctgcacccccaaggttctgatttgcagaaagccctacttgaattcggacgtggtaagccgctgggggagcgtggcctattttggctcaaagtgcacgtcgctacatgctttggttatgacaaaaccctatccgaagaccgtgcagcttgggctgatgcgaactttgcagagattgagcaactcacaatctctccgtttgattgccctgcttttgccaaggcggactccccctggtgtttcttggccgccgctatcgacctggttaatgctattcgttctggatgcccagaagagtatattagccgaatcccagtagctatggacgctacgaactcaggtgggcagcacctctcagcgctcctgagagaccctgtgggcggtcgtctgacgaacctgtactgggagggtaacgacaagaaagcggacctgtatatggatgtgaagcgccgtacggacgagaaggtgatactggacctggacaaggaggatttcgttatccagagcacttactggagagagaacgaaatcacccgcagcatgaccaagcgccccagtatgacctacttctacagcgccacggtgcgcagctgcagtgactacatctttgaaggcgcttgcgctgaggggtatgaaggtaccgacactaacagtctatggaatctgtcgtgctacctagccccgcgtatgcgcgccgctatagaggaggcaaaccctgctgctgcggcagttatgtcgtacttgcagaacctcgctaggcgtgtaccggcaagccagcacctgcagtggtatacgccgctgggcgggctcgtaatgaaccgctacacacagcgtgaagaagtgcgggtacgaattgactgtatgaacctcacaatcatgcgcgtgcataatcgggatttcaagacctgtaacaagcgcaaggcagcctcggggattgccccgaactttgtgcacagcctggatagtacgcacttgatgatggttctatgtgccgccgagggtctggacattgtgccgattcacgactccctggctacacacgcagccgatgttgatactatgcaccggcacatccgcgagcagtttgtgcgtctctacgaagagcatgaccttcttggggatatcacccgcgcggcggcagcagctggtgcggacttgacggacctggatatgccagaggttggtactctggacatccggcaggtactggaatcacctttcttcttctgctgagggtatggtatgcgagtactagtaactggtgggcgagattacacagactacttagcactaaagaccgcaatggatatgctgccaaacaaaccatctgtagtgatacatggaaatgccagaggggcggacgcactggcagacaggtgggccctggaatccggtatttttgttctgcgtatgcctgccctgtgggatgtgcagggtaaatctgcaggtatgcgcaggaacgccgccatgatatccttggcctttccagaatactgcgtcgcctttcctggtggaaggggtaccgctggtatggttgagttatgtagaaaggccggtataccagtttgggtaccctactaaaatttaatgttaccggagtaggaatgaagttaaaacacactggtaaaacttccgattacactctcaaggttctgtataagtctgacgatattacagacgcagtgaagcaactgcacgaactgggccacggcattagtcggggcctggctcctgagcagcactactggagggtgttgggaagtatactgggtaaacagtatatactaggagtctatgactcccaaggcgacttagtcggtgccgtcagctactacccagaggctgtagaggactgtcattacgtagagcctgtgctatatacagacttcttcgtattgaaaccggacaacggcgcggcagtgtctgtgattatgcagggcctgcacgcaatagccaagtgcatgcgcgctgggcgtatcgccattagccggagcacgtctagtaacacgtacaaaacaacttatcatttagtgaggtcagaatgagtggtggtttaggtaaactgttaggcaaggccacggatatgctcggccttactgacaacgcaggattagaggcgcagcagcgcttggcagagcaacaggccagcgcagctaaacaacaggctgccttagaggctaatagcgccgcagataacattgctgagattgaccccgcaggggctgcctctgcatctgcagatgcaattacgtctgagcagaagaaacggcgacaagcagggcagagcaatcctctgggcctgtaagggggtagcttggaacaaaaagcaacattagcagaactctttaagaaggaccaggacgcgggcgtcttggatgcctctgagaagttcgcgcagtggacgctcagcacgatctttacccgggacgattccctggacggtagacgcaggccgctggagcgagactatcagagcaccggcgcgcagctggtcaacactgcagccactaagattgtaggggccctgttcccacagggcaccagcttcttccggttctccaagagttcggacctggacgagttcattagttcgctgggcagcgcagctacagcagaatctaagctggccgaggtcgagaacacggcgtcacagaaagtatttgagaaagacggttatgctgcgaagttgcaagctgtgaagctgctgctggttacaggtaacgcgttggagtatattgatgagcggacaggtaaatccatcgtctactcagtccgtaactttaccgttcgaagggatggcagcgggaacgtcctgcgactcattatcagagagcgcgcaagcgtccaggacctgccagaagatttccgcggcaccttctaccgtgacaaagacccatacggcgacgttgatatctacactgccgcttgtcgcaaggttaagcggacagaggaaggcgtagaagtagtaagctacgaggtgtaccaagaagcagacgggcaccgtatcggagacagcagcacctatccagagctggagcttccttacaacgtgctggtgtggaaccttgttagcggcgaacactatgggcgcggcttggtagaggactacgccggggacttcgcccgattatcagtactgtcggaagcgttgactaactacgaggttgagtctgcgaggttaatcccgctgattgacgcaagctctgggttagacgtggacgagttctcaacgtcggagacgggtgaggctgtgcaggtgggtggtggcggttccaacgggaacagcaaatcccccgtcactgcttacgagggcggctctgcccagaagattcagtggattgccagcaacatccagatgctcgaacagaaactgtcacgtgcgttcatgtacaccggtaactcccggcagggcgagcgcgtcacggcctacgagattcgccagaatgccaaggaggcggaagccgctatgggcggcgggttcagtattctgagcgacacatggctgcgtaagctggcgtacctgtacaccgcactggtgtatcctcgctttaagctgtacctcagcgaaggtgtagtgagcatcaacgttacggtgggcacctctgcactcgctaaagccgcggcagcggacaagctgttagaggcggcgcaatccatgcagctggctatcccggtgcttgagcagattactccgcgcttcaacaaagatgcgtgcgtagattggtacttcgacgcctacggtatcgttagcgagccgttcatgtacaccgaagagcagctgcagcagaagcaacaggttcaggatgcgtctgccgatacgtccgcaggtctagcacaggaccaactccagggcttgacagcagcagacccgacagtagcaggtaagcagctgggcttattaccaagttaacaacagaggcatagatggataacgtagaaaacggtcagaacgtagaaactacacaggtagagaaccaaggcggccctaagattccgggcctaggtgctccccttagcgccccgaacaatcaaggcgtgcaggatgcacagacccctacccagcagcaacagggcaaagattcccctgaccctgctaagattcctctggatatcgaagccctaaaagcggccctggataagggtggcgatagcgctaaagagcagccccaggagctggctaagacaggcaacccgacgattgacgccggtgtagctatgttgcagaaagtctctgggttaactgactctgatatggtgcgggcacttggtaaggccctggagtatcaggaccctaacctaatcgatacggccttcattaaggaacgtttcggagagcacgctgcttatgcagagttgctggctaaagcgtacctggaagaccaggttggtcaagccaccaaggcagtacaggaagcttacgatatcgtgggcggtaaggagaactgggaggtagcagcgcagctgtttaattccaaggcccctgaacctcttcgtaacgcggctcgtgcactcgctaactcgggtgagctcaagcaggccgctgagttggtggcaagcttctgccgggatatgggtcttatcaagacacagaacccaatggtacgcggtgtagccagcaacaatgcactatctgctgcggaattccgcgcagaatataccaaactccgtcaggaagcgggcaaccgtagcttggcgtctccacagttcagtcaacgttataacgatttgctcgcacgccgtgaagctggtaagcgcgtaggtctttaattttatttataaaggaaactaaagcatggccaacactatttataatggcaacctgacccgggcccactggggcggcgcggcgtctgacgtagatattcacctggaagtgtaccagaacgaagtggatacccgcttccagtaccaggctctgttcctgggcctctccagccagcgctctatcagcggttccaacacctaccgtattgaccgcctgaacacctcctcggtgaagggtcgtcgctctggtgaggcgctggatagcaccccggtccgtaacgataagatgattatcgtggtggatacggtgctgtatatccgtaacccgattgactaccaggacgactggaccggtccggacttcctgaccgagatgggccagaacaacggctccgagttcgcagagacattcgaccaggcgcacctgattcagctaatcaagggccgttcctgggttgctccggcgcacctgaaaccggcgttcaacgacggtattgaggtgggcgctgctatcctggttcctggcaccactaccgccacacagctgacccaggctgagatggaggctaacgccatgaacatcaacctggcccacaaggctggtattgatgaactcatcaagcgcaagaccccgctgtcggacatgattaccctggtggatgtcgatacctattcgcgtctgctggagcatccgaagctcctgaacctggaatttggcgcatccaacaacgacggttacaaagaccgccgtgtagttaagatgaacggcgtgcctgtggttgagtgcaccgagttcccaaccgaggccggtacgcacccgctgggtagcgcctacaccgtcacctctgacgatgcgctgtgccgcatggtgactttcagcaagtccaagaccctggtgactgttgaggctaagccgttcacctcccgtatctgggacgatgagcgtgagttcagcaacgtgctggactgctacgcgatgtacaacatcggcctgcgtcgtccggacaccgctgcagtgaccaagttcaccttcaccaccaagtcctaattggaggttcaatggcagtaatcgctacgttcggtctggagactctccaggccaatgcagctcagcgggaggcggttaaggccgccaccgatgtagctaagaacatccaggtggcttcggttgaatctggccgcaaggctaccaagaaaacccgtaaggcggctgacgtagccgctgatactgcggaagagtaatacgcgcccctggtgccttcgggtgccaggggctttttttttgtccctgtcttaaaggtccaaggggtctttaatagaggaacaaatatgagagaattagacgctgttaacctgacgctggaagcccttggggagtctcgcgttatggacatcaacactagtaaccctagcgctggattagctcgctctgcactcgcacgtaaccgtcgtgggttactcagcacgggattctggtttaacgtggtagagcgtgaagttacgcccaccaccgacggcctgattaaggtgccatggaaccagctggctgtatatgacgcctgctcagaatccaagtacggggtacgtgacgggaatctatacgacctggtagagcagaaccaatacttcgatgcacctgtgcgtattcgtgtggtcctggatttggcctttgaggacctgccggagcacgccgctatgtgggtggctaactacaccactgcgcaggtatacttaaacgacctgggtggcgacagcaactacgctaattacgcacaggaagctgagcggtacaagagcatggtgctgcgcgagcatctgcgcaatcagaagttcagcaccagcaagacccgctttgcacgcagaatccgccgtgctcgttttatggtttaaggagagtatatggcccagtccctagagggtaccattcagagcctgctgcagggcgtctcccagcaggttccaagagagcgccagcccgggcaactgggggcgcagctgaatatgctcagcgacccggtttcaggtatccgccgtaggccgccgggtgagattgtctgggaaagcacaatcgatagccctgggcttgattccctgttcactgaatacgtagagcgtgggactgacggtaggcacctgctgattaacaccagcaacggtaactggtggttgctggctaagaatggaaagaccatccttaattccggcaatgacccgtactttgttaccaccgtaggccagacctctttgcagaccgcaagcattgccgggctgacttatatcctgaatacggagatggccccgaacacaaccgtggacaatactgggcgcatcgaccccagcaccaccgggttcttctacgttaaatccgcagcattccagaaacgctggaacgtcaccgttacctctgcgggggtggactacactggggactacaccgcaccggctgctggcagcacgagcggtaacgctgaggaggtatcaggtgcctacgttgcccagcagctgcgggactctcttgtagcgaacgggctgccctccgggaacgtgagcgtacgtggtgcgtacctgttcttctacgggttgagcaactgcgtggtatcctctgacgcgggtgatacttatgccgtggtatccaaccagtcacgtgtagaccaggagcaggaccttcctgcacagctcccggcgcaagctgacggggcaatgtgccgtgtaggtacagcctcgtctgagacggcgtggtatcagttcagctacagcacccgcacctggtccgaggtgggggcgtacgatagcatcaccaagattacgaacatgcccagagagctcgccgcggatgacaacatcattgcgcgggattgggaggggcgcttagctggtaacgacgataacaacagtaatccaggattcgtcgagaatggctacatcactggtattgcagctttccagggccgcctggtcctgcttagtggtagctctgtggatatgtccgcctcgggcctgtatcagcgattctaccgctctactgtgacgtcactgctggatacggaccgtatcagcattagctctgcgtctgcccaggattctgtgtaccgcaccgctgtgcagttcaaccgggacttggtcctatttgctaacagcatgcaggcggttgtgccgggttcggcagtacttacgccaactaacgcaagcattagtattaccagcacctacgattgtgacagccgtgtgactccggtaatggcggggcagacagtaatctacccgaacaagcgcaacgacagctacgcgggtatattggagctaatcccatcaccttacaccgcggcacagtacactacgcaggatgccacggtgcacctacctcggtatatccccggtagggtgttgcagatgcaaaactccagcgtcaccaatatggccttctcgcgcatgtctggagagcgtaacagcctgctggtctacgagttcatgtggggcggaagtgacggcgctaagatgcaggcggcgtggcataagtggtcgttcccgtacccaatcctgagcgtacaggcgctggaggatgaggtgttcttgtacatgcaagggcccagtcccagcaacaagcttttgattgtgtctatggacccgcgcgaaggttatcagctgggctcagagtaccgcgaagcctactcggatttgcagaagcaagttcaagtgcaggacggggtgttcactgtcccgtcggtattgcgcccggttgggtgggcggacaactacaaggaagagcttatcctaacgtacctacccagcaaccctatggggcctactgaggttggcatcaaggagattgctggggagaacaccctacgggttgtgcgcggtgtacctgatggcacttatgtaatcgggagacgttaccgtagtacgttcacgctaactacgcctattctacgggaccagaatgacaagctcgtgggaagtgggcatgtgcgcctgctgcgcctggacgtggcagtacgtaactccgggcacttcgacgtacaggtactagacaccccgcgggacgtcaattggggtggggaactgactggtatcttgatgaactcaaaggagctgacgcttgggcaggccctgcgtatggacctggctacgattaccgtaccatgccgcactaacgcagacacaaccgaggtgtcactatttactgacggttctatggaactgaacgtgttggatatatcgtacatcctgcgctacaaccaacgcagacggaggatttaatatgtggtggatggttgcggccatggccgctaagaccgttctggggcagggtgctcagattgaagtgtccaaggccaggaacaaggctgtgattcaacagacagccaaacagctaaacgacatcgcgctacagcgcgcccagtccagggaccggactgaggtgtctctgtttaacattcagcagcagaagctgcaggcacagagccaagtaggactgcaggcagcagcttccggcactatgggagcctctgttaaagacgcagtagccacggtgaacactgtagccgggcggcaagaggccagcgtgcgtgaccagcaggcaactcaggaagagggcttccgtctaatgacagataaggccgtggatagcggcctggctaacatggacatggaggacccctacgataacatgtttaactcgttgttgagtgtcggggcatctgccgttgggcagtacgctggtaacgctgcgtcgtctactgactctggtagctcttcgcctggtagcggagcgtcagctacgcagagcatggcatcctcctatgacttatgggggagtaagggcaatagcccagttcacacctggtaaattaggaggaatactaaatgcctgtgattcaacccagtagacaggggttaaatatcggtggcgtgcaactgcaatccaacgatgttagcttgccgtcaacggtaagtgaagtatctgttgatacctccaaagcaaaacgcctagccgccctgtctggattcgtgcaggacttcggcgtaggtttcgacgcggcagtaaaagaaaacgccgcagccgccaccgtgcgcggcgctatggatgctcagggcgcagtagatgcaatggcctccaaggacgaggctgtacagaagcaaaacatcttcgtgcgcgaagcctatcaggacggctacgtatccgccgcagcgtacgacactctagctaagtggcgcacagacagcatagcccgggctaagaaagctgccgaggcagggctgactgacgaggaattccagcagcaggagcaagagcacgtacagtcaatggcagacaagctcggggtgtatctcccggatatgtccaagcagtctgctacgagtatactgcagcagctccgcgctaccagcatggctaactatacagccttccagaaaggacgtgctgcgttcgccctggcccaggctgaccgtgccctagaccgtggactgagtgcgtccagcgatgagttctatcagcgtctgcaggcaggacagggtgccgccgcgcagatgtctatcaagaccggattagacagtatcctggctgccgagcacttggacaagaacaagaagctggacagagccaagcagtatctggttagcgtagcgcagcagacgcaggacccactggtaattaaccagctgcaggaaatggccaccaaggaactcggcgtcaactccgtggatgtcaacgcggcactgtatcaggagttcaagcgcgcaggtgctcagattgagacacaggcccgtttcgaaatctctgatgcaatacagtctcttgaggggcagacacctgagcagcaagaacagactatgcagcgtattcgtagtcgtgtcattgagctgtcggcatctgatgtacttagcgccgggaccagcatggagttctggaacaaagcccagaccattcgagagaaggcagcagacgcccaagcattgcgcacagcaattactgggaatatgccaagctctactctggcgggcatgttcaaaggggacttagataaggcacgtactcagctgctcaagagctttccggatacccccgaagggaacctgcagctgctggcatacggaagcaacagcaaggatgcgtgggccgtaaacgaggcgcacaagcgtatgtcttcggatatggcacgtacgctgactacgctggaccagctcggtgaagatggcgaggtttcccgcgagaacgtcaatagcatcaacttgtgggcacaggcttatagcaccagtacggacttagggaagatggcgctgctgtctgaggtcccatctgagtggcgtggagtggtgcagaaagctgttacgcaaaacccaaataatgccagtaacactatcttggacgatcttcgccgccaggctcgtaataaggcgagtgggcgctacagcaatatccaaagtaaccccacggacaagatggtagacccaagcggcacggctaactggttcagcttcttcggggatgcagacgcacagcgccaggaagcgcgagctgctatggaagatgagtaccgttatgtgtataaccacaatccggaatcccttgtagggaaggacgctgacgacatcaatacgatgctaaaaggcaatatccaatcccgtaagctggagctggacattgccggggcacctaggcatgtgtatctgcccgctggcacctctatgcaatctatcatgggtgattataagggcgaccaagagcagttcaaggcctccctgcagcagcatatacagaaccaggttcagtatatgtcagaccccagcaacatagagcgtgtagtagtgcaggccgccaccgctggcaacgcaggtcagaacatgaccgtaaccgtgttcgacaagaagggcaccttccagacgatgtctgtgaaccttcgagacgttcagacgactgcgcaggctgcgtatgactcagcactggctggagagatgaagattggaagcgagcaagtaggtgtacgtcctgccaccttctacgaccacgacaacgggcgtgccgtcagcgtacaagtaaatggccgtaactcggtagggctggaaccatcactgtttagtgacatcctagccactactatgaagttcgaagggttccgagaaggcaagggtaagggtagcgtaggcttcggcctgcacgttaactctggcatgcccgtcccccagaaagttaccattgacgacggtatcagtatcctcaaatcctcactggaggagcagtacataccgaacgtgcagaagcaactcaagggacagggtttgactgcctccgacgaggcgttaaaggttatggtggacctgaactatcacggtggtaacggtagctccggccccgtagcagaggcgatggcacaggtacgcaaggctgctaagtccccggtgggggcgtatcagtaccctgtatctgaggcccagggtagggcttggcaagcgctgcggaataccccggcgtacaagcaggcccaacctgggcgtaagaagtacctggaacaaaacctacgtgattggctcttcgaagcaacgcactaaccagaggcccttcggggcctccccttatcaaaattcttttaggagatattatggctcagtttctgaaccaagaaccgaatccacaggaaaaggattctgctaagggcgcaacacttaaatctgcgcctgagcgcgtagattggaacgatgccggggacaacggtctgaacgcactggggcgtgcctcattactggcacaggccaagaccccagctactacagccgcagagagctttgcctcgggtatgggcaacagcatcatcgccgcagctatacgcaaggcctctgccccggcatttgaccgagacccgaactttaatgccaagcagaccctgagtagcgatactcgggctaagctgtacgccccaaatcaggaagagattgagtacctgcatgactccgtgtcagtagaagattacaactaccgcatgcagcagatgcttgagcagcgtgaccgtgaccgcttaatggctgacaacacagtagctgggttcgcgggtatgttggtaggggattccccgttcatcctggccccgatgtctgctgctggtattgctggccgtgcgggcttagctgcacgtaccgctatacgcgctgctgatgtaggtactgcattctatgcacaggaccaactggggcagtctgctgcggtaactgcactgatagcgggcgtagctgggttagaccagctctgggatatgtctagggctgctaaagctgccgccaaggctcgtactgggcgtgagcctatgttcgacccagaagcgcctacaactcgtacagctagggatgctaatgttaccggagtaggagagggagaggaaattctcactaagacactggatgaaagcatccaagtatcgagaaacaataccgcctccgtgaacatgaaagcacagcacgtagttcagttcttgaggaagtctgagcacttgacagcaggacagaaggctattctggacacgctgggcgatgctgtaaatgacattgattttaaactagtagcaggctccgcaaaccgcagccgctacacttatgcacaacaagatttagctaagcggggagagatatccctgcgcgcgcctaagcaagctaacggcagcacctggactacagtcggtgatgcgctgcgcgctatggatgcagatacaagcaaggtggccgtgcacgaactgattcatgccgctactgcgcgcgctattgacagtaatcccgagattgctaaacgcctggaggaagtgcgcgctgttattgcggctgattccaccctgacaccgcgtatgcgatattacgcaagtaatgtgcacgagatgctggcaggcttaggcgacagccctgagtgggttgagcacctggcacgtacgcagtctcccaccggcaatagcatgctccgccaactgggtgagtacatcatgaacgctctgggcatcaaggccaaaggctctgccttggaggatgtactggatgcgtatgaggatgcagttaagtggacagctaaggattatgcagaccaagcccagagcttccgtagtgaggctttccaggacctggcgggcagcactaccctcaacgaggctaagcgtgcacaagctatgctggacggcgctaagaagaagctctccactatgtttgcactgtacgataatatcgcccaaggcaacgaagacttggctaaactgctagtgtcggatgcgtctgcagtaggcggccgtcgcccgtcagtggtagactacaagcgtaacctcactttggagatggatgcccgcgccagcgtagttgaagatgctatcctaggcgcgttgaaggataagggtgtaggggtgctctcacgcttcttccatcggagtaatttccgcgctgagcgggctgcgctggaggaccgcctgagcaagtacctggatgctgcctacagtgctgacgtaaacggccgcgctgtgccggtgccggatgcagagattgctccgctggttgatgcttaccgccgctctggctgggctagcaagtggcacgagcatatgctcaatgccggtctagtggatgatggtgcgttggttaaatccgactactacttcccgcgccagtacagctacgacaagatgcgccaaggtatcgcgcagggtaacactctggacgactaccgagccctgttccgggccgccctgcgggacgtgtaccctagcatggagtcagaggtagtgcagcgtgttgccaaggagatggttgacggtatctacaacggccgtgcgggacagtctggccctatgtggaagcagctgattaacggcatgggtaacgatgaggtcgtcatggctatgcgcagcgctggtgtagaagagtctgcaatccagagcttcctggctggtaacgtacgagaatcaggcagcacatcccctgcgcggaacctgcgtcagcgtactcggttcaacatggacaaagagtacctgattaacggaaagagcatgcgtatgcaggacctgatggatactgacgtagccaaggttatgcacgggtacactaaccgtatgtctgggcgtgtcggtatggcctatgcaggcgtacaggacctggggcagctcgctaagatgattgacgagtccaagcacgtactggcagattctgctaagtgggagaagaccgtcaatgacaccatcgactttatcctgggtggggcacctgctgacgctgggcagcttccggacttgctgcgcgcagccgggaacatggctaacgccactatgctcaagaactccggcctgtatcagctgaccgacactgcgttggctatgaaggagtttggtatggcccgtgtgctgcgcagtatgcgagaccaaccttggttcaaggaaggtgccgtagctatcaagactccggatatggctgcccgcctagacactgtgctgaggggaaatatccagaaggagatgcgcttccgctggctgaatacgtacgctgacgataacctggacctgacccgtcaggcctcctggttcaacgtcactcagaacgttgggcaggctgcacgccacgtcaacggtatgagcatggtgcatcggctgcaggttaacctgaactccggtattgtggcggacgagcttacgcagatgttcaagggtgatgctgaggcgtttaagcgtctggagcgtttcgggcttacccgagatgttgcggaccgcgctatcgctgccaataaggctaacccgggcgccatgttccagccggacctgcagatgcaagttgaggttgtaggggcgcgtatgatggactacctggtacagcagattcgtactggagagacctcacactttgcacagttcaaccctatcggcaaagtcatcgtagggtaccagagcttcgcactggctgccactaacaagattctgcgtagagagctgaacgatgctgggtggattggtgtagcccacattatggcataccagttcccgttgatgctgctggctactatggctaagcatggcatggatgggaaggacgtagacacccagaaactcatcagtgagtccgtaacgggtatgagtgccatcggcgggg

SEQ ID NO: 51 - DNA, 43626 bp, Unknown
  source: /note="Description of Unknown: MCoc15c Bacteriophage Sequence"
gggcggacaactacaaggaagagcttatcctaacgtacttacccggcaaccctatggggcctactgaggtcggcatcaaggagattgccggggagaacaccctacgggttgtgcgcggcgtacctgatggcacttatgtaatcgggagacgttaccgtagtactttcacgctaactacgcctattctacgggaccagaatgacaagctcgttggaagtgggcatgtgcgcctgctgcgtctggatgtagcggtgcgtaactctgggcacttcgatgtacaggtactagacaccccgcgggacgtcaattggggcggggaactgactggtatcctgatgaactcaaaggagctgacgcttgggcaggctctgcgtatggacccggctacgattaccgtgccatgtcgtaccaacgcagacacaaccgaggtgtcactatttactgacggttctatggaactgaacgtgttggatatatcgtacatcctgcgctacaaccaacgcagacggaggatttaatatgtggtggatggttgcggccatggccgctaagaccgttctggggcagggtgctcagattgaagtgtccaaggccaggaacaaggctgtgattcaacagacagccaaacagctaaacgacatcgcgctacagcgcgcccagtccagggaccggactgaggtgtctctgtttaacattcagcagcagaagctgcaggcacagagccaagtaggactacaggctgcagcctctgggactatgggggcctcggttaaagacgctgtagccacagtgaacactgtagccgggcggcaagaggccagtgtgcgcgaccagcaggcaactcaggaagagggcttccgtctaatgacagataaggctgtggatagcggcctggctaacatggatatggaggacccgtacgataatatgtttaactcgctgttgagtgtcggggcatccgctgttgggcagtacgccggtaacgctgcgtcatcttctgactctggcagctcttcgcctggtagcggagcgtcagctacgcagagcatggcatcctcctatgacttatgggggagtaagggcaatagcccagttcacacctggtaaattaggaggaatactaaatgcctgtgattcaacccggtagacaggggttaaatatcggaggagtgcaactgcagtccaacgatgttagcttaccgtcaacggtaagtgaagtatctgttgatacctccaaagcaaaacgcctagccgccctgtcagggttcgtgcaggacttcggcgtaggtttcgacgaggcagtaaaagaaaacgccgcagccgccaccgtgcgcggcgctatggatgctcagggcgcagtagatgcaatggcctccaaggacgaggctgtacagaagcaaaacatcttcgtgcgcgaagcctaccaggacggctacgtatccgccgcagcgtacgacactctagccaagtggcgcacagacagcatcgcccgggctaagaaagctgccgaggcagggctgactgacgaggaattccagcagcaggagcaagagcacgtacagtcaatgtcagacaagctcgggatgtatctcccggatatgtccaagcagtctgctacgagtatactgcagcagctccgcgctaccagtatggctaactatacagccttccagaaaggacgtgctgcgttcgccctggcccaggctgaccgtgccctcgaccgtgggctgagtgcgtccagtgatgagttctatcagcgcctgcaggcaggacagggtgccgctgcgcagatgtctatcaagaccggattagacagtatcctggctgctgagcacttggacaagaacaagaagctggaccgagccaagcagtatctggttagcgtagcgcagcagacgcaggacccgctggcaatcaaccagctgcaggaaatggccaccaaggaactcggcgtcaactccgtggatgtaaacgcggcgctgtatcaggagttcaagcgcgccggtgctcagattgagacccaagctcgtttcgaaatctccgatgcaatccagtctctcgaaggtcagaccccagagcagcaggaacagactatgcagcgtattcgtagtcgtgtcattgagctgtcggcatctgatgtacttagcgccgggaccagcatggagttctggaacaaggctcagaccattcgagagaaggcagcagacgcccaagcattgcgcacagcaattactgggaatatgccaagctccactctggcagggatgttcaagggtgacttagataaggcacgtacgcagttactcaagaatttcccagacactccagaagggaacttgcagctgctggcatacggaagcaacagcaaggatgcgtgggccgtcaacgaagcgcacaagcgtatgtcttcggatatggcacgtacgctgactacgctggaccagctcggtgaggacggtgaggtttcccgggagaacgtcaacagcatcaacttgtgggcacaagcttatagcaccagtacggacttagggaagatggcgctactgtctgaggttccatctgagtggcgtggagtggtgcagaaagctgttacacaaaacccaaataatgccagcaacactatcttggacgaccttcgccgccaggctaggaataaggcgagtgggcgctacagcaatattcaaagtaaccccacggacaagatggtggacccaagcggcacggctaactggttcagcttcttcggggatgcagacgcccagcgccaggaagcgcgagctgctatggaagacgagtaccgttatgtgtataaccacaatccggaatcccttgtagggaaggacgctgacgacatcaatacgatgctaaaaggcaatatccaatcccgtaagctggagctggacattgctggggcacctaggcatgtgtatctgcccgctggcacctctgtgcaatctatcatgggggattataagggtgaccaagagcaattcaaggcctccctgcagcagcatatacagaaccaggttcagtatatgtcagaccccagcaacatagagcgtgtagtagtgcaggccgccaccgcgggcaacgcaggtcagaacatgaccgtaaccgtgttcgacaagaagggcgcattccagactatgtctgtgaaccttcgagacgttcaggctactgcacaggctgcgtatgactcggcactagctggcgagatgaagattggcagcgaacaagtaggcgtacgtcccgctaccttctatgaccacgacaacggacgtgctgtcagcgtgcaagtcaacggtcgtaactcggtggggctggaaccatcactgtttagtgacattctcgccaccactatgaagttcgaagggttccgagaaggtaaaggcaagggtagtgtaggcttcggtctgcatgttaactcgggcatgcccgtcccacagaaagtgaccattgatgacggcatcagtatcctcaagtcctccatggagaagcagtacataccgaacgtgcagaagcaactcaaggggcagggtttgaatgcctccgacgaggcgttaaaggtaatggtggacctgaactatcacggtggtaacggtagctccggccctgtagcagaggcgatggcacaggtacgcaaggctgctaagtccccggtgggggcgtatcagtaccctgtatctgaggcccagggtagggcttggcaagcgctgcggaataccccggcgtacaagcaggcccaacctgagcgtaagaagtacctggaacaaaacctacgcgattggctctttgaagcaacgcactaactagaggcccttcggggcctccccttatcaaaattcttttaggagatattatggctcagtttctgaaccaagaaccgaatccacaggaaaaggattctgctaagggcgcaacacttaaacctgcgcctgagcgcgtagattggaacgatgccggggacaacggtctgaacgcactggagcgtgcctcattactggcacaggccaagacaccagctactacagccgcagagagctttgcatcgggtatgggtaacagcatcattgccgccgctatacgtaaggcctctgctccggcatttgaccgagacccgaactttaatgctaagcagaccctgagtagcgatactcgggctaaattgtatgctccgaatcaggaagagattgagtacctgcacgactctgtgtcggtagaagattacaactaccgcatgcagcagatgcttgagcagcgtgaccgtgaccgcttaatggcagacaacacagtggctgggttcgcaggtatgctggtaggtgactccccgtttatcctagccccgatgtctgctgctggtattgctggccgtgcgggcttagctgcacgtactgctatccgtgctgctgacgtagggtctgcattctatgcacaggaccaactgggccagtccgccgcggtaactgcactgatagcgggcgtagctgggttagaccagctctgggatatgtctagggctgctaaagctgccgctaaggcgcgtactgggcatgagcctatgttcgacccagaagcgcctacaacgcgtacagctagggatgctaatgttaccggagtaggagagggagaggaaatcctcactaagacactggatgaaagcatccaagtatctagaaacaataccgcctccgtgaacatgaaagcacagcacgtagttcagttcttgaagaagtctgagcacttgacagcaggacagaaggctattctggacacgttgggcgatgctgtaaatgacattgattttaaactggtagcaggctccgcaaaccgtagccgctacacttacgcacaacaagatttagctaagcgtggggagatatccctgcgcgcgcctaagcaagctaacggcagcacctggactacagtcggtgatgcgctgcgcgctatggatgcagatacaagcaaggtggccgtgcacgaactgattcatgccgctactgcgcgcgccattgacagtaatcccgagattgctaaacgcctggaggaagtgcgcgctgttattgcagctgactccactttgacaccgcgtatgcgatattacgctagtagtgtgcacgagatgctggcaggcttaggtgacagccctgagtgggttgagcacctggcacgtacgcagtctcccaccggtaagagcatgctccgccaactgggtgagtacatcatgaacgctctgggcatcaaggccaaaggctctgccttggaggatgtcctggatgcatacgaggacgccgttaagtggaccgctaaggattatgcagaccaagcccagagcttccgtagcgaagccttccaggacctggcggatagcaccaccctcaacgaggctaagcgcgcccaagctatgctagacggcgctaagaagaagctctccactatgtttgcactgtacgataatatcgcccaaggcaacgaagacttggctaaactgctagtgtcggatgcgtctgcagtaggcggccgtcgcccgtcagtggtagactacaagcgtaacctcactttggagatggatgctcgtgccagcgtagtggaagatgctatactgggcgcattgagggataagggtgtaggcgtactctcacgcttcttccatcgtagtaatttccgcgctgagcgggctgcgctggaagaccgcctgagcaagtacctggatgccgcttatagcgccgacgtaaacggtcgcgctgttccggtgccggatgcagagattgctccgttggttgatgcctaccgtcgctctggctgggctagcaagtggcacgagcatatgctcaatgccggtctagtggatgatggtgcgttggttaaatccgactactacttcccgcgccagtacagctatgacaagatgcgtcaaggtatcgcacagggtaacactctggacgactaccgagccctgttccgggccgccctgcgggacgtgtaccctagcatggagtcagaggtagtgcagcgtgttgccaaggagatggttgacggtatctacaacggccgtgcgggacagtctggccctatgtggaagcagctgattaacggcatgggtaacgatgaggtcgtcatggctatgcgcagcgctggtgtagaagagtctgcaatccagagcttcctggctggtaacgtacgagaatcaggcagcacatctcctgcgcggaacctgcgtcagcgtactcggttcaacatggacaaagagtacctgattaacggaaagagcatgcgcatgcaggacctgatggatactgatgtagccaaggttatgcacgggtacactaaccgtatgtctggacgtgtgggtatggcctatgcaggcgtacaggacctgggccagctagctaagatgattgatgagtctaagcatgcactggcggactccgctaagtgggagaagaccgtcaacgacaccatcgactttatcctgggcggagcacccgctgacgctggacagcttccggatttgctgcgtgcagccgggaacatggctaacgccaccatgctcaagaactccgggctgtatcagttgactgatactgctttggctatgaaggagttcggcatggctagggtgctgcgcagtatgcgagaccagccttggttcaaggaaggtgccgtagctatcaagaccccagatatggcttctcgtctagacaccgtgctgcgaggtaatatccagaaggagatgcgcttccgctggctgaatacgtacgctgacgataacctggacctgacccgtcaggcctcctggttcaacgtcactcagaacgttgggcaggctgcacgtcacgtcaacggcatgagtatggtgcaccggctgcaggttaacctgaactccggtatcgtggcagacgagcttacgcagatgttcaagggcgatgctgaggcgtttaagcgtctggagcgtttcgggcttacccgcgaaattgcagaccgtgctatcgctgccaacaaggctaacccgggcgccatgttccagccggacctgcagatacaagttgaggttgtagggacgcgtatgatggactacctggtacagcaggttcgtactggagagacctcacactttgcacagttcaaccctattggcaaagtcattgtagggtaccagagcttcgcactggctgccactaacaagattctgcgtagagagctgaacgatgctgggtggattggcgtagcccacattatggcgtaccagttcccgttaatgctgctggctactatggctaagcatggcatggacgggaaggacgtggacacccagaaactcatcggcgagtccgtaatgggtatgagtgccatcggcgggatatccttactgcaggatatcttcctgggagattctcctcgtcactcattagcatctatgggttacgtcacagggctgcttggagcggtgcaggacctggctaccggtaatatggatatcaagaccttcactaagcaggtcccgttaatccaggaattcgcacctacgcgagctataatcaataacttcggagacgattaatatggcattcagctggcaagagcaaatcaagccagctggtacccaggatatccagtgtgatattgagtatttggacaagtcctatattcatgtatatctcgacggcgttgaaaccactggatacacttggaccagctccactaatatcagactaaatacagccttggcagcaagcacgactgtgctgctaatccgtaagacagagcgagagtatctgtacatcgagttcgcaagcggctctccgttcatcgaggtaaacgtagattctcaaaatacccagttcttgcacctggctcaagagctggtagagggcagggctatccccggattctacggggatataagcatgaatgggtatcgcattactaacatagcggacccgacaggccctcaggatgccgcgaccaagaactatgtagatgttggtgatgctaggcttgacgcgcgcattgactcagaacactcagcctgggtatccgccgtgcagacagaggcggctatccggaaggcagtggacgacgcactgagcgcccgtacttccgctttggagaacacctttataagcggggtagagacagttagctacccgtggagcacggtgctgaccgaggatacggacgaagtgactcctggcctagcattcaccaaggctgtagtggagattaacggggttgggcagattcgcggttacagtttcgagattgtagataatacgatactctttgcagagacattacctgcaggaactattgtagccgcccgactgggggtcgacgtaactgcgggggacggattcgctacacaagcatccgtagattacttggccgactccttggggaatttggcgtatctggataaagccacggctgtatctgatgcaacaggtactggagacgtagtggctcaactaaatgcgctgctggcagcactacgcactagtggggtgctaggaacgtaacaggagaaagtatggcaggggcggctaaacgtagtcgcctctcagagctgcaccgcatgttcactgaggccttgattgaagaaatcaagcagtctaaggaagatgaggtgccgctccccgccgcagataagtcagttatcgctaagttcttgaaggacaatgacatcaccgcggatgcagattccgaggagatgcaggaccttcgcgacgagttcgatgacgaactagcggcgcgcagagaggcgcgtaagaaagagattttaaacaagattagtggttcagattctgaggacttactagaaggaattgtctaatggtatcggtgaagactgcgcgaagactgcgcatgctcaaccagaaacttactggttatagcgcgaatccgcgcagtattcccaaagaggagcgcgaggacatcgcgatgatgatggccgcggcgctgagtgacttccgggaatttgcgtacatcggtatgcggttcctgggctttacgctcacggacatgcaggccgacattgcagagtacatgcagaagggccctaggaagcgcatggtggctgcgcagcgtggtgaggctaagtctacactggcagcactctacgccgtctggaggcttatccaggaccaatcctgccgtatcctgattgtgtccggcgcggagaagcaggcgtccgatgtagctaacttaatcattcgtatgctggaaacctggccgctgctgtgctacttgaaggctgaccctactcgtggggaccgtacttcattcgaaggttacgatgttaactgcgacctgaaacctctggataagtccgccagcgtagcctgtgtaggtataaccgcatccttgcagggtaaacgtgcggacctgttgattccagacgatatcgagaccactaagaacggcttaacgcaaacccagcgtgagcagctgctgatgatttctaaagacttcgcagctatctgtacgcacggggatacgctgtacctgggtacaccgcagaccaaggacagtatctacaaaaccctgccgggacgtggcttcgaggtccgcgtgtggccggggcgcattccgtctgttgaaatggaagagcgatatggaagtacacttgctccttatatcctggagcttattgagcgcggctataaacgcaccggcttcggcgtcgacgggacgctaggcgagagcacggacaccggacgctatgacgaggatgcgctgattgagaaggagctggactttggtccggaaggcttccagctgcagtatatgctcgacaccacactgtccgaccagatgcgtacgcgcatcaagctttcggatatgctggtttactctggcagccaggattcctccccggagacgttctcctacatcgcggaccgccggtacctgtaccagcacgagcatgaggggattatgggtcagcagatgtacttcccggcattctatggggacatgcacctgccgtaccagcataaggtgctggtggtggacccggccggttgtggcggagatgaagtgtcctacgctgctggtggtgctgcgaactcgtacattcacctattctccgtaggcggcttccaaggaggtatcagcgaagagaacattgataaactgattgacctgtgcgtagagttagacatcccggatatggtggtggagagcaacatggggcacggtaccgtgtctatgcttatcctgaaccggttacgggagcggcgtctcgccggtattggtgtacgggacctgaacaactccacgcagaaagagcgtcgtatcatcgacacaatcagcccagttactcgccgccaccgcctggtagtgcatgagcgtgctattcacgatgatatcagcacttgtatggcgtacccccgggataggcgttggctgtactctgcgttcgcgcagctgtccggcatcacgtacgaccgcggtagcctggctaaagatgaccgggcagacgcaatagccatgatggtggctacgctgaacgggcatctggtggaagatgagaaagtggtggctgagcgtgagtccgagaagatggctcgggccttcattgagaacccgctggattgggcacagagcaaagtgtctaagggccttcggggtgtagctgctcggctgcagaaccgcggcagaggtaaacaacatagaggaagaagataatggcatcaatcatcgcagctaaagctgtggatgtacagtatgagattgtgggtaaggcccagaatctggagaagcaagtatctccagactacaacgtgggctttgtcggcaccgcggccctagacactctgaatacgttctttacgtatatggagggtcagggctataccgccaccgcggaaggcgctagcttcgttgctgacggcacgctacaggctcgtctattcagtatgctgtcgcagctgagcaagaccggctacgttgcgctgactggcactggtatgccattgggtgagggttcaggtaccgactttgatacctcattcaccgccctgcaatctgcatttgaggctgctacagtagcggcagaagctgaataataaaccaaaggagagtacacatggcaattgcaaaagcaaccccagcgcaacagcaggagctgctgcgccagctgaacattctcggtaaggacctatatgctatccttacgcagccgcagaacgtggcccagaccggtgctgccttcgataccaagattgctgcacttgaagccgcggtagccgcagtgaaggcggcaagctaatgcgtaaactggtcgctgggttactgctcgcggttactttgactggttgctcggcgacctctgcactcaccggcttagttggttctaagccggatgtatctgctcaggttggtgccgaaaacaccaagcaaaccgttggcctgaacaacaaggtggactccagcaccaccaacaaaaccgatgtatcagattctaacgtaggcactttggatacgtccagcaagaagcaggtgcaaactattagcacggggacaatccaggcagaacgcttacaggtagttaacaatgatagttacagtcttatcctcgccggattagctggggccagcattcctctggtcttcctagtggtcattctggtgattcgtaagctattcaggaagaaggggcagcaggatgattaaggtaggggacatggttgggccggacctcgctacccgggcaggcgcagcagttactggcgctacggtatcaggaggttggttggcagagttaatgagctggaactggagcactatcagcttcatcactgcgacggtgtgcgcggtgctaaccctggcgtggaatgcgtattacaagcggcgtacattcaagctcctagaggagcaggcacgtaaggggactattaaatatgagtttaaggactaaggttattgcggccctcacgggggccactatgctcggaggcgccattaccggcgtagtgcagcacaacgagggtctgagccttaccacctacaaggatagcgcaggtgtccccactatatgctatggcgagacaaagggcgttaaaatgggccagagagccacgctgagcgattgtcagaagcagctaatacaatcagcaggggaacacgcaaaggctcttgacgggcttcctatgcagctctctgacgtagccctggttgggtctgtagacttcatttataatgtaggcgtagctggcttcaacggtagcgccgtgaagcggcatctcaagagcctggattatgcagcagcagggaaggccgtactggactggcgctatattagcaaataccagcagaaatcccccggcaccggttgggtgtacaagggcagcaaccgctggaccttcgactgctcccagtatattaatgggcagcgcaataaagtgtgctggggcctatgggagcgcaggcagtggcagagcaaagccattgggaaccagtacaagaatgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgtccggattcttctggtaactatgcagccgctattgagcggatttccgctaaaggtgtaaaggtgctgcgagtacctgtggggtcttattatgttggagactgccaccttactaaccctatgctgtttataggtgatggcctagagggcgttaacccgcttggggctgtattcgttaaaccgagcacagccagtaagatgttctactttgacggtacgagcacccgtggaatgggcggcgggttccttagaatgcgactgcagggggctgtcagcagtgattcgggacttatggtggaggtaacgtcctggagctattttggggcggaaaactctgcttttaataacttggcgggctctgcgctggtgttgcgtgactgtatggagagtcacatctccggaaacttattccgtaggatgggtgcctctaacggcagcgttatactcctcggggattacataggtattcctaataataacgtcaataacctgcacattcagaataacacattcgggttgtgctctggtgcgtggattaagagtacagcaaacagtaacccggacctggtgtggattacggataataagtttgagtgggatagtgtaccgtacggagctaacacaaccacgcagcacgtactagactttggacagctgtcacgctcttggattacccgtaacggttttgcgcacttccgcccagactccgaccataacctgtatgccgggtgtattcgtattaggtctggagctgttggtcctattgttatttctgataacaaggcgtatgggtgcgaaggagaattctggaccattgaaggtggttatgtagatgccttcgacaatgatgcgaacattgcagatgccagcagtgttctatcctggtcactgagtagtactagggcttgccgcatcaaccctcctcgcgtatacagtgggaacatgaacgtagtgcgcggggatagtccgttcggccctgggtttatcgggcaggcgtacatgcgcggggctgctgctgctagtcgtaccgttagggctggagccgctagtaccgtggcactagatgtccctgcgggccaggagatgcgtcggtaccagttgccactgcaccttctcggggctatagtgcgcgtatccttgcgagtctacaatcccggcgctactggtaacataaccttagcagtgggtagtggcggctcctctgttgctgcggtaccggctggtccagggtggttcgatgtagacttttacttgggtaacagcctaactggggacggagatttgcgcttcaccaacagcaccggaaacacactgagcctggatggtattacagtagagcgtgctcgttctgttccatttagctttgcgtggaccccaggtgctgtcgctgctggtacgctggtatctagtcctgtgcaaaccctgccgtacggcattactcaagcccctgtcggtttgagttctccggtatttaacgggtctgttgatgggctgctagccggtatcagtagctacagcgggtacagctcctacaaagttactctgtttaatcctggggctactccaattacccctggggctactcgggctagcttggtgttgcacttctaatgcacagcgtaaaacccaggcccagtctaggcgagcaggtctatacctggacctgaaatttattagactcacgcgagcccctccctcaccctcaacgcgcccaattgcccccatagggggtgcctagcgtcaatttagggggggggggcactgctagggcctgctagtgcgcaccagcgggcctcagcgggcctgtgctgcgttctagggctatcgctagtgctaccctatggctatccctgtgcgttcactagggcgcttcctgtgcgctctacggggcgctggggctatccctgtgcgctccctgtgggccataggggtgcgccatgccttgcttattttgtgcgtccattgcgggcctgcctagtgcctgcctagtgggaccagtagtgccgccgtagtgggccagctagtgcgctgtagtgctatccccggtgctatccctagtacgcactaggctatccactggctatcgctagtgctttacattgtgctgattatatgctacgctgcgcgctccccactagggcgcacttccactatccagcgctctcccaatgctatccctttgctcttactttcattcgaaagctattatgaaatgaagtaaccggagtaggaggggtttagggacactatatacactactactcactatgcactccctagtatgtccctgtgcctacgcagtaggctgacatacctacacagtcaccgcatcactacgtggcttcactctcgttacgccactgcgttctgctctttgtagtattaggtagtattggctcgtaatggctagcagtggctacagctagtgccagcatagggctatccctgatgtggttctaagtatttaccctgcttaccctttttgctcccggtgataaaaagcttaaaaaagtgcttgcttcttttggttcaatgggtctatagttcaatcaccgggaggcgctgaggtgctaaccggggccgagccgggaggctccgctggattaaagctagatagtgcgaagggttagacactcgataaaaagagttgacaccgcgaagggcataagctagattgagtccaagcagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttctgattcactgagtaacttagatagcaagcagtaagctggttcgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccctaccgataacgtgccgcttactgtgaagcccagcaaacaagggttgagcggtgagcacagggtgaggggaaagcaaaaacaaaagggcggcagtaaacagcctagtgggtggcctactgttaactcccaatttgggcactaattacagcctatagcatcctatggggtgctatgtgaagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactatgcgtcttgactacaaacaagctgacaagcagggccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggaagtggcctagtagcaagcctatagcgtcctacggggcgctatgtgaatgcaactggcgtatgaggtttcatatgaaagcaatactggtctatccgggccatgaactctggcccgtgtggtgcaatcggatatacgaagaatacagctacactgtggttatattctctgacaaagacactaatcaggaatcccctttagaatttgtggatacctacaccgaaatggctgcccgcactgtgctggacgccgtgaatcttggcattatcaacgactggagacaactttatggttaacgtgttcaacatcattgtgaccagcgctatgctggtgctgggcaacgacgtaaacaacccggtgccctattgcacagtgcagttgcagcaaccggcggcgcagcaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtagggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgctaccggtttaatgtaaggggtattgtatgagcaaacagaacctgtacgacgtatacaagcgcccgaatgggctgctgtaccgggtgccgctgcgcagcccactgcataagcgcgcggagttctatgcaaagcatttgcagcggtggataccatccgggcacaaggttggtgggttaatatctagcgaccgcagcgccatcgtagcccgcaacgtggtgttcaaggacagcgtatgctcacagtagacgaaacagcgctgctgtgctggcgtctgctggaaacgcagggcaagtgcggctgcacttgggagacattcaaagaggttcctaatgaactcaagcaaatcgtgccagttgaacgtcgactactccgagttagaaaagagggggttggcactgtgctcacaacctaccgggagtatacagagtctgccgcgcggcggttgcaagagcacattcagttcgatgtggttgcggctctacggcggtacgggtatcgtggagcttttacgcaatttcgggccgcagtccgggcttattacaagcagcaacaactcgctgcgtggtacgcacgctgacctcgttattactgacgaactcaaagaatctattcaggagcaaatgaaaatgcaggaaactaacacagcacctatcgaatggaaagtagtattaccggaaggtgcaaacgcactgccaatgcgggggtcaatgtattcaagtggtgattactggacccctttcgaggacttgcaaatgcgaggctatgactacccgcacaccgagagcgcactgcaggcgcttatgggtctcctcaaagtcagcgcaaacaccccaggcttagaggtatctataggtggggcactgcatccgaaatatcgtgccatgtacagggctgccggtccgttgcaacgggtggacttgtgccgttcaggaactttctttgaactgcttgccccggcgcgagtcaccattgacaacaagttctgggaacgtcgccgcgacttctatgaggatggcgacgtagtggttgagcgtgtacttgctagcgtagaagcattcaccggttacaaggtgcacaagcaagccctgcagttattcgaacgcattatgcttgcgccagaagagcagcagcgccaattatacactggctacgattacggtagccacatcagagacgtgcacgccgtgggtctgctcatgaagctgcacggtttcgtagtgtctagattcgctgttccgttgggcttcggtttccgcaacggcgagcccatcgtgatgctggggcagccgcggatgcacaaggatttcgctgcggttactgagtaccgctgcgtagagatgcgcgtaggtaagtggctcgccaattactacggcaacggggttgacttccgcgacgccatcgaagacctcaaggctatgaacgtagagcctacaacgtacctgtgcaagaccgagcaggaatggtatgacgcctacgagaatggcccaagtagctgcatgagcgggtactcatttgagcacagccctgtgcgggcgtatgctacaaccagccacgggctaccagataacgggctgcgcctattcatccagtacaccggggagctgttcggggacgacttcgaagtgcaggcacgagcaatcgtaaaacctgaaaccaaagagtacgtccgtgcttacggaaacgctgcggatgcaatcctgcgggggcatgggtacaccagaaacactgaatgtctcgagggggtaatgctggcgcgcataccgcacccaacctacaacggcgcagtgctgatgccatacctagatagcagccagtgcggcgtagatgagtatgaggatgatgcctttgtaatccgtgacgcctacgagtacgaggcgcaggaatcagaagggtacatttacgttggcgcagagtctgcccggtgctgctgctgcggagcgcgcttctccgtcgatgacatgcaggaaaccgcaggtggtgatatggtctgcgacggctgtgtagaagatggggactttgtatacgcagttggccgagaagggctgcataatcgctggagctgtacttggtctgattaccacgacgcctatgtatatgacgcggacattgagcactgttcggtagaaggggtagtgcatgaccaagaagagctggtgtttgcacaggaccggcaggtgcttattgagcacgcagaagaacacccagtgcacgggttaattctcactgagcatgcagctgattgcttgggagagaagtacctgggcaacgatgacgaagaagtagaggaggcagcttaatgttcttgaatccgcacgggattgatatgcagctgctcttgcagatactgcgaacgcaccggcctagctgggcaagcactgagtggtttgagccgctgcttatgcaagcgctgggtagtggtatgcactacgtaaaggacaagcacgggaactacttcgtgctggtgggggactcagagcaaagcgacgtagcgtttacgtcgcacctcgatacggtggcccgtccaaccagcgctgcgccggacgttggttgtactaacaagggcgtactgttcgtaaagaatccgcagcaagctgactgcttgggtgctgactgtggtgccggtatctatctgatgctggagatgctgcggcggggtgtgcacggacgttactgcttcttcgtggatgaagaggtgggctgcgagggtagcgctgcatcggtcaaggatgactctggattttggactggggtcaaggcgatgattagcttcgaccgccgcggcgacggtatcattacgcatcaaaggtatatgcgctgctgctctgacacctttgccaagaccctagcagagcgcctgggacgcacggagcagcacttgcagaagggtgtgtatactgactcagccgagttcgttggcatcattcctgagtgcaccaacgtcggtgtagggtacatgcacgagcacaccccggatgaggtactggacctgaacatacttgggcaagtgcttgagcgggtactgcaagatggtacgttcaagcgcctaccgattgagcgtgacccgaaggtagtggagccggaccagtggctctctgcatctacgctcagtttacggcagccgtgggacctgccaccggacgaggacccgcaattgctggctgcgttccgcgtagtgtcgcagctttctaaacaacaactggttagctgggtgcaggagaatccagagaaggcggcggagtacataatggtgttctccgattacggctttaaagaagagctgattgaactaggcacccgagtcgtagaagactggggcggatacgataatattgtggagggttgattatgtctaagtttaaagttggtgataaagttgttcgcaaagcacacaaaaacacttcgtcgttcaagtcgtacctaggggattttgcttactacgtaattacagatataactacaagcggccactggctgcagttggataactttacagatgggggagccgacccctacccgtggtacgcctataacttcgagctgtatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatgtcggttaagcgcgagcagaagtaatggaccagccctggcttagagcgtgcaagcgcctggccgtggggcagagggcgcgctttcggtgctgcggcagggacgccgccggggtgctctacaataacccggatgcatgggaatattattgccaccgctgtaagcaggtgggcaaggagcacaagcagtaccagcgcatacagttacaggaagagccgagggtgcagccctctgcacctgcagatgcaatttgcattagccaagcgcctgcggaaacgcagagttttatttacggattcctgaccacaaagggaatcatgcctgaaatggtggaggatgcagaatggagcaaagagaaacagcggataatcttccgtgtcggaagcgctgctctgggccgtgcagtgcatgcccgacaacaaccgaagtgggtaatgtacggccatccggtaccgttcgctgccgcggcacctgccgtagcaccggctgtagctgcggccgcgcctctaaaggtcgtgctcaccgaggactatctatcagcccggaagatacagcacgcagttacgagctacagtgcgttgaacgtgcaggctatagctatgctgggtacacgcttgcccacgccgctgagggcttggctgattcagaatcgcccggaagtggttctgatgctggacaatgacccggctgggcacgctggggtagcggcagcacgccgagcattgcgcccgttcatgcagtgccgggagcattacttcgctgcggacccgaaggacgcagaaattaaagagattctggaggctatacaatgcaaccacatatccagagggagctagttaacaaactaagggacgcggcggtgcgctatcatgggacacaacagcttcgggcagtaatagctagactggtacaagaggcgcttgaaggaggtaagaattggaccttatagttgttcgtgcgatgtgcacgcagaaagtgtggactcgcttgcgagagcagattcctaagtcgatgcttgcgccggacacttcgaaccttctggactgggtggggttgtactggaacacgtacccagagcaccaggaggtgcagtgggatgcgatgcagagcatgctcaacctccgggcggggcacttatcccgggaagagcgggtaatcatggacgagcttatgcggggagtacaagccgtgccgcaggattctgtggtggggattgtccaaaccctgaatgagctggcctacagcggggaggtagcggcgcttacgcagcgctaccaagacggtgaggagattgattacctcctggagatgaagcacctgcagcgcaagtacggtgatggcgctgcggtgcatgattcgctgcttgaatgggagagtggtagtgttgacgagatacttgccgcgactgatgagagcggcggtcttaaactgggcgtgttcgagcaactcgctagcaacatccgaggtctacgtggcggggactgtatcgcagtggctgctcctgtggactctggtaaaactagtctgcttgctgctattgctgtggattttgctgagcaaatgcagcagcagccggaagtgtacggggaccgccctatcctctggttggttaacgagggcccagcgacgcgcacagtgccgagggtatatcaagcggcgctgcattggactctggcggagattaaggaccggcacagtaagcaagagttcgtgccagcctacctcaagaaagtaggcagggctgaccggattcgtgtcaaggctgcgcactcattgacgatggcgcagatatccacgctcatggaggagatgcgccccgcggtaatcatcatcgacatggtggcgaatatccgtggcggcactatggagagtgagcaccagaaccttgaggcgaaatggcaggagctgcgtatccttgggtgcgagaacgactgcgctattgtaggcactatgcaactttcactcgaaggttacaacatgctgttcccgccactcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgcttatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagcggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgaattgggatatttggtttacctacaaagacggcaaactctactggaagcacgaggttagaagtgggcgcggacgcagccacctaaactgcgccgcaggttccgaggcaggaactctgaacaaagtacatggatactggtacgttaagctgcataataagctatacaaaagaagtttgatagtatatgagatgcacaacggtccgctgcgagcaggccaccatatagaccacataaatcataacaggttagaagataccccagataacttgagggcagtgcttcctgagaagaacatgcagaacaagtccctgtatagaagcaaccgcagcggctatgtaggggtgcacaggaagagaggtcgttggatagcaaccctaggaaataaacaattaggttcatttagcagtatagagcaagccgtagagtgtcgtagactggcagctgaggcggcggggtatcaccataatcacggggttgcagtatgactagcagtattatgactatagaccttgaggtcgagaataatccttactatggtagcaaggctagcccctactgccctgacaactatgtagtgcattcggcctaccgcatagaccggaccgaggatgacggcacagttaccgtagaaccgacctttgatatcagattcaacagcaagcaggaattccttgacgacgtagccggggagcatctgtggttccgcataccttctgattgctggtgcatcgtggcccacaacgcagccttcgaaattagctggtttttaacatatcagcggcaacactttgaggaattcctaaagcgcggcggccgcgtattcgacacaatgcacggggagtatattgtgtctgactttcagagtatgtacccatccttggatgaaactgcgccaaagtatggtggggagcataagattgatggggtaaaaatattgtgggaacagggtgttctgacctcgcagatagaccccattcttctcagggattacctagtcaatggtgatataaagaacacggccctgtgcttctacggccagtgtgctacgttcacccagcgcaatcagatgcagtacgtgtgggagcgtatggatgccttgctggcttgggcgtactgcgaatggttcggcctgttcgttaatatgccaattgcgcgcaagaaccaggaggagcaggagcagcgcatctgtgagattaagcaggagctgcagcagtatatcccgaaggacctaccggagactctggatttcaacttcggctcggactttcatatgtctgcactggtgtacggcgggcctatcaagtatcgcaagaaggtgccctatgaccctccccagtacgtcaaggccgactactggcaagtcggggacacttgggttgccgtggatgacgtgcccgcaccgccaggtgcaaccacgtacaagtccggtaagaacaaggggctaccaaaagtattccgccttgatacagaggaggagaaacttaagtgggaggatgacctttacttctgcccgggcctagtgaacatccaggagctgccggaagttatccgggagaagtatgcggagcgtggagagttccgacaggcgcgcaccctgcaggacggtacgccagtatacagcaccagcacagacgcaatggaggcgctggcccgccaagggttcgagttctgtaagttggtgaatgagctggcggcgcttgagaaggacaccggtacctactatttacgggaagttctggatgcaaacggagaagtcaaagagcggaagggaatgctgcagtacgtaatacccgaacgcccagatggttccggtatcatacaccaccggctgaatacttgtgccactgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcttgctacaggcaggtacggatatgcactgttaccgcctcgctttccgcgagggactgccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtacacgatgcattgtatctggacagcgccaacccggaggttggacgtgaggcgagcctgctggttaagcagtgcatggaggatgcacctaagcgtatccaccagctctggcctaactacggtatcattggcgaggtgcccttcccggcggaagctgaaatgggtacgagcatgtacagtaaggagaaggtagaatgaatattaaacctggcagtattgtggagatgctggaacttgggccggagcctatcgacccacgacatcgtgcctactttgcaccgggtacgcagcatcgcgtgatatcttacgacgttgaattcggcgaggtggagctactcaatccggacagcaactcagagaagcctggggacggcatcaccttcttcgctggagagtacaagctcatcgcggagtagtgataggtggacccttgggtggtgtagggggttagggtagcatggaaatatgctagggtcaactaaataattaaataaaattatttgttgactctggcttgattctgtgattccccgagaattaatgtgatacgagtaggaacaacacaagagaggcaaccttggctaaagtaagtctaatcaaactgtggaccaaagaagagcaccaacaaattcttggcagtttcctaaataacactgatgcagctattgcgtacaataacaaatttcgcaggggggacgtaatcgtgtctcgccagcttgtacgctactggcgcagcatcttcatggataacaagggcagcaaggccagtgccaaccgcgggctgcaggaggcgcgtaagctaatccaaccaagcccaacggacgatatcgggaatacaaaggtgccggatatgtgccaccgcattctggttgtcggggacctgcacgctccgtatacccacgtagacgcaatgccgttccttgagagcgtacgtgatgcgtactgcccggacatggtagtgcaggtgggtgacgaaaccgacgggcacgctatcagcttccacgactctgaccctaacctggatagcgcaggggtggagctggagaaagccaagctcgtactggaggagctgcatgaactattcccgaacctgctggtttgcgattccaatcacggctcactcgtatatcgccgcgctaaagctcacggtttgccagtgcaatttatcaagaagtaccgggacatcttattccctgagcatggtgctccggcgtggtcgtgggccgacgcttgggtgctcaacacaccgctggggcctgtccgtttccagcatcaagtcagcggtgatttcatgctcaatgcatcccatgagcgcacctctctggtgttggggcatgagcatggacgcttcgaggttcagtatgctgcttcttcaacggcgctgtactttggtgcgtatgcagggtgcttgattgaccgcaagagcatggcctttgcttatggcagactcacccgcaagaaaccaatcctgggtgtgatggtaatcaccgagggttgcccgcagttaattccgatgctgctcgacgacgatggtcgttgggtagggagaagcaaatgaatgtactggattcaactgtcacccgagtagatgctcctgtatgggatgagcaataccaggtgtatcgtgtaaccctggagtatgactgctgggggcacaaatctgagacagagcggtggtataaagatgaagcctcagctcttagtttaaaagttggtgacataatcaaaacctaattaggagtgtcgatgaaaatgggaatctgttctgtactgggccttatctttgtaaccctgaaactgactggcgttatcgcctggtcctggtggtgggtactgcttccgttctacggcggtgtagctttgctgttggcaatcctggcggcaggcggtgtggcagcagccgcggctgcaggcattaaatccgcacttaagaatcgctaggccggacctgcatctgcacgtaaatatcatttaaactaaacgaggacgtaattatatgactacgaatgtactggcatccctgaacgctctggtagacgcagcaatcgaaacccaagatgtggatatgcgggaaaccgcacagggtggtgcgtacgaggacgtgctgctgccgaagggtgaatattacggttacttcaccgagtatgtggaaatcggtaagcgcctgccgaccaagggtggtaagcctaccggtaagcctgcagtggctaacgtacgtatcggcattgtagtgttcggccccaacggcgaagtgaagcgtatccgcccgtacccgatggctatcagtaactttgagcgagcaggcttcaagaagttcttcgacaagctcaactacgacaatagcattaagcatgcagcgcagcgtctgggccaggccttcaccttcccgattgatgagcacaccagcgccgcgggtaagaagtcgaacatcgtggacctgtccggtatccgcccgattcctaagttcgacccgaacaccggtgaacctattaagatgccagcgctggatgcctccgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcgccggcagccccagctgctccagtggctcctgcggctcctgtagcgcctgtagctccagcagcgcccgctgcacctcaagcctaataaaccctaatcgaaactaatacggcccctcctggggccttagaggaagcctatgaacatcatcaacatccttatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctaactctcacgcatacagggcaagccttctgggtcccgagattagtgcgcagcgttatcacttgaatcgccagtgcgccaagtcccggcgccgtgcatatgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggatatgttcctggtcggctgctcagaggcagtggcgtacctgacgcctgcaggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatataccgacaggtacagtgtggcctgcactggaggacccattcggatggattaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgatgggaaacacgatgaacttgaaactattctggatgcgctgcgtgaacgagcacccaaaacacatcgaagaacggttgagcacttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcgtatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggccagggcacgacgcaaagcacgggagactgttaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggggttcttccagctcttccattcgaagagcgaggctgtttctgactcagtgaactctcctcggcactaccagttcttcccggacctggaggcaatagaggtaattgcacgcagcatgacgcaagagcagttctacggctattgtctcggtaacagattaaaatacagactctgcgccggtaacaaggatacactggagcaggacattgctaagtccgataagtacccagaactgtatgagcaacaccgaggtaagtgcattgacgcttagtgcatggtgtcatgagatgtggcagagggtagtagagcggcgcgacaaaaagcacggggaggggctattaaatgaagacagtaatctttgatttggacggtacactagctgatggcgcgcaccgcttgcacttgctgcctactgtggatttgtatctgactgacagttggaatgagttcaaccgggcctcgaagtatgatagccctatccacagcactattgaagtgtgcaacatcatggtgcgggcagggttgcgggttattatcttgacggggcgctcggatatagtaagagcggaaacagaggcctggcttgagcggaacttcgttatgtactccgagctggttatgaggccgcacagcgacaaccgaaaggatactgtcatcaaagaggaatttctgcgtaaccaagtcgggctggaaaacattgtggcggcttgggacgacagccccgcggtgattgagcatttccgcggactgggtattaccacttacgctgtatgcgactatggtgcagcaacacatcgaacagacttaaaatcccacggggtggaggaattagcatgagtgcagtaggtacaggcatgaagtatgacgcaggcaaacctcgaatggacttgctactggacgggtgcccgaatgcgttgctgcgtatcagtgatgtgctgaccttcggggcccagaagtatgcggcacacagttggcacacggtagccgaaggtaagtcccgatacaaggccgcgctactgcggcacctcacagcacacgctctaggggaaacactggactcggagagtgggttgccgcacctggcgcacgccgcttgttgtgcgttatttattctagaactggagcagatggatagtgcggccgagtgagtggtgccacatgatgtggcagaaagcagtagagcgaggcgacgaacgcggcgctaaaaactacctggagatgtataatctctgggtaagtcgaaatcagtagttagaagtaccggacataaccaaggagactaagcgcctatgattagcgccctgaatacggttgtagtaccagaggaagcactggtgaaacgccagctggagcttgaagagacctataagattcgcggaatcgagcgcgcgcgtaagctgattacggacgcgttgcagaacggtgggattatgaacctgccgatgacgcagcgtatgctcacctcggcatacgaggtggctgctaccgctatcgacgagatgcgaaatgtcaaagccccgggcatcggtggtaagtaccgccggttcctgcgcttagtacccttggatgtcctgaccaccctgagcctgtgcacaatgtttgaggcgttcagtgtcgccccaggcgagtccgctagtcgccgccagactgcacaggcggtaatgtctgcgctgggccggaacgtgcagtcagagctactggctctgcagttacgcaacgtagccccagcgtacatggaccgcgtgtatgagtacctcacagagcgccgtacgaagtcccctacgcacatcctgcgtacgctccgtgccagtgccgagaacgtacactacgggcacgagccttggaccaatgcccagaacatctccgtagggcgtctgctgtgtgccgcagtgtttgagacgggactgttccagtggaagaactgtagcgggaatctgagcatgctctatccggctgatgacgttatggaggccttccagaaactggtagagtccgctgatactgtaaccatgaagccgcctatgctgataccgccggtgcagcacactactctgtgggatggtgggtacctcacccctatcgacaatcgcggaacctaccataacgcgcacattgacagagctcgtctccgtgaagtagcggaagcatttaagtccgcggacggcatcaaaaaagcgcttaataaggcacaggaaaccccgtaccgtattaataagcgcgtactggaactggtgcaagaagcacgggccctgggtgttgggataggtatgcctcgctcagtaccggagccgaaaccggagtggtatctggacggggttccgaaagagaattacactgaggaagagcttgaccgcttcggtgagtggaagacgcgtatgtctctatggtatagcgccgaccgtaagcgtgtatcgcaactgcgcagccttctgactacgttggaaatggctgaggaattcaaagatgagaaagccctgtacttcccgacttgtgcggactggcgctaccgcctgtacttcaagtcctctctgcatccccagggttctgatttgcagaaagccctccttgaatttggtaggggcaagccgctgggggagcgtggcctgttctggctcaaggtgcatatcgccaattgctttggttatgacaaaaccctattcgaagaccgtgcagattgggttgatgcaaatattggtcaaatacgagagttggtacacaatccatttagttcggatgcttttaggtcggccgactcgccgtggtgcttgttggcagcggctacagaccttgttgctgcacttgattctgcgtgcccagaagagtatattagccgaatcccagtggctatggacgctacgaactcaggtgggcagcacctctcagcgctcctgagagaccctgtgggcggtcgtctgacgaacctgtactgggagggtaatgacaagaaagcggacctgtatatggatgtgaagcgccgtacggacgagaaggtgatactggacctggacaaggaggatttcgttatccagagcacttactggagagagaacgaaatcacccgcagcatgaccaagcgccccagtatgacctacttctacagcgccacggtgcgcagctgcagtgactacatctttgaaggcgcttgcgctgaggggtatgaaggtaccgacactaacagtctatggaatctgtcgtgctacctggctccgcgtatgcgcgccgctatcgaggaggcaaaccctgctgctgcggcagttatgtcgtacttgcagaacctagctagacgtgtaccggcaagccagcacctgcagtggtatacgccgctgggtgggcttgtaatgaaccgctacacacagcgtgaagaagtgcgtgtacgtattgactgtatgaatctcactgtcatgcgagtgcataatcgagattttaagacatgcaacaagcgtaaggcggcctccgggattgccccaaactttgtgcatagcctggatagtacgcacttgatgatggtgctctgcgctgcggaggggttggatattgtacctattcacgactcgctggctactcacgcagccgacgttgatgctatgcaccgacacatccgtgaacagtttgtgcgtctctacgaagagaatgacctgcttggggatattactcgcgcagcagcagcagccggggcggacttgacggacctggatatgcccgaggtgggtactctggacatccggcaagtactggaatcgcctttcttcttctgctgataaatgaagttaccggagtaggaatgaagttaaaacacactagtaaaacttccgattacactctcaaggttctgtataagtctgacgacattacagacgcagtgaggcaactgcacgaactgggccacggcattagtcggggcctagctccagagcagcactactggagagtactgggcagcatactgggtaaacagtatatactaggagtctatgactcccaaggcgacttagtcggtgctgtcagctactacccagaagctgtagaggactgtcattacgtagagcctgtgctgtatacagacttcttcgtattgaagccaggtaacagtaaggcggtacttgtgattatgcagggccttcgcgcaatagctaagagtatgcgggctgggcgtatcgccattagccgaggtgcatcggataacacatacaatacaacttatcatttagtgaggtcagaatgagtggtggtttaggtaaactgttaggcaaggccacggatatgctcggccttacggacaacgcaggattagaggcgcagcagcgcttggcagagcagcaggctagcgcagcgaaacaacaggctgccctagaggctaatagcgccgcagataacattgcggagattgaccccgcaggggctgcctctgcatctgcagatgcaattacgtctgagcagaagaaacgacgacaagcagggcagagcaatcctctgggcctgtaagggggtagcttggaacaaaaagcaacattagcagaactctttaagaaggaccaggacgcaggcgtcttggatgcctctgagaagttcgcgcagtggacactcagcactatctttacccgggacgattccctggacggtagacgcaggcctctggagcgtgactaccagagcaccggcgcgcagctggtcaacactgcagccactaagattgtagggtcactgttcccgcaaggcactagtttcttccggttctccaagagttcggacctggacgagttcattagttcgctgggtagtgcagctacagcagaatctaagctggctgaggtcgagaacacggcgtcacagaaagtatttgagaaagacggttatgctgcgaagttgcaagctgtgaagctgctgctggttacaggtaacgcgttggagtatattgatgagcggacaggtaaatccatcgtctactcagtccgtaactttaccgttcgaagggatggcagtgggaacgtcctgcgactcattatcagagagcgcgcaagcatccaggacctgccagaagatttccgcggcaccttctaccgtgacaaagacccatacggcgacgttgatatctacactgccgcttgtcgcaaggttaagcggacagaggaaggcgtagaggtagtaagctacgaggtgtaccaagaagcagacggacaccgtattggggacagcagcacctatccggagctggaacttccatacaacgtgctggtgtggaaccttgttagcggcgagcactacggacgcggcttggtagaggactacgccggggactttgctcggttgtcggtactatcggaagcattaactaactacgaggttgagtctgcgcggttaatcccgctggttgacgcaagttccggtctggatgtagatgagttcgcaacgtcggagacgggcgaggctgtgcaggtgggcggcggtggttccaacgggaacagcaaatcccccgtcactgcttacgagggcggctctgcccagaagattcagtggattgccagcaacatccagatgctcgaacagaaactatcgcgtgcgtttatgtacactggtaactccaggcagggtgagcgtgtcacggcttacgagattcgccagaatgccaaagaggcggaagccgctatgggtggtgggttcagtatcctgagcgacacctggctgcgtaagctggcgtacttgtacactgcgctggcgtaccctcgctttaagctgtacctcagcgaaggcgtagtgagcatcaacgttactgttggcacctctgcactagctaaagccgcggcagcggacaagctgttagaggcggcgcagtccatgcagctggctatccctgtgctggagcagattactccacgcttcaacaaggatgcgtgcgtagactggtacttcgacgcctatggtatcgtcagcgagccgttcatgtacaccgaagagcagctgcagcagaagcaacaggttcaggatgcgtctgccgatacgtccgcaggtctagcacaggaccaactccagggcttgacagcagcagacccgacagtagcaggtaagcagctgggcttattaccaagttaacaaccgaggcatagatggataacgtagaaaacggtcagaacgtagaaactacacaggtagagaaccaaggtggccctaagattccgggcctaggtgctccccttaacgcccctaacaatcaaggcgtgcaggatgcacagacccctacccagcagcaacagggcaaagattcccctgaccctgctaagattcctctggatatcgaagccctaaaagcggccctggataagggtggcgatagcgctaaagagcagccccaggagctggctaagacaggcaacccgacgattgacgccggtgtagctatgttgcagaaagtctctgggttaactgactctgatatggtgcgggcacttggcaaggccctggagtatcaggaccctaacctaatcgatacgaccttcattaaggaacgtttcggagagcacgctgcttatgcagagttgctggctaaagcgtacctggaagaccaggttggtcaagccaccaaagcagtacaggaagcttacgatatcgtgggcggtaaggagaactgggaggtagcagcgcagctgtttaattccaaggcccctgaacctcttcgtaacgcggctcgtgtactcgctaactcgggtgagctcaagcaggccgctgagttggtagcaagcttctgccgggatatgggtcttatcaagacacagaacccaatggtacggggcgtggccagcaacaatgcactgtctgctgcagaattccgcgcagaatataccaaactccgtcaggaagcgggcaaccgtagcttggcgtccccacagttcagtcaacgttataacgatttgctcgcacgccgtgaagctggtaagcgcgtaggtctttaattttatttataaaggaaactaaagcatggccaacactatttataatggcaacctgactcgtccgcactggggcggagcggcgtctgacgtagatattcaccttgaagtgtatcagaacgaagtggatacccgcttccagtaccaggctctgttcctgggcctctccagccagcgctctatcagtggctctaacacctaccgtatcgaccgcctgaatacctcctcggtgaaaggtcgtcgctccggtgaggcgctggatagcactccggtccgtaacgataagatgattatcgtggtggatacggtgctgtatatccgtaacccgattgactaccaggatgactggaccggtccggacttcctgaccgagatgggtcagaacaacggctctgagttcgcagagaccttcgaccaggcgcacctgattcagctcatcaagggccgctcctgggttgctccggcgcacctgaaaccggcgttcaacgacggtatcgaggtaggcgcagctattctggttccgggtgccaccccttccacgcagctgacccaggctgagatggaggcgaacgccatgaacattaacctggcccacaaggctggtattgatgaactcatcaagcgcaaaaccccgctggcggatatgattaccctggtggatgtcgatacctattcgcgtctgctggagcatccgaagctcctgaacctggactttggtgcatccaacaacgacggttacaaagaccgccgtgtagtgaagatgaacggagtgcctgtagtagagtgcacggagttcccgaccgctgctggtacgcacccgctgggctctgcttacaccgtcacctctgacgacgcgctgtgccgtatggtgactttcagcaagtccaagaccctggtgactgttgaagctaagccgttcacctcccgtatctgggacgatacgcgcgagttcagcaacgtactggactgctacgcgatgtacaacatcggcctgcgtcgtccggacaccgctgcagtgaccaagttcaccttcaccaccaagtcctaattggaggttcaatggcagtaattgctacgttcggtctggagaccctccaggctaatgcagctcagcgggaggcggttaaggccgccaccgatgtagcgaagaacatccaggtggcttcggttgaatctggccgcaaggctaccaagaaaacccgtaaggcggctgacgtagccgctgatactacggaagagtaatacgcgcccctggtgccttcgggtgccaggggctttttttttgtccctgtcttaagggtccaaggggtctttaatggaggaacaaatatgagagaattagatgctgtgaacctgacgctggaagccttgggggaatctcgcgttatggacatcaacaccagtaacccgagtgcggggttagctcgctctgcgcttgcacgcaatcgtcgcgggttactcagcacggggttctggtttaacgtggtcgagcgcgaagttacccccaccactgacggcctgattaaggtgccgtggaaccagctggccgtgtacgatgcctgctcagactccaagtacggggtacgtgacgggaacctgtacgacctggtagagcagaaccaatacttcgatacgcctgtacgtattcgcgtggtcctggatttagcctttgaggacctaccggagcacgccgctatgtgggtggctaactacaccactgcacaggtatacttaaacgacctgggtggcgacagcaactacgctaattacgcacaggaagctgagcggtacaagagcatggtgctgcgcgagcatctgcgcaatcagaagttcagcaccagcaagacccgctttgcacgcagaatccgccgcgctcgttttatggtttaaggagaggttatggcgcaatcattagaaggtaccattcagagcctactgcagggcgtctcccagcaggttccaagagagcgccagcccgggcaactgggggcgcagctgaatatgctcagcgacccggtttccggtatccgccgtagaccgccgggtgagattgtctgggaaagcacgatagataaccctgggcttgactccctgttcactgaatacgtagagcgtgggactgacggtaggcacctgctgattaacaccagcaacggtaactggtggttgctggctaagaatggaaagaccatccttaattccggcaatgacccgtactttgttaccaccgtaggccagacctctttgcagaccgcaagtattgctggattgacttatatcctgaatactgagatggctccgaacacaaccgtggacaatactgggcgcatcgaccccagtaccaccgggttcttctacgttaaatccgcagcattccagaaacgctggaacgtcaccgttacctctgcaggggtagactactcaggggactacaccgccccagctgctggtagtaccagcggtaacgctgaggaggtatctggtgcttacgttgctcagcaactgcgtgactctcttgtagcgaatgggttgccagctgggaacgtgagcgtacgtggcgcgtacctgttcttctatgggttaagcaactgtgtggtatcctctgacgcgggtgatacttacgctgtggtgtccaaccagtctcgtgtagaccaggagcaggacctgcctgcacagctcccagcgcaagctgacggagcaatgtgtcgtgtgggtaccgcctcgtctgagacagcatggtaccagttcagctacagcacccgcacctggtctgaggtgggggcgtatggtagcatcactaagattacgaacatgcctagagagctcgccgcggatgacaacatcatcgcgcgggattgggagggacgtttagctggcaacgacgacaacaacagcgacccggggttcgtagagaacggctacatcaccggaattgcagctttccagggccgcctggttctgcttagcggcagctctgtggatatgtcagcctctggtctgtatcagcgcttctaccgctctactgtgacgtcactgctggatacggaccgtatcagcattagctctgcgtctgcccaggattctgtgtaccgcaccgctgtgcagttcaaccgggacttggtcctgtttgctaacagcatgcaggccgttgtaccgggctctgcagtgcttacgcccaccaacgcaagcattagcattaccagcacctatgattgtgacagccgtgttaccccggtaatggcgggtcagacagtaatctacccgaacaagcgcaacgacagctacgcgggtatattggagctaatcccgtcgccgtacaccgctgcgcagtacactacgcaggatgccacggtgcacctacctcggtatatcccaggcagggtattgcagatgcaaaactccagtgtcaccaatatggccttctcgcgcatgtctggagagcgtaatagcctgctggtctacgagttcatgtggggcggaagtgacggcgctaagatgcaggcagcgtggcataagtggtcgttcccgtacccaatcctgagcgtacaggcgctggaggacgaggtgttcttgtacatgcaagggcccagtcccagcaacaagctcctgattgtgtctatggacccgcgtgaaggttatcagttgggttcagagtaccgcgaagcctactcggatttgcagaagcaagttcaagtacagggaggggtgttcactgttccggcggtattgcgcccggttgggtgggcggacaactacaaggaagagcttatcctaacgtacttacccggcaaccctatggggcctactgaggtcggcatcaaggagattgccggggagaacaccctacgggttgtgcgcggcgtacctga

SEQ ID NO: 52 - DNA, 43626 bp, Unknown
  source: /note="Description of Unknown: MCoc8a Bacteriophage Sequence"
atcgtggagcttttacgcaatttcgggccgcagtccgggcttattacaagcagcaacaactcgctgcgtggtacgcacgctgacctcgttattactgacgaactcaaagaatctattcaggagcaaatgaaaatgcaggaaactaacacagcacctatcgaatggaaagtagtattaccggaaggtgcaaacgcactgccaatgcgggggtcaatgtattcaagtggtgattactggacccctttcgaggacttgcaaatgcgaggctatgactacccgcacaccgagagcgcactgcaggcgcttatgggtctcctcaaagtcagcgcaaacaccccaggcttagaggtatctataggtggggcactgcatccgaaatatcgtgccatgtacagggctgccggtccgttgcaacgggtggacttgtgccgttcaggaactttctttgaactgcttgccccggcgcgagtcaccattgacaacaagttctgggaacgtcgccgcgacttctatgaggatggcgacgtagtggttgagcgtgtacttgctagcgtagaagcattcaccggttacaaggtgcacaagcaagccctgcagttattcgaacgcattatgcttgcgccagaagagcagcagcgccaattatacactggctacgattacggtagccacatcagagacgtgcacgccgtgggtctgctcatgaagctgcacggtttcgtagtgtctagattcgctgttccgttgggcttcggtttccgcaacggcgagcccatcgtgatgctggggcagccgcggatgcacaaggatttcgctgcggttactgagtaccgctgcgtagagatgcgcgtaggtaagtggctcgccaattactacggcaacggggttgacttccgcgacgccatcgaagacctcaaggctatgaacgtagagcctacaacgtacctgtgcaagaccgagcaggaatggtatgacgcctacgagaatggcccaagtagctgcatgagcgggtactcatttgagcacagccctgtgcgggcgtatgctacaaccagccacgggctaccagataacgggctgcgcctattcatccagtacaccggggagctgttcggggacgacttcgaagtgcaggcacgagcaatcgtaaaacctgaaaccaaagagtacgtccgtgcttacggaaacgctgcggatgcaatcctgcgggggcatgggtacaccagaaacactgaatgtctcgagggggtaatgctggcgcgcataccgcacccaacctacaacggcgcagtgctgatgccatacctagatagcagccagtgcggcgtagatgagtatgaggatgatgcctttgtaatccgtgacgcctacgagtacgaggcgcaggaatcagaagggtacatttacgttggcgcagagtctgcccggtgctgctgctgcggagcgcgcttctccgtcgatgacatgcaggaaaccgcaggtggtgatatggtctgcgacggctgtgtagaagatggggactttgtatacgcagttggccgagaagggctgcataatcgctggagctgtacttggtctgattaccacgacgcctatgtatatgacgcggacattgagcactgttcggtagaaggggtagtgcatgaccaagaagagctggtgtttgcacaggaccggcaggtgcttattgagcacgcagaagaacacccagtgcacgggttaattctcactgagcatgcagctgattgcttgggagagaagtacctgggcaacgatgacgaagaagtagaggaggcagcttaatgttcttgaatccgcacgggattgatatgcagctgctcttgcagatactgcgaacgcaccggcctagctgggcaagcactgagtggtttgagccgctgcttatgcaagcgctgggtagtggtatgcactacgtaaaggacaagcacgggaactacttcgtgctggtgggggactcagagcaaagcgacgtagcgtttacgtcgcacctcgatacggtggcccgtccaaccagcgctgcgccggacgttggttgtactaacaagggcgtactgttcgtaaagaatccgcagcaagctgactgcttgggtgctgactgtggtgccggtatctatctgatgctggagatgctgcggcggggtgtgcacggacgttactgcttcttcgtggatgaagaggtgggctgcgagggtagcgctgcatcggtcaaggatgactctggattttggactggggtcaaggcgatgattagcttcgaccgccgcggcgacggtatcattacgcatcaaaggtatatgcgctgctgctctgacacctttgccaagaccctagcagagcgcctgggacgcacggagcagcacttgcagaagggtgtgtatactgactcagccgagttcgttggcatcattcctgagtgcaccaacgtcggtgtagggtacatgcacgagcacaccccggatgaggtactggacctgaacatacttgggcaagtgcttgagcgggtactgcaagatggtacgttcaagcgcctaccgattgagcgtgacccgaaggtagtggagccggaccagtggctctctgcatctacgctcagtttacggcagccgtgggacctgccaccggacgaggacccgcaattgctggctgcgttccgcgtagtgtcgcagctttctaaacaacaactggttagctgggtgcaggagaatccagagaaggcggcggagtacataatggtgttctccgattacggctttaaagaagagctgattgaactaggcacccgagtcgtagaagactggggcggatacgataatattgtggagggttgattatgtctaagtttaaagttggtgataaagttgttcgcaaagcacacaaaaacacttcgtcgttcaagtcgtacctaggggattttgcttactacgtaattacagatataactacaagcggccactggctgcagttggataactttacagatgggggagccgacccctacccgtggtacgcctataacttcgagctgtatcaagacccgaaggatgagctgccgccagtcccggacaaggtggcctacatgaactctaagcgcgacccgggaaatgaccaacgcctagttcttgagaaggataatggggatggggaaggtttaatgtacatcggggtagttcctaagaagggaagcactcgggcaaaggttgagattgggattaacatcgaccccgattcagccctgcagttggcacacgacctgcgccgcatggctatgtcggttaagcgcgagcagaagtaatggaccagccctggcttagagcgtgcaagcgcctggccgtggggcagagggcgcgctttcggtgctgcggcagggacgccgccggggtgctctacaataacccggatgcatgggaatattattgccaccgctgtaagcaggtgggcaaggagcacaagcagtaccagcgcatacagttacaggaagagccgagggtgcagccctctgcacctgcagatgcaatttgcattagccaagcgcctgcggaaacgcagagttttatttacggattcctgaccacaaagggaatcatgcctgaaatggtggaggatgcagaatggagcaaagagaaacagcggataatcttccgtgtcggaagcgctgctctgggccgtgcagtgcatgcccgacaacaaccgaagtgggtaatgtacggccatccggtaccgttcgctgccgcggcacctgccgtagcaccggctgtagctgcggccgcgcctctaaaggtcgtgctcaccgaggactatctatcagcccggaagatacagcacgcagttacgagctacagtgcgttgaacgtgcaggctatagctatgctgggtacacgcttgcccacgccgctgagggcttggctgattcagaatcgcccggaagtggttctgatgctggacaatgacccggctgggcacgctggggtagcggcagcacgccgagcattgcgcccgttcatgcagtgccgggagcattacttcgctgcggacccgaaggacgcagaaattaaagagattctggaggctatacaatgcaaccacatatccagagggagctagttaacaaactaagggacgcggcggtgcgctatcatgggacacaacagcttcgggcagtaatagctagactggtacaagaggcgcttgaaggaggtaagaattggaccttatagttgttcgtgcgatgtgcacgcagaaagtgtggactcgcttgcgagagcagattcctaagtcgatgcttgcgccggacacttcgaaccttctggactgggtggggttgtactggaacacgtacccagagcaccaggaggtgcagtgggatgcgatgcagagcatgctcaacctccgggcggggcacttatcccgggaagagcgggtaatcatggacgagcttatgcggggagtacaagccgtgccgcaggattctgtggtggggattgtccaaaccctgaatgagctggcctacagcggggaggtagcggcgcttacgcagcgctaccaagacggtgaggagattgattacctcctggagatgaagcacctgcagcgcaagtacggtgatggcgctgcggtgcatgattcgctgcttgaatgggagagtggtagtgttgacgagatacttgccgcgactgatgagagcggcggtcttaaactgggcgtgttcgagcaactcgctagcaacatccgaggtctacgtggcggggactgtatcgcagtggctgctcctgtggactctggtaaaactagtctgcttgctgctattgctgtggattttgctgagcaaatgcagcagcagccggaagtgtacggggaccgccctatcctctggttggttaacgagggcccagcgacgcgcacagtgccgagggtatatcaagcggcgctgcattggactctggcggagattaaggaccggcacagtaagcaagagttcgtgccagcctacctcaagaaagtaggcagggctgaccggattcgtgtcaaggctgcgcactcattgacgatggcgcagatatccacgctcatggaggagatgcgccccgcggtaatcatcatcgacatggtggcgaatatccgtggcggcactatggagagtgagcaccagaaccttgaggcgaaatggcaggagctgcgtatccttgggtgcgagaacgactgcgctattgtaggcactatgcaactttcactcgaaggttacaacatgctgttcccgccactcaccgctatgaagcagagcaagattggcgtgcagggtgccttggacttggcgattatgatgggatgcttggacaggaacgagcagccgcacatgcaaaacgtccgtggtatcagtactccgaagaacaagatggcactgtctggtaaagaatcgctcctgcaattcgaggtgggattcgagccgggtcgttgtagatttgatgagggccaaattaatgtctaagtttaaagttggcgataaagtaaagcgcagcaccgttgtgccgcgtgatatattctaccgcactggcgtgaagattggcaggacttacactgtgtgcgccgtaagtgaaagcggcgcctacataggactgactgaatctaaggagagcacattcaactttgatgcttatgcgttctctcttgtatccaccggtgctgcttgggacgtaaacgaagcactgcgcctgcgcgggttggcagtacaagcgatacaggagtacaacacttacctactgcagcagccgctgctggaggctatcgaacctccgccaccaatcaagtgacttccctagcgccttctacgagggcgctatgtaggtacacaggagggtttatgcaagtagactatacaggggttatccaaaaagcggattacacaggacttatacgcggtagttacgtggtgcgacaccgcgttaccggggaattttgtaccgtggaactcggggcacgttacaatcagagagagtgggatattgtagggcctatatcactgctgggagatttactagtatgcttaaaccgtcagacatcaactacctagacgacgaggtaatcaaggcgtacgctgcatctgcaggtactttccgtaaacgattcgcactggacagcagccagctgattgtgcatctggctatcaacaaggctcggagggctaagtggaaatgaattgggatatttggtttacctacaaagacggcaaactctactggaagcacgaggttagaagtgggcgcggacgcagccacctaaactgcgccgcaggttccgaggcaggaactctgaacaaagtacatggatactggtacgttaagctgcataataagctatacaaaagaagtttgatagtatatgagatgcacaacggtccgctgcgagcaggccaccatatagaccacataaatcataacaggttagaagataccccagataacttgagggcagtgcttcctgagaagaacatgcagaacaagtccctgtatagaagcaaccgcagcggctatgtaggggtgcacaggaagagaggtcgttggatagcaaccctaggaaataaacaattaggttcatttagcagtatagagcaagccgtagagtgtcgtagactggcagctgaggcggcggggtatcaccataatcacggggttgcagtatgactagcagtattatgactatagaccttgaggtcgagaataatccttactatggtagcaaggctagcccctactgccctgacaactatgtagtgcattcggcctaccgcatagaccggaccgaggatgacggcacagttaccgtagaaccgacctttgatatcagattcaacagcaagcaggaattccttgacgacgtagccggggagcatctgtggttccgcataccttctgattgctggtgcatcgtggcccacaacgcagccttcgaaattagctggtttttaacatatcagcggcaacactttgaggaattcctaaagcgcggcggccgcgtattcgacacaatgcacggggagtatattgtgtctgactttcagagtatgtacccatccttggatgaaactgcgccaaagtatggtggggagcataagattgatggggtaaaaatattgtgggaacagggtgttctgacctcgcagatagaccccattcttctcagggattacctagtcaatggtgatataaagaacacggccctgtgcttctacggccagtgtgctacgttcacccagcgcaatcagatgcagtacgtgtgggagcgtatggatgccttgctggcttgggcgtactgcgaatggttcggcctgttcgttaatatgccaattgcgcgcaagaaccaggaggagcaggagcagcgcatctgtgagattaagcaggagctgcagcagtatatcccgaaggacctaccggagactctggatttcaacttcggctcggactttcatatgtctgcactggtgtacggcgggcctatcaagtatcgcaagaaggtgccctatgaccctccccagtacgtcaaggccgactactggcaagtcggggacacttgggttgccgtggatgacgtgcccgcaccgccaggtgcaaccacgtacaagtccggtaagaacaaggggctaccaaaagtattccgccttgatacagaggaggagaaacttaagtgggaggatgacctttacttctgcccgggcctagtgaacatccaggagctgccggaagttatccgggagaagtatgcggagcgtggagagttccgacaggcgcgcaccctgcaggacggtacgccagtatacagcaccagcacagacgcaatggaggcgctggcccgccaagggttcgagttctgtaagttggtgaatgagctggcggcgcttgagaaggacaccggtacctactatttacgggaagttctggatgcaaacggagaagtcaaagagcggaagggaatgctgcagtacgtaatacccgaacgcccagatggttccggtatcatacaccaccggctgaatacttgtgccactgtaaccgggcgccttagtagttctaacccgaacctgcagaacctaccccgcccggatgaggacggggatggggtggctaaatccaaggtgaagcaggtattcaccagccgattcggtgataacggccgcatcactgaggttgactactctgcgctggaagtggttatgtcctgcgtgcatacaggggataagaaactgctgggcttgctacaggcaggtacggatatgcactgttaccgcctcgctttccgcgagggactgccgtatgaagaagtatatgagcgctgccacaacaagaagcacgagctgcatccgctttggaaggcaatgcgtacaagtattaaggctcctagctttgcagcccagtatggcgctacggctaaggggattgcgtttgctactggatgtacggtggaatttgcacaggctttcttggacaacgaggctgcgctgttcccgcaaacaattggcttccgcgctgttgttaaggaagaggtagagcgtaccggtgcggagggtcgcatgtaccgggagcaggcggacgacggcagctatcgaatctaccgcattgggacgtggaccagccctgctggtgcccgctacagcttccgtcagaaagagcagtggaaggaggttgtgcctgggcagcgtaagcagaaggtcatggactacaaggaaaccgagatggcgaactactggtgccaaggggaagcattcttcctgatggcggtggcggctggtatggttctgcgtgcactcttggcccgtgactggttcgacaatcaggtgtgcctgattacgaacgtacacgatgcattgtatctggacagcgccaacccggaggttggacgtgaggcgagcctgctggttaagcagtgcatggaggatgcacctaagcgtatccaccagctctggcctaactacggtatcattggcgaggtgcccttcccggcggaagctgaaatgggtacgagcatgtacagtaaggagaaggtagaatgaatattaaacctggcagtattgtggagatgctggaacttgggccggagcctatcgacccacgacatcgtgcctactttgcaccgggtacgcagcatcgcgtgatatcttacgacgttgaattcggcgaggtggagctactcaatccggacagcaactcagagaagcctggggacggcatcaccttcttcgctggagagtacaagctcatcgcggagtagtgataggtggacccttgggtggtgtagggggttagggtagcatggaaatatgctagggtcaactaaataattaaataaaattatttgttgactctggcttgattctgtgattccccgagaattaatgtgatacgagtaggaacaacacaagagaggcaaccttggctaaagtaagtctaatcaaactgtggaccaaagaagagcaccaacaaattcttggcagtttcctaaataacactgatgcagctattgcgtacaataacaaatttcgcaggggggacgtaatcgtgtctcgccagcttgtacgctactggcgcagcatcttcatggataacaagggcagcaaggccagtgccaaccgcgggctgcaggaggcgcgtaagctaatccaaccaagcccaacggacgatatcgggaatacaaaggtgccggatatgtgccaccgcattctggttgtcggggacctgcacgctccgtatacccacgtagacgcaatgccgttccttgagagcgtacgtgatgcgtactgcccggacatggtagtgcaggtgggtgacgaaaccgacgggcacgctatcagcttccacgactctgaccctaacctggatagcgcaggggtggagctggagaaagccaagctcgtactggaggagctgcatgaactattcccgaacctgctggtttgcgattccaatcacggctcactcgtatatcgccgcgctaaagctcacggtttgccagtgcaatttatcaagaagtaccgggacatcttattccctgagcatggtgctccggcgtggtcgtgggccgacgcttgggtgctcaacacaccgctggggcctgtccgtttccagcatcaagtcagcggtgatttcatgctcaatgcatcccatgagcgcacctctctggtgttggggcatgagcatggacgcttcgaggttcagtatgctgcttcttcaacggcgctgtactttggtgcgtatgcagggtgcttgattgaccgcaagagcatggcctttgcttatggcagactcacccgcaagaaaccaatcctgggtgtgatggtaatcaccgagggttgcccgcagttaattccgatgctgctcgacgacgatggtcgttgggtagggagaagcaaatgaatgtactggattcaactgtcacccgagtagatgctcctgtatgggatgagcaataccaggtgtatcgtgtaaccctggagtatgactgctgggggcacaaatctgagacagagcggtggtataaagatgaagcctcagctcttagtttaaaagttggtgacataatcaaaacctaattaggagtgtcgatgaaaatgggaatctgttctgtactgggccttatctttgtaaccctgaaactgactggcgttatcgcctggtcctggtggtgggtactgcttccgttctacggcggtgtagctttgctgttggcaatcctggcggcaggcggtgtggcagcagccgcggctgcaggcattaaatccgcacttaagaatcgctaggccggacctgcatctgcacgtaaatatcatttaaactaaacgaggacgtaattatatgactacgaatgtactggcatccctgaacgctctggtagacgcagcaatcgaaacccaagatgtggatatgcgggaaaccgcacagggtggtgcgtacgaggacgtgctgctgccgaagggtgaatattacggttacttcaccgagtatgtggaaatcggtaagcgcctgccgaccaagggtggtaagcctaccggtaagcctgcagtggctaacgtacgtatcggcattgtagtgttcggccccaacggcgaagtgaagcgtatccgcccgtacccgatggctatcagtaactttgagcgagcaggcttcaagaagttcttcgacaagctcaactacgacaatagcattaagcatgcagcgcagcgtctgggccaggccttcaccttcccgattgatgagcacaccagcgccgcgggtaagaagtcgaacatcgtggacctgtccggtatccgcccgattcctaagttcgacccgaacaccggtgaacctattaagatgccagcgctggatgcctccgagattaagctgttcctgtggaacaacccaaccaaagagacctgggacagcctacacatcgaaggcaccttcgacgacggtaagagcaagaactggattcaggaggatatgtacaaggccgtagacttcccgggcagtgctctggatattatgctgaacgctggctctgttccgagtccggcagctatgcaggcacctgctgctccttctgcaccggcggctcccgctgcgccggcagccccagctgctccagtggctcctgcggctcctgtagcgcctgtagctccagcagcgcccgctgcacctcaagcctaataaaccctaatcgaaactaatacggcccctcctggggccttagaggaagcctatgaacatcatcaacatccttatcaaactcctgagtgcagcctacacagcagaagctaaacgagcagatgccaaagcgcagtttaacgagcagctgtcagttaaattcgcagacgacgcagtacgtctggccgctcaatccgaggcgcgagtagaggcctccaagcacagcaaagaggtagcagaagcgcatgcttgtcatgctgataacctgcgtgccaagcgtgacgaagtagctaacttcctgggggtataaatgcgcataatcacatgggccaaagaacagtacgctgtgtttctgcttctgcgcgcacagcgtttgcagaagcgagcagacgactggcgctgggcagctaactctcacgcatacagggcaagccttctgggtcccgagattagtgcgcagcgttatcacttgaatcgccagtgcgccaagtcccggcgccgtgcatatgccctgggcgcagaggccacggccactgagaccaaagcctacgccttcattcaaaaacacaaactgaaaggatttgactaatggataaagtattagaagcgtacgagaaccttgccattacggtcggctcagcggtatacgatgcagcggcgtatggggtgcttaatattagtctggacgacatctacaacgcactagatgagctggcggccctgtacggaatggacctggacctggccgctacagccttccgggagcacaacgatctggcggcacatgccgataagttacgaggagacgaccttgtacttatccgcgtagtgggcacgctcagcgttggcctggcggagattggctcctgtatctacgacgtagaccagagcctgcgtactccggaagtaatcggggacatgctcggcaccgtgctggtgctgtctgaactggaggcttaagtatgttgtacgtatctcgcgcaatttacgtagctttgattctcccgctgattccattggcgggactgtgctaccttggcgataagctgagcaaggcaaagtgggcagaacgttgggttaactgggccgacaagaaggcccgcgatattacggggcgctgatgattatcaacggggttgacttgtcccagcttagcgagcagttagctccgcagaactctgggaagattctgctgtacgatgcggatttttgcgtgtacaaagccgccgctacagtaaaacgtttggataccgcaatacgccgcttctatcagctggtgcttgaggatatgttcctggtcggctgctcagaggcagtggcgtacctgacgcctgcaggatgtgctaagtgcttgcgctggcacctgcctacggctaagccctatcaggggcagcgcgctaatcgacaggagctaccgctcaaggcaccgttgaagcggcacctgattgagaacccagaccagtattctgagcagggtattcaggtagtcagcagtgactacttcgaggccgacgacctctttgtaatggattcgtacagcttcggagaccggggaatcctgatgtcccaggacaaggattcttggctcagccctatggctcggttcgatataccgacaggtacagtgtggcctgcactggaggacccattcggatggattaagtgggatgacacccaggctatgcctgtacgagcacacgggttgaagttcttctggtggcagatgctagcaggggacgacgcagataacgtcaaaggcatcacgttgcttgatgggaagccctgtggcaagcgaacggcctttgatgctatctaccctattacctcagagcaggacgccgcagaattcgtcgtagcggcttacgctcgaaacaaccaagacgtactcgcagaggcagaatgcctgttcctgcggcgctccccgtcagattctgcctatcagtatctgatgtcactgttgactactcccagtctgcgtgactgggtgcattcgctgcacgagtaccataaacagcatatacagtggatacaggagcacccagacaatggcgaagatgtctgcgaaggaaatgagcctgcgggcgattgagttatactacgatgggaaacacgatgaacttgaaactattctggatgcgctgcgtgaacgagcacccaaaacacatcgaagaacggttgagcacttggattctctcattcacgacaatgctatgctggatgtagttggggggattgaggtatggtaatgagtacaccttgtatagaccatgggagaaaggggcggccaaagactgggttcctatccgcgtgggtgcttattgacggtaaacgccaacctacaaccgcacacaggaaggcgtactatgaacacacaggagagtggcccgaagtagtacagcacacctgtggaaattctcgctgcattaaccctgagcacctgcatggagggacccacaaaagcaaatcagcaaagggttccagcagcggccgctcacgtttgaacgaaggtacggtgcgctatctgcggcaaatgcacattcctggggaccgggaatggggtagcaacgctatagctagacgcctgggtatggctcaaagtacggtatatcgtatgttaagagggatttcatggcgctgcgtaaaataactcgagcacagattcgctctgtggctattaagcttgccaaagaccagggaggtatatgcctcctctgcggcaaacctttggacttcacaatcaagggggtaactggtgattctgttgtcgttgaccactgtcatattactgggcgtattcggggtgctcttcatcgctcgtgcaatggaggggaaggcaaagtggcatctgccgctgggcgctggattgttggtagcatgcaatcttctggggctattgctgaatctctacgtagggtcgccgattacttagaccgagaacctacggatatgctatactatacgcacaagacgccggaagaactagcacaagcacagaagctcaaggcccgcaaggccagggcacgacgcaaagcacgggagactgttaaatgattgaatccactaaattctatgcaggtgatttggttgtgcgcaaagcgagtcacgtagggggtatctggaaggacatctgtgaacagctacaggtagacctagactcccccagattagtgacgtgcgcagaagacggacttataaccttagccgagtgtgggacctcttggcgagcggggttcttccagctcttccattcgaagagcgaggctgtttctgactcagtgaactctcctcggcactaccagttcttcccggacctggaggcaatagaggtaattgcacgcagcatgacgcaagagcagttctacggctattgtctcggtaacagattaaaatacagactctgcgccggtaacaaggatacactggagcaggacattgctaagtccgataagtacccagaactgtatgagcaacaccgaggtaagtgcattgacgcttagtgcatggtgtcatgagatgtggcagagggtagtagagcggcgcgacaaaaagcacggggaggggctattaaatgaagacagtaatctttgatttggacggtacactagctgatggcgcgcaccgcttgcacttgctgcctactgtggatttgtatctgactgacagttggaatgagttcaaccgggcctcgaagtatgatagccctatccacagcactattgaagtgtgcaacatcatggtgcgggcagggttgcgggttattatcttgacggggcgctcggatatagtaagagcggaaacagaggcctggcttgagcggaacttcgttatgtactccgagctggttatgaggccgcacagcgacaaccgaaaggatactgtcatcaaagaggaatttctgcgtaaccaagtcgggctggaaaacattgtggcggcttgggacgacagccccgcggtgattgagcatttccgcggactgggtattaccacttacgctgtatgcgactatggtgcagcaacacatcgaacagacttaaaatcccacggggtggaggaattagcatgagtgcagtaggtacaggcatgaagtatgacgcaggcaaacctcgaatggacttgctactggacgggtgcccgaatgcgttgctgcgtatcagtgatgtgctgaccttcggggcccagaagtatgcggcacacagttggcacacggtagccgaaggtaagtcccgatacaaggccgcgctactgcggcacctcacagcacacgctctaggggaaacactggactcggagagtgggttgccgcacctggcgcacgccgcttgttgtgcgttatttattctagaactggagcagatggatagtgcggccgagtgagtggtgccacatgatgtggcagaaagcagtagagcgaggcgacgaacgcggcgctaaaaactacctggagatgtataatctctgggtaagtcgaaatcagtagttagaagtaccggacataaccaaggagactaagcgcctatgattagcgccctgaatacggttgtagtaccagaggaagcactggtgaaacgccagctggagcttgaagagacctataagattcgcggaatcgagcgcgcgcgtaagctgattacggacgcgttgcagaacggtgggattatgaacctgccgatgacgcagcgtatgctcacctcggcatacgaggtggctgctaccgctatcgacgagatgcgaaatgtcaaagccccgggcatcggtggtaagtaccgccggttcctgcgcttagtacccttggatgtcctgaccaccctgagcctgtgcacaatgtttgaggcgttcagtgtcgccccaggcgagtccgctagtcgccgccagactgcacaggcggtaatgtctgcgctgggccggaacgtgcagtcagagctactggctctgcagttacgcaacgtagccccagcgtacatggaccgcgtgtatgagtacctcacagagcgccgtacgaagtcccctacgcacatcctgcgtacgctccgtgccagtgccgagaacgtacactacgggcacgagccttggaccaatgcccagaacatctccgtagggcgtctgctgtgtgccgcagtgtttgagacgggactgttccagtggaagaactgtagcgggaatctgagcatgctctatccggctgatgacgttatggaggccttccagaaactggtagagtccgctgatactgtaaccatgaagccgcctatgctgataccgccggtgcagcacactactctgtgggatggtgggtacctcacccctatcgacaatcgcggaacctaccataacgcgcacattgacagagctcgtctccgtgaagtagcggaagcatttaagtccgcggacggcatcaaaaaagcgcttaataaggcacaggaaaccccgtaccgtattaataagcgcgtactggaactggtgcaagaagcacgggccctgggtgttgggataggtatgcctcgctcagtaccggagccgaaaccggagtggtatctggacggggttccgaaagagaattacactgaggaagagcttgaccgcttcggtgagtggaagacgcgtatgtctctatggtatagcgccgaccgtaagcgtgtatcgcaactgcgcagccttctgactacgttggaaatggctgaggaattcaaagatgagaaagccctgtacttcccgacttgtgcggactggcgctaccgcctgtacttcaagtcctctctgcatccccagggttctgatttgcagaaagccctccttgaatttggtaggggcaagccgctgggggagcgtggcctgttctggctcaaggtgcatatcgccaattgctttggttatgacaaaaccctattcgaagaccgtgcagattgggttgatgcaaatattggtcaaatacgagagttggtacacaatccatttagttcggatgcttttaggtcggccgactcgccgtggtgcttgttggcagcggctacagaccttgttgctgcacttgattctgcgtgcccagaagagtatattagccgaatcccagtggctatggacgctacgaactcaggtgggcagcacctctcagcgctcctgagagaccctgtgggcggtcgtctgacgaacctgtactgggagggtaatgacaagaaagcggacctgtatatggatgtgaagcgccgtacggacgagaaggtgatactggacctggacaaggaggatttcgttatccagagcacttactggagagagaacgaaatcacccgcagcatgaccaagcgccccagtatgacctacttctacagcgccacggtgcgcagctgcagtgactacatctttgaaggcgcttgcgctgaggggtatgaaggtaccgacactaacagtctatggaatctgtcgtgctacctggctccgcgtatgcgcgccgctatcgaggaggcaaaccctgctgctgcggcagttatgtcgtacttgcagaacctagctagacgtgtaccggcaagccagcacctgcagtggtatacgccgctgggtgggcttgtaatgaaccgctacacacagcgtgaagaagtgcgtgtacgtattgactgtatgaatctcactgtcatgcgagtgcataatcgagattttaagacatgcaacaagcgtaaggcggcctccgggattgccccaaactttgtgcatagcctggatagtacgcacttgatgatggtgctctgcgctgcggaggggttggatattgtacctattcacgactcgctggctactcacgcagccgacgttgatgctatgcaccgacacatccgtgaacagtttgtgcgtctctacgaagagaatgacctgcttggggatattactcgcgcagcagcagcagccggggcggacttgacggacctggatatgcccgaggtgggtactctggacatccggcaagtactggaatcgcctttcttcttctgctgataaatgaagttaccggagtaggaatgaagttaaaacacactagtaaaacttccgattacactctcaaggttctgtataagtctgacgacattacagacgcagtgaggcaactgcacgaactgggccacggcattagtcggggcctagctccagagcagcactactggagagtactgggcagcatactgggtaaacagtatatactaggagtctatgactcccaaggcgacttagtcggtgctgtcagctactacccagaagctgtagaggactgtcattacgtagagcctgtgctgtatacagacttcttcgtattgaagccaggtaacagtaaggcggtacttgtgattatgcagggccttcgcgcaatagctaagagtatgcgggctgggcgtatcgccattagccgaggtgcatcggataacacatacaatacaacttatcatttagtgaggtcagaatgagtggtggtttaggtaaactgttaggcaaggccacggatatgctcggccttacggacaacgcaggattagaggcgcagcagcgcttggcagagcagcaggctagcgcagcgaaacaacaggctgccctagaggctaatagcgccgcagataacattgcggagattgaccccgcaggggctgcctctgcatctgcagatgcaattacgtctgagcagaagaaacgacgacaagcagggcagagcaatcctctgggcctgtaagggggtagcttggaacaaaaagcaacattagcagaactctttaagaaggaccaggacgcaggcgtcttggatgcctctgagaagttcgcgcagtggacactcagcactatctttacccgggacgattccctggacggtagacgcaggcctctggagcgtgactaccagagcaccggcgcgcagctggtcaacactgcagccactaagattgtagggtcactgttcccgcaaggcactagtttcttccggttctccaagagttcggacctggacgagttcattagttcgctgggtagtgcagctacagcagaatctaagctggctgaggtcgagaacacggcgtcacagaaagtatttgagaaagacggttatgctgcgaagttgcaagctgtgaagctgctgctggttacaggtaacgcgttggagtatattgatgagcggacaggtaaatccatcgtctactcagtccgtaactttaccgttcgaagggatggcagtgggaacgtcctgcgactcattatcagagagcgcgcaagcatccaggacctgccagaagatttccgcggcaccttctaccgtgacaaagacccatacggcgacgttgatatctacactgccgcttgtcgcaaggttaagcggacagaggaaggcgtagaggtagtaagctacgaggtgtaccaagaagcagacggacaccgtattggggacagcagcacctatccggagctggaacttccatacaacgtgctggtgtggaaccttgttagcggcgagcactacggacgcggcttggtagaggactacgccggggactttgctcggttgtcggtactatcggaagcattaactaactacgaggttgagtctgcgcggttaatcccgctggttgacgcaagttccggtctggatgtagatgagttcgcaacgtcggagacgggcgaggctgtgcaggtgggcggcggtggttccaacgggaacagcaaatcccccgtcactgcttacgagggcggctctgcccagaagattcagtggattgccagcaacatccagatgctcgaacagaaactatcgcgtgcgtttatgtacactggtaactccaggcagggtgagcgtgtcacggcttacgagattcgccagaatgccaaagaggcggaagccgctatgggtggtgggttcagtatcctgagcgacacctggctgcgtaagctggcgtacttgtacactgcgctggcgtaccctcgctttaagctgtacctcagcgaaggcgtagtgagcatcaacgttactgttggcacctctgcactagctaaagccgcggcagcggacaagctgttagaggcggcgcagtccatgcagctggctatccctgtgctggagcagattactccacgcttcaacaaggatgcgtgcgtagactggtacttcgacgcctatggtatcgtcagcgagccgttcatgtacaccgaagagcagctgcagcagaagcaacaggttcaggatgcgtctgccgatacgtccgcaggtctagcacaggaccaactccagggcttgacagcagcagacccgacagtagcaggtaagcagctgggcttattaccaagttaacaaccgaggcatagatggataacgtagaaaacggtcagaacgtagaaactacacaggtagagaaccaaggtggccctaagattccgggcctaggtgctccccttaacgcccctaacaatcaaggcgtgcaggatgcacagacccctacccagcagcaacagggcaaagattcccctgaccctgctaagattcctctggatatcgaagccctaaaagcggccctggataagggtggcgatagcgctaaagagcagccccaggagctggctaagacaggcaacccgacgattgacgccggtgtagctatgttgcagaaagtctctgggttaactgactctgatatggtgcgggcacttggcaaggccctggagtatcaggaccctaacctaatcgatacgaccttcattaaggaacgtttcggagagcacgctgcttatgcagagttgctggctaaagcgtacctggaagaccaggttggtcaagccaccaaagcagtacaggaagcttacgatatcgtgggcggtaaggagaactgggaggtagcagcgcagctgtttaattccaaggcccctgaacctcttcgtaacgcggctcgtgtactcgctaactcgggtgagctcaagcaggccgctgagttggtagcaagcttctgccgggatatgggtcttatcaagacacagaacccaatggtacggggcgtggccagcaacaatgcactgtctgctgcagaattccgcgcagaatataccaaactccgtcaggaagcgggcaaccgtagcttggcgtccccacagttcagtcaacgttataacgatttgctcgcacgccgtgaagctggtaagcgcgtaggtctttaattttatttataaaggaaactaaagcatggccaacactatttataatggcaacctgactcgtccgcactggggcggagcggcgtctgacgtagatattcaccttgaagtgtatcagaacgaagtggatacccgcttccagtaccaggctctgttcctgggcctctccagccagcgctctatcagtggctctaacacctaccgtatcgaccgcctgaatacctcctcggtgaaaggtcgtcgctccggtgaggcgctggatagcactccggtccgtaacgataagatgattatcgtggtggatacggtgctgtatatccgtaacccgattgactaccaggatgactggaccggtccggacttcctgaccgagatgggtcagaacaacggctctgagttcgcagagaccttcgaccaggcgcacctgattcagctcatcaagggccgctcctgggttgctccggcgcacctgaaaccggcgttcaacgacggtatcgaggtaggcgcagctattctggttccgggtgccaccccttccacgcagctgacccaggctgagatggaggcgaacgccatgaacattaacctggcccacaaggctggtattgatgaactcatcaagcgcaaaaccccgctggcggatatgattaccctggtggatgtcgatacctattcgcgtctgctggagcatccgaagctcctgaacctggactttggtgcatccaacaacgacggttacaaagaccgccgtgtagtgaagatgaacggagtgcctgtagtagagtgcacggagttcccgaccgctgctggtacgcacccgctgggctctgcttacaccgtcacctctgacgacgcgctgtgccgtatggtgactttcagcaagtccaagaccctggtgactgttgaagctaagccgttcacctcccgtatctgggacgatacgcgcgagttcagcaacgtactggactgctacgcgatgtacaacatcggcctgcgtcgtccggacaccgctgcagtgaccaagttcaccttcaccaccaagtcctaattggaggttcaatggcagtaattgctacgttcggtctggagaccctccaggctaatgcagctcagcgggaggcggttaaggccgccaccgatgtagcgaagaacatccaggtggcttcggttgaatctggccgcaaggctaccaagaaaacccgtaaggcggctgacgtagccgctgatactacggaagagtaatacgcgcccctggtgccttcgggtgccaggggctttttttttgtccctgtcttaagggtccaaggggtctttaatggaggaacaaatatgagagaattagatgctgtgaacctgacgctggaagccttgggggaatctcgcgttatggacatcaacaccagtaacccgagtgcggggttagctcgctctgcgcttgcacgcaatcgtcgcgggttactcagcacggggttctggtttaacgtggtcgagcgcgaagttacccccaccactgacggcctgattaaggtgccgtggaaccagctggccgtgtacgatgcctgctcagactccaagtacggggtacgtgacgggaacctgtacgacctggtagagcagaaccaatacttcgatacgcctgtacgtattcgcgtggtcctggatttagcctttgaggacctaccggagcacgccgctatgtgggtggctaactacaccactgcacaggtatacttaaacgacctgggtggcgacagcaactacgctaattacgcacaggaagctgagcggtacaagagcatggtgctgcgcgagcatctgcgcaatcagaagttcagcaccagcaagacccgctttgcacgcagaatccgccgcgctcgttttatggtttaaggagaggttatggcgcaatcattagaaggtaccattcagagcctactgcagggcgtctcccagcaggttccaagagagcgccagcccgggcaactgggggcgcagctgaatatgctcagcgacccggtttccggtatccgccgtagaccgccgggtgagattgtctgggaaagcacgatagataaccctgggcttgactccctgttcactgaatacgtagagcgtgggactgacggtaggcacctgctgattaacaccagcaacggtaactggtggttgctggctaagaatggaaagaccatccttaattccggcaatgacccgtactttgttaccaccgtaggccagacctctttgcagaccgcaagtattgctggattgacttatatcctgaatactgagatggctccgaacacaaccgtggacaatactgggcgcatcgaccccagtaccaccgggttcttctacgttaaatccgcagcattccagaaacgctggaacgtcaccgttacctctgcaggggtagactactcaggggactacaccgccccagctgctggtagtaccagcggtaacgctgaggaggtatctggtgcttacgttgctcagcaactgcgtgactctcttgtagcgaatgggttgccagctgggaacgtgagcgtacgtggcgcgtacctgttcttctatgggttaagcaactgtgtggtatcctctgacgcgggtgatacttacgctgtggtgtccaaccagtctcgtgtagaccaggagcaggacctgcctgcacagctcccagcgcaagctgacggagcaatgtgtcgtgtgggtaccgcctcgtctgagacagcatggtaccagttcagctacagcacccgcacctggtctgaggtgggggcgtatggtagcatcactaagattacgaacatgcctagagagctcgccgcggatgacaacatcatcgcgcgggattgggagggacgtttagctggcaacgacgacaacaacagcgacccggggttcgtagagaacggctacatcaccggaattgcagctttccagggccgcctggttctgcttagcggcagctctgtggatatgtcagcctctggtctgtatcagcgcttctaccgctctactgtgacgtcactgctggatacggaccgtatcagcattagctctgcgtctgcccaggattctgtgtaccgcaccgctgtgcagttcaaccgggacttggtcctgtttgctaacagcatgcaggccgttgtaccgggctctgcagtgcttacgcccaccaacgcaagcattagcattaccagcacctatgattgtgacagccgtgttaccccggtaatggcgggtcagacagtaatctacccgaacaagcgcaacgacagctacgcgggtatattggagctaatcccgtcgccgtacaccgctgcgcagtacactacgcaggatgccacggtgcacctacctcggtatatcccaggcagggtattgcagatgcaaaactccagtgtcaccaatatggccttctcgcgcatgtctggagagcgtaatagcctgctggtctacgagttcatgtggggcggaagtgacggcgctaagatgcaggcagcgtggcataagtggtcgttcccgtacccaatcctgagcgtacaggcgctggaggacgaggtgttcttgtacatgcaagggcccagtcccagcaacaagctcctgattgtgtctatggacccgcgtgaaggttatcagttgggttcagagtaccgcgaagcctactcggatttgcagaagcaagttcaagtacagggaggggtgttcactgttccggcggtattgcgcccggttgggtgggcggacaactacaaggaagagcttatcctaacgtacttacccggcaaccctatggggcctactgaggtcggcatcaaggagattgccggggagaacaccctacgggttgtgcgcggcgtacctgatggcacttatgtaatcgggagacgttaccgtagtactttcacgctaactacgcctattctacgggaccagaatgacaagctcgttggaagtgggcatgtgcgcctgctgcgtctggatgtagcggtgcgtaactctgggcacttcgatgtacaggtactagacaccccgcgggacgtcaattggggcggggaactgactggtatcctgatgaactcaaaggagctgacgcttgggcaggctctgcgtatggacctggctacgattaccgtgccatgtcgtaccaacgcagacacaaccgaggtgtcactatttactgacggttctatggaactgaacgtgttggatatatcgtacatcctgcgctacaaccaacgcagacggaggatttaatatgtggtggatggttgcggccatggccgctaagaccgttctggggcagggtgctcagattgaagtgtccaaggccaggaacaaggctgtgattcaacagacagccaaacagctaaacgacatcgcgctacagcgcgcccagtccagggaccggactgaggtgtctctgtttaacattcagcagcagaagctgcaggcacagagccaagtaggactacaggctgcagcctctgggactatgggggcctcggttaaagacgctgtagccacagtgaacactgtagccgggcggcaagaggccagtgtgcgcgaccagcaggcaactcaggaagagggcttccgtctaatgacagataaggctgtggatagcggcctggctaacatggatatggaggacccgtacgataatatgtttaactcgctgttgagtgtcggggcatccgctgttgggcagtacgccggtaacgctgcgtcatcttctgactctggcagctcttcgcctggtagcggagcgtcagctacgcagagcatggcatcctcctatgacttatgggggagtaagggcaatagcccagttcacacctggtaaattaggaggaatactaaatgcctgtgattcaacccggtagacaggggttaaatatcggaggagtgcaactgcagtccaacgatgttagcttaccgtcaacggtaagtgaagtatctgttgatacctccaaagcaaaacgcctagccgccctgtcagggttcgtgcaggacttcggcgtaggtttcgacgaggcagtaaaagaaaacgccgcagccgccaccgtgcgcggcgctatggatgctcagggcgcagtagatgcaatggcctccaaggacgaggctgtacagaagcaaaacatcttcgtgcgcgaagcctaccaggacggctacgtatccgccgcagcgtacgacactctagccaagtggcgcacagacagcatcgcccgggctaagaaagctgccgaggcagggctgactgacgaggaattccagcagcaggagcaagagcacgtacagtcaatgtcagacaagctcgggatgtatctcccggatatgtccaagcagtctgctacgagtatactgcagcagctccgcgctaccagtatggctaactatacagccttccagaaaggacgtgctgcgttcgccctggcccaggctgaccgtgccctcgaccgtgggctgagtgcgtccagtgatgagttctatcagcgcctgcaggcaggacagggtgccgctgcgcagatgtctatcaagaccggattagacagtatcctggctgctgagcacttggacaagaacaagaagctggaccgagccaagcagtatctggttagcgtagcgcagcagacgcaggacccgctggcaatcaaccagctgcaggaaatggccaccaaggaactcggcgtcaactccgtggatgtaaacgcggcgctgtatcaggagttcaagcgcgccggtgctcagattgagacccaagctcgtttcgaaatctccgatgcaatccagtctctcgaaggtcagaccccagagcagcaggaacagactatgcagcgtattcgtagtcgtgtcattgagctgtcggcatctgatgtacttagcgccgggaccagcatggagttctggaacaaggctcagaccattcgagagaaggcagcagacgcccaagcattgcgcacagcaattactgggaatatgccaagctccactctggcagggatgttcaagggtgacttagataaggcacgtacgcagttactcaagaatttcccagacactccagaagggaacttgcagctgctggcatacggaagcaacagcaaggatgcgtgggccgtcaacgaagcgcacaagcgtatgtcttcggatatggcacgtacgctgactacgctggaccagctcggtgaggacggtgaggtttcccgggagaacgtcaacagcatcaacttgtgggcacaagcttatagcaccagtacggacttagggaagatggcgctactgtctgaggttccatctgagtggcgtggagtggtgcagaaagctgttacacaaaacccaaataatgccagcaacactatcttggacgaccttcgccgccaggctaggaataaggcgagtgggcgctacagcaatattcaaagtaaccccacggacaagatggtggacccaagcggcacggctaactggttcagcttcttcggggatgcagacgcccagcgccaggaagcgcgagctgctatggaagacgagtaccgttatgtgtataaccacaatccggaatcccttgtagggaaggacgctgacgacatcaatacgatgctaaaaggcaatatccaatcccgtaagctggagctggacattgctggggcacctaggcatgtgtatctgcccgctggcacctctgtgcaatctatcatgggggattataagggtgaccaagagcaattcaaggcctccctgcagcagcatatacagaaccaggttcagtatatgtcagaccccagcaacatagagcgtgtagtagtgcaggccgccaccgcgggcaacgcaggtcagaacatgaccgtaaccgtgttcgacaagaagggcgcattccagactatgtctgtgaaccttcgagacgttcaggctactgcacaggctgcgtatgactcggcactagctggcgagatgaagattggcagcgaacaagtaggcgtacgtcccgctaccttctatgaccacgacaacggacgtgctgtcagcgtgcaagtcaacggtcgtaactcggtggggctggaaccatcactgtttagtgacattctcgccaccactatgaagttcgaagggttccgagaaggtaaaggcaagggtagtgtaggcttcggtctgcatgttaactcgggcatgcccgtcccacagaaagtgaccattgatgacggcatcagtatcctcaagtcctccatggagaagcagtacataccgaacgtgcagaagcaactcaaggggcagggtttgaatgcctccgacgaggcgttaaaggtaatggtggacctgaactatcacggtggtaacggtagctccggccctgtagcagaggcgatggcacaggtacgcaaggctgctaagtccccggtgggggcgtatcagtaccctgtatctgaggcccagggtagggcttggcaagcgctgcggaataccccggcgtacaagcaggcccaacctgagcgtaagaagtacctggaacaaaacctacgcgattggctctttgaagcaacgcactaactagaggcccttcggggcctccccttatcaaaattcttttaggagatattatggctcagtttctgaaccaagaaccgaatccacaggaaaaggattctgctaagggcgcaacacttaaacctgcgcctgagcgcgtagattggaacgatgccggggacaacggtctgaacgcactggagcgtgcctcattactggcacaggccaagacaccagctactacagccgcagagagctttgcatcgggtatgggtaacagcatcattgccgccgctatacgtaaggcctctgctccggcatttgaccgagacccgaactttaatgctaagcagaccctgagtagcgatactcgggctaaattgtatgctccgaatcaggaagagattgagtacctgcacgactctgtgtcggtagaagattacaactaccgcatgcagcagatgcttgagcagcgtgaccgtgaccgcttaatggcagacaacacagtggctgggttcgcaggtatgctggtaggtgactccccgtttatcctagccccgatgtctgctgctggtattgctggccgtgcgggcttagctgcacgtactgctatccgtgctgctgacgtagggtctgcattctatgcacaggaccaactgggccagtccgccgcggtaactgcactgatagcgggcgtagctgggttagaccagctctgggatatgtctagggctgctaaagctgccgctaaggcgcgtactgggcatgagcctatgttcgacccagaagcgcctacaacgcgtacagctagggatgctaatgttaccggagtaggagagggagaggaaatcctcactaagacactggatgaaagcatccaagtatctagaaacaataccgcctccgtgaacatgaaagcacagcacgtagttcagttcttgaagaagtctgagcacttgacagcaggacagaaggctattctggacacgttgggcgatgctgtaaatgacattgattttaaactggtagcaggctccgcaaaccgtagccgctacacttacgcacaacaagatttagctaagcgtggggagatatccctgcgcgcgcctaagcaagctaacggcagcacctggactacagtcggtgatgcgctgcgcgctatggatgcagatacaagcaaggtggccgtgcacgaactgattcatgccgctactgcgcgcgccattgacagtaatcccgagattgctaaacgcctggaggaagtgcgcgctgttattgcagctgactccactttgacaccgcgtatgcgatattacgctagtagtgtgcacgagatgctggcaggcttaggtgacagccctgagtgggttgagcacctggcacgtacgcagtctcccaccggtaagagcatgctccgccaactgggtgagtacatcatgaacgctctgggcatcaaggccaaaggctctgccttggaggatgtcctggatgcatacgaggacgccgttaagtggaccgctaaggattatgcagaccaagcccagagcttccgtagcgaagccttccaggacctggcggatagcaccaccctcaacgaggctaagcgcgcccaagctatgctagacggcgctaagaagaagctctccactatgtttgcactgtacgataatatcgcccaaggcaacgaagacttggctaaactgctagtgtcggatgcgtctgcagtaggcggccgtcgcccgtcagtggtagactacaagcgtaacctcactttggagatggatgctcgtgccagcgtagtggaagatgctatactgggcgcattgagggataagggtgtaggcgtactctcacgcttcttccatcgtagtaatttccgcgctgagcgggctgcgctggaagaccgcctgagcaagtacctggatgccgcttatagcgccgacgtaaacggtcgcgctgttccggtgccggatgcagagattgctccgttggttgatgcctaccgtcgctctggctgggctagcaagtggcacgagcatatgctcaatgccggtctagtggatgatggtgcgttggttaaatccgactactacttcccgcgccagtacagctatgacaagatgcgtcaaggtatcgcacagggtaacactctggacgactaccgagccctgttccgggccgccctgcgggacgtgtaccctagcatggagtcagaggtagtgcagcgtgttgccaaggagatggttgacggtatctacaacggccgtgcgggacagtctggccctatgtggaagcagctgattaacggcatgggtaacgatgaggtcgtcatggctatgcgcagcgctggtgtagaagagtctgcaatccagagcttcctggctggtaacgtacgagaatcaggcagcacatctcctgcgcggaacctgcgtcagcgtactcggttcaacatggacaaagagtacctgattaacggaaagagcatgcgcatgcaggacctgatggatactgatgtagccaaggttatgcacgggtacactaaccgtatgtctggacgtgtgggtatggcctatgcaggcgtacaggacctgggccagctagctaagatgattgatgagtctaagcatgcactggcggactccgctaagtgggagaagaccgtcaacgacaccatcgactttatcctgggcggagcacccgctgacgctggacagcttccggatttgctgcgtgcagccgggaacatggctaacgccaccatgctcaagaactccgggctgtatcagttgactgatactgctttggctatgaaggagttcggcatggctagggtgctgcgcagtatgcgagaccagccttggttcaaggaaggtgccgtagctatcaagaccccagatatggcttctcgtctagacaccgtgctgcgaggtaatatccagaaggagatgcgcttccgctggctgaatacgtacgctgacgataacctggacctgacccgtcaggcctcctggttcaacgtcactcagaacgttgggcaggctgcacgtcacgtcaacggcatgagtatggtgcaccggctgcaggttaacctgaactccggtatcgtggcagacgagcttacgcagatgttcaagggcgatgctgaggcgtttaagcgtctggagcgtttcgggcttacccgcgaaattgcagaccgtgctatcgctgccaacaaggctaacccgggcgccatgttccagccggacctgcagatacaagttgaggttgtagggacgcgtatgatggactacctggtacagcaggttcgtactggagagacctcacactttgcacagttcaaccctattggcaaagtcattgtagggtaccagagcttcgcactggctgccactaacaagattctgcgtagagagctgaacgatgctgggtggattggcgtagcccacattatggcgtaccagttcccgttaatgctgctggctactatggctaagcatggcatggacgggaaggacgtggacacccagaaactcatcggcgagtccgtaatgggtatgagtgccatcggcgggatatccttactgcaggatatcttcctgggagattctcctcgtcactcattagcatctatgggttacgtcacagggctgcttggagcggtgcaggacctggctaccggtaatatggatatcaagaccttcactaagcaggtcccgttaatccaggaattcgcacctacgcgagctataatcaataacttcggagacgattaatatggcattcagctggcaagagcaaatcaagccagctggtacccaggatatccagtgtgatattgagtatttggacaagtcctatattcatgtatatctcgacggcgttgaaaccactggatacacttggaccagctccactaatatcagactaaatacagccttggcagcaagcacgactgtgctgctaatccgtaagacagagcgagagtatctgtacatcgagttcgcaagcggctctccgttcatcgaggtaaacgtagattctcaaaatacccagttcttgcacctggctcaagagctggtagagggcagggctatccccggattctacggggatataagcatgaatgggtatcgcattactaacatagcggacccgacaggccctcaggatgccgcgaccaagaactatgtagatgttggtgatgctaggcttgacgcgcgcattgactcagaacactcagcctgggtatccgccgtgcagacagaggcggctatccggaaggcagtggacgacgcactgagcgcccgtacttccgctttggagaacacctttataagcggggtagagacagttagctacccgtggagcacggtgctgaccgaggatacggacgaagtgactcctggcctagcattcaccaaggctgtagtggagattaacggggttgggcagattcgcggttacagtttcgagattgtagataatacgatactctttgcagagacattacctgcaggaactattgtagccgcccgactgggggtcgacgtaactgcgggggacggattcgctacacaagcatccgtagattacttggccgactccttggggaatttggcgtatctggataaagccacggctgtatctgatgcaacaggtactggagacgtagtggctcaactaaatgcgctgctggcagcactacgcactagtggggtgctaggaacgtaacaggagaaagtatggcaggggcggctaaacgtagtcgcctctcagagctgcaccgcatgttcactgaggccttgattgaagaaatcaagcagtctaaggaagatgaggtgccgctccccgccgcagataagtcagttatcgctaagttcttgaaggacaatgacatcaccgcggatgcagattccgaggagatgcaggaccttcgcgacgagttcgatgacgaactagcggcgcgcagagaggcgcgtaagaaagagattttaaacaagattagtggttcagattctgaggacttactagaaggaattgtctaatggtatcggtgaagactgcgcgaagactgcgcatgctcaaccagaaacttactggttatagcgcgaatccgcgcagtattcccaaagaggagcgcgaggacatcgcgatgatgatggccgcggcgctgagtgacttccgggaatttgcgtacatcggtatgcggttcctgggctttacgctcacggacatgcaggccgacattgcagagtacatgcagaagggccctaggaagcgcatggtggctgcgcagcgtggtgaggctaagtctacactggcagcactctacgccgtctggaggcttatccaggaccaatcctgccgtatcctgattgtgtccggcgcggagaagcaggcgtccgatgtagctaacttaatcattcgtatgctggaaacctggccgctgctgtgctacttgaaggctgaccctactcgtggggaccgtacttcattcgaaggttacgatgttaactgcgacctgaaacctctggataagtccgccagcgtagcctgtgtaggtataaccgcatccttgcagggtaaacgtgcggacctgttgattccagacgatatcgagaccactaagaacggcttaacgcaaacccagcgtgagcagctgctgatgatttctaaagacttcgcagctatctgtacgcacggggatacgctgtacctgggtacaccgcagaccaaggacagtatctacaaaaccctgccgggacgtggcttcgaggtccgcgtgtggccggggcgcattccgtctgttgaaatggaagagcgatatggaagtacacttgctccttatatcctggagcttattgagcgcggctataaacgcaccggcttcggcgtcgacgggacgctaggcgagagcacggacaccggacgctatgacgaggatgcgctgattgagaaggagctggactttggtccggaaggcttccagctgcagtatatgctcgacaccacactgtccgaccagatgcgtacgcgcatcaagctttcggatatgctggtttactctggcagccaggattcctccccggagacgttctcctacatcgcggaccgccggtacctgtaccagcacgagcatgaggggattatgggtcagcagatgtacttcccggcattctatggggacatgcacctgccgtaccagcataaggtgctggtggtggacccggccggttgtggcggagatgaagtgtcctacgctgctggtggtgctgcgaactcgtacattcacctattctccgtaggcggcttccaaggaggtatcagcgaagagaacattgataaactgattgacctgtgcgtagagttagacatcccggatatggtggtggagagcaacatggggcacggtaccgtgtctatgcttatcctgaaccggttacgggagcggcgtctcgccggtattggtgtacgggacctgaacaactccacgcagaaagagcgtcgtatcatcgacacaatcagcccagttactcgccgccaccgcctggtagtgcatgagcgtgctattcacgatgatatcagcacttgtatggcgtacccccgggataggcgttggctgtactctgcgttcgcgcagctgtccggcatcacgtacgaccgcggtagcctggctaaagatgaccgggcagacgcaatagccatgatggtggctacgctgaacgggcatctggtggaagatgagaaagtggtggctgagcgtgagtccgagaagatggctcgggccttcattgagaacccgctggattgggcacagagcaaagtgtctaagggccttcggggtgtagctgctcggctgcagaaccgcggcagaggtaaacaacatagaggaagaagataatggcatcaatcatcgcagctaaagctgtggatgtacagtatgagattgtgggtaaggcccagaatctggagaagcaagtatctccagactacaacgtgggctttgtcggcaccgcggccctagacactctgaatacgttctttacgtatatggagggtcagggctataccgccaccgcggaaggcgctagcttcgttgctgacggcacgctacaggctcgtctattcagtatgctgtcgcagctgagcaagaccggctacgttgcgctgactggcactggtatgccattgggtgagggttcaggtaccgactttgatacctcattcaccgccctgcaatctgcatttgaggctgctacagtagcggcagaagctgaataataaaccaaaggagagtacacatggcaattgcaaaagcaaccccagcgcaacagcaggagctgctgcgccagctgaacattctcggtaaggacctatatgctatccttacgcagccgcagaacgtggcccagaccggtgctgccttcgataccaagattgctgcacttgaagccgcggtagccgcagtgaaggcggcaagctaatgcgtaaactggtcgctgggttactgctcgcggttactttgactggttgctcggcgacctctgcactcaccggcttagttggttctaagccggatgtatctgctcaggttggtgccgaaaacaccaagcaaaccgttggcctgaacaacaaggtggactccagcaccaccaacaaaaccgatgtatcagattctaacgtaggcactttggatacgtccagcaagaagcaggtgcaaactattagcacggggacaatccaggcagaacgcttacaggtagttaacaatgatagttacagtcttatcctcgccggattagctggggccagcattcctctggtcttcctagtggtcattctggtgattcgtaagctattcaggaagaaggggcagcaggatgattaaggtaggggacatggttgggccggacctcgctacccgggcaggcgcagcagttactggcgctacggtatcaggaggttggttggcagagttaatgagctggaactggagcactatcagcttcatcactgcgacggtgtgcgcggtgctaaccctggcgtggaatgcgtattacaagcggcgtacattcaagctcctagaggagcaggcacgtaaggggactattaaatatgagtttaaggactaaggttattgcggccctcacgggggccactatgctcggaggcgccattaccggcgtagtgcagcacaacgagggtctgagccttaccacctacaaggatagcgcaggtgtccccactatatgctatggcgagacaaagggcgttaaaatgggccagagagccacgctgagcgattgtcagaagcagctaatacaatcagcaggggaacacgcaaaggctcttgacgggcttcctatgcagctctctgacgtagccctggttgggtctgtagacttcatttataatgtaggcgtagctggcttcaacggtagcgccgtgaagcggcatctcaagagcctggattatgcagcagcagggaaggccgtactggactggcgctatattagcaaataccagcagaaatcccccggcaccggttgggtgtacaagggcagcaaccgctggaccttcgactgctcccagtatattaatgggcagcgcaataaagtgtgctggggcctatgggagcgcaggcagtggcagagcaaagccattgggaaccagtacaagaatgtaagcacagccctggctgaattgaaacgataagaggggacacatggcactagtagagaacgtacaaacacggtactacagccaagacgatttgtggtgcagagtagctgactacttagcgaaggatgccccggtacttaccggactccgtccggattcttctggtaactatgcagccgctattgagcggatttccgctaaaggtgtaaaggtgctgcgagtacctgtggggtcttattatgttggagactgccaccttactaaccctatgctgtttataggtgatggcctagagggcgttaacccgcttggggctgtattcgttaaaccgagcacagccagtaagatgttctactttgacggtacgagcacccgtggaatgggcggcgggttccttagaatgcgactgcagggggctgtcagcagtgattcgggacttatggtggaggtaacgtcctggagctattttggggcggaaaactctgcttttaataacttggcgggctctgcgctggtgttgcgtgactgtatggagagtcacatctccggaaacttattccgtaggatgggtgcctctaacggcagcgttatactcctcggggattacataggtattcctaataataacgtcaataacctgcacattcagaataacacattcgggttgtgctctggtgcgtggattaagagtacagcaaacagtaacccggacctggtgtggattacggataataagtttgagtgggatagtgtaccgtacggagctaacacaaccacgcagcacgtactagactttggacagctgtcacgctcttggattacccgtaacggttttgcgcacttccgcccagactccgaccataacctgtatgccgggtgtattcgtattaggtctggagctgttggtcctattgttatttctgataacaaggcgtatgggtgcgaaggagaattctggaccattgaaggtggttatgtagatgccttcgacaatgatgcgaacattgcagatgccagcagtgttctatcctggtcactgagtagtactagggcttgccgcatcaaccctcctcgcgtatacagtgggaacatgaacgtagtgcgcggggatagtccgttcggccctgggtttatcgggcaggcgtacatgcgcggggctgctgctgctagtcgtaccgttagggctggagccgctagtaccgtggcactagatgtccctgcgggccaggagatgcgtcggtaccagttgccactgcaccttctcggggctatagtgcgcgtatccttgcgagtctacaatcccggcgctactggtaacataaccttagcagtgggtagtggcggctcctctgttgctgcggtaccggctggtccagggtggttcgatgtagacttttacttgggtaacagcctaactggggacggagatttgcgcttcaccaacagcaccggaaacacactgagcctggatggtattacagtagagcgtgctcgttctgttccatttagctttgcgtggaccccaggtgctgtcgctgctggtacgctggtatctagtcctgtgcaaaccctgccgtacggcattactcaagcccctgtcggtttgagttctccggtatttaacgggtctgttgatgggctgctagccggtatcagtagctacagcgggtacagctcctacaaagttactctgtttaatcctggggctactccaattacccctggggctactcgggctagcttggtgttgcacttctaatgcacagcgtaaaacccaggcccagtctaggcgagcaggtctatacctggacctgaaatttattagactcacgcgagcccctccctcaccctcaacgcgcccaattgcccccatagggggtgcctagcgtcaatttagggggggggggcactgctagggcctgctagtgcgcaccagcgggcctcagcgggcctgtgctgcgttctagggctatcgctagtgctaccctatggctatccctgtgcgttcactagggcgcttcctgtgcgctctacggggcgctggggctatccctgtgcgctccctgtgggccataggggtgcgccatgccttgcttattttgtgcgtccattgcgggcctgcctagtgcctgcctagtgggaccagtagtgccgccgtagtgggccagctagtgcgctgtagtgctatccccggtgctatccctagtacgcactaggctatccactggctatcgctagtgctttacattgtgctgattatatgctacgctgcgcgctccccactagggcgcacttccactatccagcgctctcccaatgctatccctttgctcttactttcattcgaaagctattatgaaatgaagtaaccggagtaggaggggtttagggacactatatacactactactcactatgcactccctagtatgtccctgtgcctacgcagtaggctgacatacctacacagtcaccgcatcactacgtggcttcactctcgttacgccactgcgttctgctctttgtagtattaggtagtattggctcgtaatggctagcagtggctacagctagtgccagcatagggctatccctgatgtggttctaagtatttaccctgcttaccctttttgctcccggtgataaaaagcttaaaaaagtgcttgcttcttttggttcaatgggtctatagttcaatcaccgggaggcgctgaggtgctaaccggggccgagccgggaggctccgctggattaaagctagatagtgcgaagggttagacactcgataaaaagagttgacaccgcgaagggcataagctagattgagtccaagcagtaactgaatatgtcgtgtaacagtaaatgcgcgattggaaccctaaccacgatagggcgctgagaggctaacagcgagataacccctaagaagtgatgctcatcggagtttagggaaacaggctggttgggaactaccgaataccccgagctggacagccagcaagtagtaagaaataaacgcttgacaagttctgattcactgagtaacttagatagcaagcagtaagctggttcgcggggaggcccagtaccttgactggtacgatgacgaccgagcctagataatcagttaaaaagagtaagcgtgccggacgttatcaccggggttctgaggcaaaccatactgccgaggcgagagcagctcgctcctctgaatcgagggaacaaggcgcggagtgtaccccgcaaagagcatataacatagcgtagcagtaacaaggctgcgctagattatgtactctgagaggtgagattatgcgcaaagcaaaacgcctagcattacggcggaatatgcagttatcacttaaccctaccgataacgtgccgcttactgtgaagcccagcaaacaagggttgagcggtgagcacagggtgaggggaaagcaaaaacaaaagggcggcagtaaacagcctagtgggtggcctactgttaactcccaatttgggcactaattacagcctatagcatcctatggggtgctatgtgaagtaattatctaagcaactagggaggtgccaaatggttggctacggtgaaggttaatagcctatagcgtcctacggggcgctatgtgaaattaaccgatagtaaatcaatcaaagaggtgtattatgacccattcaactggtaaagtattcaagctcaccgctgcgggtagcattcgtaaagcgctgggcgacgtagtggaagcaaagcgtaacatcactatcagcgcgctcttccacggtcttatcagcagcaacgtttcctgggctacggatatgcagcgcagtgacgctgctgactttgatatggtgctgcgtacgctattacccatcaagttcaacaaagagtccggtaagtacgagttcaacgctaagaagtgctatgcgtcggctgagaagctgggaatcgaactggacactatgcgtcttgactacaaacaagctgacaagcagggccgcgaagttattgttgccagcttctatagctcctgtatggccctgtacgctgccgaagcggagcaggtgaagaatgacgcgctggacgctgatgcagtgcgcttgcaagcgctggggcgcgttaaaaacgccattaagaaggccaaagagactggcgtaagcgacgcagatttggtgagtatgctcattaatcagggcgtggatgtacgtgctgtgctggacgcaactttgaaggaagtggcctagtagcaagcctatagcgtcctacggggcgctatgtgaatgcaactggcgtatgaggtttcatatgaaagcaatactggtctatccgggccatgaactctggcccgtgtggtgcaatcggatatacgaagaatacagctacactgtggttatattctctgacaaagacactaatcaggaatcccctttagaatttgtggatacctacaccgaaatggctgcccgcactgtgctggacgccgtgaatcttggcattatcaacgactggagacaactttatggttaacgtgttcaacatcattgtgaccagcgctatgctggtgctgggcaacgacgtaaacaacccggtgccctattgcacagtgcagttgcagcaaccggcggcgcagcaaccgcagccgcgccctgagtatgacctctttgaagaccccgagggtggttgcaaagagctgggcgcgcgtatccttgcggcggtgcaggagcagtacccggacgccgctgtaacgctcacggtggacggtaagagcaacaacgatatttgaggtagggtatgcacggaaagaatcctgagacgctgctgatgtgtaggcagcaaccaacaatcgaaggactggcgcgagagtacagcgcgaaggcagcgctgcgccagcactacgagaagcaagcgcagcgcctgggtatgaccttgcgaggctactgctaccggtttaatgtaaggggtattgtatgagcaaacagaacctgtacgacgtatacaagcgcccgaatgggctgctgtaccgggtgccgctgcgcagcccactgcataagcgcgcggagttctatgcaaagcatttgcagcggtggataccatccgggcacaaggttggtgggttaatatctagcgaccgcagcgccatcgtagcccgcaacgtggtgttcaaggacagcgtatgctcacagtagacgaaacagcgctgctgtgctggcgtctgctggaaacgcagggcaagtgcggctgcacttgggagacattcaaagaggttcctaatgaactcaagcaaatcgtgccagttgaacgtcgactactccgagttagaaaagagggggttggcactgtgctcacaacctaccgggagtatacagagtctgccgcgcggcggttgcaagagcacattcagttcgatgtggttgcggctctacggcggtacgggtatcgtggagcttttacgcaatttcgggccgcagtccgggcttattacaagcagcaacaactcgctgcgtggtacgcacgctgacctcgttattactgacgaactcaaagaatctattcaggagcaaa

SEQ ID NO: 53 - DNA, 524752 bp, Unknown
  source: /note="Description of Unknown: KP2-Mcoc1 Bacteria Sequence"
agaatttgcctggcggcactagcgcggtggtcccacctgaccccatgccgaactcagaagtgaaacgccgtagcgccgatggtagtgtggggtctccccatgtgagagtagggaactgccaggcatcaaataaagcagaaagcccggtcgaaagaccgggctttttgttttatctgttgtttgtcggtgagcgctctccagagtaggacaaatccgccgggagcggatttgaacgttgcgcagcaacggcccggagggtggcgggcaggacgcccgccataaactgccaggcatcaaacaagtgaagagcccatcctgccggatgggctttttgcgtttctggcgtccggccagcgtgccggcatgcctccccggtggcgctgcgcttaccggggctacggatccgacacggggctacgtccctgtggccggacaaggtgcgcagcaccgcctccgggaaaatccctcctatatctcctttcaacgcaaaataaaaccccgtcatggcaatcccttcgccataatccactttttccctgcccctgcgctggcgatgatcgcgaaaaccgtgcttgcgaaaaaaaatgtgaatccaatcacatataaaaatataacaattatataacatttagtttactaattaatttgtctgcgtgacgtggtacgcccgacaagacagattgcagtctttgctggagcaatataacaatgacagaaagtagcattaccgaacggggcgcgccggaactggccgatacccgtcgtcgtatttgggcaattgttggcgcttcctcggggaatctggttgaatggtttgatttttacgtttactcattctgctcgctctatttcgcgcacatcttctttccatccggaaataccaccacccaactgctgcaaccggcaggcgtatttgccgccggatttctgatgcgtcctatcggtggatggctgtttggtcggatcgctgaccgccggggacgtaaaacgtccatgcttatctcggtctgcatgatgtgctttggctcactggtgattgcttgtctgccgggttatgcggtgatcggcacctgggccccggcgctgctgctgctggcgcgtctgttccaggggctgtctgttggcggagaatacggcaccagtgcgacctatatgagtgaagtcgcggtggagggtaagaaaggcttctatgcctccttccagtacgttacgctgattggtggtcaactgctggctgtattagtggttgtggcgctccagcaggtgcttagcgatgaagatctccatgcctggggatggcgtattccttttgccctcggggcggtactggctatcgtcgcgctgtggctgcgtcgccagctggacgaaacctcgaagcaagagacccgggcgctgaaagaggctggctcatttaaagggttgtggcgcaatcgccgggcctttgcgatggtgttaggctttaccgccgccggatcgctgaccttctacaccttcaccacctatatgcaaaagtatctggtcaacacggcgggcatgacggccagcaccgccagcgtgatcatgaccgcggcgctgttcgtttatatgctggttcagccgctattcggcgccttctcggataaagttggccgccggacctccatgctgtgctttggcgtgctggcgacgttatttaccgtgcctattctcagcgccttgcaaaaagtgagctcaccctatgccgccttcggcctggtgatctgcgccttactgattgtcagtttctatacctcgatcagcggcatcctgaaagcagagatgttcccggctcaggttcgcgcgcttggggtcgggttgtcctatgccgtcgcgaacgcattgttcggcggctctgcggagtacgtcgcgctgtcgcttaagtcggcagggatagagcacgcgttctactggtatgtgacggtgatggccgccattgccttccttgtctccctgatgttgcatcgcaaagggaaggggttgcgtctgtaacgcttactgatgagccaactgccatacagcgtagccggtggtcgcgccggcgacatcccaggcaaaatccttccagctccagccgctcccagccgggcggctgtcccaaagctcttttgaggcgccaaggctgacggaaaacatcaggccgatagcggcgctgcggtcccggctgtaaccctgatgttgcgcatattcattgccagcggcagagagcatcgctgaggccagaaaatgctgggctttgtcctgaccggaccatgcatcatttgccatgtggctgcagccggttaacagcagcgaagcaatcactattatcgtacgcatagcgcttccagaaaaaagccccgtcgaggcggggctgatagtcagagaatacggctgatcagccggtcaatgcggatccgccgcaggcggcggatcagttttcgcactttcaccggatagtcggcgatactttgcagatcccgataatgtttcactaccgtggtgtgggtgcggatgagcttcagctctttctcccgcatggcccccagctgccgctttggatcgtggatcagaatggcgttttccagatcgagccgccaggcgcgcgggttcaggttgttgccagtgagcagcatccactcatcgtcaacccacatgcctttcaggtggtagctgttatcgtcatccttccacaggcggacgatcagctgatcggtattgacataatactgcagccggctgaggaaacgccgcaggttgatctcatacagatagggaagggcgccgatgattttaaacggctgatcttcaggaatgtagaaatcgttagccgttttatcgccgacaataatctccacctgtttaccgtcgcgcagcagctggatgatatttcttaccagtacggcagggaggttgaagtagggggtgcagatcgtcagcttgtgttcggcacagggcatcaggtgaaagatggttttattcagcaggctcgatttacccaggcctaccagcggggtgacggagagttcttcgtcaccagcggtgccgacaaaatggtagctgcggtcgcggagctcctgacggtactggcgaatgtcgtttttgatttccgggctttttggccgatccggtctgtcgagacggttaacgccgcgcccctgaaccagattgttgtcgacccagtcgaacatgatgtccgccattttgccgttacggatgcactgatagcgatcatagcgatacttatcatgctgatgcagataaacatcattcaggctggcgccgctgtagaggacgcagtcatcaataataaagcctttgaaatggagaacgccgagcgcctcccgggtgttaatcggcacgccgtaaacggggatatctacccctggattttcattggccatccgacaataccagtcggcattggtattagaggcggcggcgccgatacggccacgctgagcgcggtgccagtccaccagaacgcggacatccagttccggacgctggcgtttggcgtcataaagggcctgcaaaattccttttccgccatcatcttgctccagatagagcgcaataatgcatatacgctgagtggcgtgggcaatccgggtcagtaacgcttccctgaattccgcaggggcgtaaaagaactctacatcatcaactgactgagaaagcttagggagttgggcaaggtgttgttgatgtttattacgcttaaattttgacaacatcacagtgcgtttcttctctgtttattgaagggtcttctgtaccatgcagacgacgtaagcgggcaataataccattactacccgctaatgtggtcaacaattgcggtcagcgtcgcgcgattatccctgattcaggggcagcgacaggctgacaatcccatcttccagctgaatatcgacggtgaatcccagctttctggcgaggcctatcatgcctcggttatttggcatcgtaataccattaaggcgctgcaggccatggctttgcgtataggcgatcagcttttccagcaaccttcgccccaggcctaacccttttaaatctgaacggaccagaacggcaaactcggcgtcaatattatcgggatcggagatcgcccgcgtcacgccgaggatctcgctcttctctgcgctggtcctgacggcaacgaacgccatttctcgatcgtagtcgatctgggtcatattggctaagtcgtcatgggtaaattcgttgatctcactaaaatagcgataatagagatcttctttggtgacctgggcgataaatgcgagcaactgtggctcatcttccgggaggatcggccggaacagacagcgatcgccatttttcatcaccacccactcctccagttggtgcggatagggacgaatagcgagacggctttcactgtcgccgctgaagggagcaagccccagggtaacgtccagcgccgtaaactcgttgccggaggcgagcaggggatgaatatccaggcgctggatctccgggcagtcgacgatcaggttcgagacctgaaccagcagctggcttaagccagcgatatccagcgggcgcaaggcgctgcggccgcggatcttcttatttttgatcgcctggatcaccagataacgcgccaggttcatattcagcggcggcagcgccacggcggcctggtcctcggcccgccactccacgccgccctcgcctagcataatcaacgggccgaagacgggatcgtgctcaaccactactcttagctcctgggcgccagcgcgattggccatgctttgcaccagcaatccatgaatgcgcgcctggggccaggccagtttgacgcgatcgatcatcgcatctgcagcctgctgcacctcggcggcggtacgcaaatagagcatgaccccctgtacttctgatttgtgcgggatatccggagaacgcagcttcagcgcaaccggatagcctatctgctcagcgatatgcaccgcttccgcgctgtcagcggcaatccaggttggcagcgtgtggatgccataggcccgaagcaccgggctgacctcgtgagtatccagcgtggtggcgccgtcttctatcgcttgctgcagcagagcatgcgcctcgctggtattggcggttaaggagtctggtagcaccggcgtctcgcgcagttgtttctggttgcgacggtattccaccatatgcataaaagcggtgatcgtgccctccggcgtacggtaggtagggaggccggcatcgctgaataaacgtcgcgcttcctgcgaggaaaattcgccgcaccagttggtcagcacggtgacatatttaccgcgcgggtgatgcttcagagcgtcaatcagggccagggcactctcggtgcccggcgcggcggcgctgggagagtggatcaccagcagcgcgtcatagtcctgactgttgagcaaaacattcaccgcccgctgatagtgttcgctactggcgtcatcgcgtagatccagcgggttggcgatctccacgccaaccggcaacgcctggcgcagggcgtcgcgcgtctcctcgctgagagtcgccagcttaccgtttcgcaaccaaagctcatccagcgccagcgccgccggcgccgcaccgttgctgacgatcatcagtttttcaccgcgcagcgggcgcatgtggctgagcgtttccaccgcagagaacagctcatgggtatcctgcacccgcagcagaccagcgcgctgaatggccgcatcccatgccgggtccatcccggaattggcgtgcaatagcttctgcgccgccggactacggccgcttttaatcaccaggataggtttgtttcgcgaagcgctgcgcgcggcggagacaaagcggcgcgcgtcgctgagatgctcgaggtacagcaaaatggcgctggtcttgctgtcgcgggccagaaagtccagcaggtcatcgacatcaatatccaggctatcacccagggcgatgaagtaggaaaaacccatctcgcgctgttgcgcccagtcaaggatagtattggagacggcggccgactgcgagataaaggccagtttaccgcgatggatcggcaccggtgaaaagctggcgttcagcccttgccatggggccagcagtccgagactgttggggccgagcagacgcatctgatagcgcgcggcgcattcgagcagcgccgggtactgttccggctgcgaagagaggatgatgcaggtcttgcagcctttttgccctaaggcttcgagcaattcgagattacgcctggcgttagtacagagcaccgccagatccggcgtaaacggcaggctctcgatggtaggccatgccagtaccccaagaaccgccttccaggcgggggtgaccggcatcaccgggccattgaagccgccggctaacaggttgcgcatcatgagatagccagcgcgctgcggcttcattgatgcgccaataacggcgatggactttggtcgcagcagcgcttccaggcctcgttggctcataccggtctcctttcatcccagtgaccgaatgattttaaacgttttccacctggcccgctgtgatactgcccttatgctgggtttttcccgccagatagcgggtccggaagcgggtgaagtgctcgccaagcgcagcggcggccggggcatcgcccgccagatccagcagggcgatggccacttccgcggtacaatattgtccgtcggcgtgcgcctcgcgcagatggtaggcagagatgcgcgacagatcgacggagataatcggcagcgcgtcgagataaggactcttacggaacattttgcgcgcttcggtccaggtgccgtcgagcatgataaacagcggcggtttaccggacggcggcgcgctcaggacctggcgatccggcccggcataggaggccggaaatacgaccatgggctgataatcaggatgggcgaccagatcgagcagcgcctgcggcggttcggtacgcgaccactgaaacgcttcggtatctggcagaatatcggcgatgagccggccagtgttgctgggcttcatcggttccgtatcaaacatcaccaggcagaagcggctggcggcctgcgccgaggttaacgtggcgcacaggcactgcttgagcggcagcagacagcgctggcagcggcggatgcgattgccgcgcgcaaggaaagggcgggtagctcgcgcgagacgttcggcgcgcaggcgaaggacagcgttatcagtcatgggagtcgctagtgaaaaacgctattgtcgcagaggtgaaaacggggcacaagcggtgccccggaagggttattgttggccggcttcgttaagccagctatcgaatggcgcttttggcactgcgccattgagcatgtcgatcacttcgccatttttgaacatcataatggtcgggatgctgcggatacgaaaccgggcgctaagctcacgttccgcttcggtgttgactttcacaaaacgcatcttcccgctacgctcttccgcgacgtcttcaaagatcggcgcgaagctacggcagggtccgcaccatggcgcccagaaatcgacaacgaccggcagatcgtccttcaagagtttatccagcgttgccccggtcgcgttgatgacgtcgccgtcaaaaagatcgtgaccgcagcgtccgcactttgcgccatccgcgctacgatcgtccgggaggcggttcagagcctgacaactggcacaaacggtattcataactaacctctggttatgggttgcaacgtggcacgtggccgatatgtttctgtgatgttacatattatcgatgaagtgttatttgaggacaatgcgttttgttcgatgagtgcaatagaggccggcttttaaacgaaatcatggcgaagcgatgacacatcgggtaatctgcgcgcttcgcgcagcgcaggtggagaaaattgatgagcgacgaactgaaaaataaaagcggcaaggtcaaagtgatgtatgtccgcagtgatgatgattctgacaaacgcacccataacccacgtaccgggaaagggggaggtcgtccaggaaaatctcgtgttgacggccgcagccgccctgcgcgtgacgaacgaaacagccgcggtgacgatcgcaaacgtgacgaccgtaagcgtgacgatcgcaaacgcgatgattttcatcgcgacgatgcgtctccgtggcgtaccgtttcccgcgctcctggcgatgagacgccggtaaaagaagatcacggcgggatcagcgggaagagctttatcgatccggaagtgctgcgtcgtcagcgtgcggaagagacccgcgtatatggcgaaaacgcctgccaggcgctgttccagagccgtccggaagctatcgttcgcgcctggtttattcagagcgtgacgccgcgctttaaagaggcgctgcgctggatggcggccaaccgtaaggcctatcacgtggtggacgaagccgagctggcgaaagcctccggcaccgagcaccacggcggcgtctgcttcctgatcaaaaaacgccacggcacttctgttgctcaatgggtcgcgaaggccggggaagaagattgcgttctggcgctggaagatgtgggtaacccacataatctcggggcgatcatgcgcagctgcgcgcactttggcgtgaagggcgtggtggttcaggatgctggcgtgctggagtccggggcggcgatccgtacggcggagggcggtgcggagcatgttgaaccgatcactggcgacagctttatcgataccctcgatcagttccgcaaagcgggctacgcgattgtgtcaacgtccagccataatggtaccccgctgtttaaagccgagctgccgaagaaaatggtgctggcgttaggccaggaacgtgatggtctgtccgatgcggcgatttccagcgccgttctcagcgttgccatcgacggtaccggtaatgtcgaaagcctgaacgtctctgtggcgaccggcgtcctgctggcggaatggtggcgtcagaacaaggcgtgattcgcctgcctgaatgcaaaaaagccagctgatgctggcttttttttatggctgtcaatcactcgctttcagcgggaaggaccggcatccagtcgatcggcgtttcgccgcggtcaaccagccactggttggtctgtacgaaatgattgcagccaaagaagccgcgatgcgcagagagcggtgatggatgcggcgccttcagcacgcagtggcgctgacgatcgataatcgcgcctttcttctgcgcatgagagccccacagcagaaaaactactccctcgcaatgctcattgattaaagcgataaccttatcggtaaaggtctcccagcccagactggcatgcgagtgcgcctgtccggcgcggacggtcaggaccgtattcagcagcagcacgccctgtcgtgcccagctttcgagataaccgtgggtggggcgggtaaagccggggatcgtggcctccagctctttatacatattcagcaacgaaggcgggatcgcgacgcccggacgaactgagaacgccagaccgtgggcctgacccgggccgtgataggggtcctggccgagaatgacgactttgacatcgcccagttcagtaaagcgaaacgcattgaagacgtctttttgcggtggatagatggtgatcccggactggcgctcttcggcgacggtcttcagagtattgagaaaatagggttgttgcttttcatccgccagcacgtcatgccaggttaaaggggtggtcatcttgctctcctgcaaaagggtcatcgctatagcttaacggcttctttctatagaacaaaatcggcacggcttgatgccggcttttatgcaaaaaaaattgaaaatttacaaaattatttatagctcacaatggcgtaacttgatgtaaaacaataaaaacctcctatacccacgttgggtgagtggtttttattgatttatatcaaggaatgccgagggtgcggctgatatatatacactcatacaacaatggttttaccaattggccgcgaagaggccaaaatcgaataaacactgcctgggaggcatcaaatgattactggtatccaaattactaaagcggcaaacgacgacctgctcaactctttctggctgctggatagcgaaaaaggcgaagcgcgctgcctgtgcgccaaaggtggttttgcggaagatgatgtggttgcggtaagcaaactgggtgaaatcgaataccgtgaaatcccggtggacgtgaaaccggaagtgcgcgtcgaaggcggtcagcacctgaacgttaacgtgctgcgtcgcgaaaccctgctggacgcggttgagcatccggaaaaatatccgcagctgaccattcgtgtttccggctacgcggtacgcttcaactctctgacgccggaacagcagcgcgacgttatcgcccgtacctttaccgaaagcctgtaaggctaacgccagatgtgaaaacgccgggatatcccggcgtttttttactcatcgctggacgctgatggcgtcccggccgcgcttggcttccggcgcttaccgatatttttcgtatcgcggtggcgcttcttcacccgcggtttctctttttcatcttttttcttctgcgcacgcttcgccagcactttcttcgatggcttacccgtcagcttctcgctcggcgcacgggtcttcgggcgcagttcatcgataactctggctttcaacggctcttcaatatagcgaccaatcttacccagcagcaggtggtcatgagcctcgaccagagaaatggcggtcccttttttaccggcgcggccggtacgaccgatacggtgcaggtaggtatccgcggtacgcggcatatcgaagttaaagacgtggctgacgtccggaatatcgataccgcgggcagcgacgtcggtggcgatcagcacgttgacgcggccgtcggtcaggcgcttgatagcttcgtttcgcttggcctgcaccatctcgccttccagccagcaggtgttaatcccggcctcacgcagccagttagccagctcatgcacgcgctcacgcttacgcacaaacacgatagcgcgggtggcttccggctgttgcagcagattcaccagcagtttggttttatgttcgatatcgtcggcgcggtagtaccactgatggattttcttacgctcgcgggttgacggattggcggaaacttcaaccggctcctccagcagacgctcagcaaagtctttgatcgcatcgccttccagcgtcgcggagaacagcatagtctgcttgcgccagcgagtttcaccggcgatggtttcgatatcctgggcaaaacccatatccagcatgcggtcggcttcatcgaggattagggtctcgacggcgcggcagtcgaaattctcttctttaatatattgcagcaggcgaccggtggtggcgactacgatgtcctggttttcgctgaacacttccgcgtggttcatgtacgccacgccgccggtaatggtagcgatgtccagatgggtatgcttcgccagctcgcgggcgtggtcggctacctgcatcgccagctcacgggtcggcgtcaggataagaatgcgcggcgggccggatttcttacgcgggaaatcgagcaggtgctgcaacgctggcagcagatacgccgccgttttaccggtgccggtcggcgctgaaccgagaatgtcacggccatcgagcgcaggcggaatagcggcggcctgaatggctgtcgggcgagtgaaacctttatcctggagggcttccagcaggttttcgtcgagttcaagttcggaaaaagtcgttacagtcatgttctacctctgagtgggccgccgattatagacgttactgacgtaatgttcatctgtttgtaaggctatctgttctccggtattgtgcatagccttaggttcaggagtttttgtcggcaaggttattgaggatgtctcagtcgaagtttgcgctgccgcgcaatggttttaccttcaaacggttctttgtcgctcacgatcgctgcgccatgaaggtgggtaccgacggtattttgctgggcgcctgggcgccgattgccggagtgaagcatgtgctggatattggcgcgggcagcggcttgctggcgctgatgctcgcgcagcgtaccggagatgatgtgcatgtcgaggcggtagaactggacgaagaggccgccgctcaggcgcgggaaaacgccctcgcgtcgccgtgggcttcgcggattgaggtctggcaggccgatattcatcagtggcagcagtcgcaaactcgacgctatgaactgataatcagtaatccgcccttttttgccgaaggcgtgccatgcgcgacctcgcagcgagagcaggcgcggtacaccactacgctcgatcacgcctccctgctgacctgtgccgcagagcatattaccgaagaaggttttttttgcgtggtgttgccggtggatattggtaatgctttcatcgaacgggcaagggcgatgggctggcatctgcgactgcgtactgacgtggcggagaccgagctgcgaccgccgcatcgggtgctgctggctttctccccgacggcaggggagtgtttcagcgacaggctggcgatccgcgggccagagcagcaatattcggaaggctttaccgctctgaccgaggacttttatctctttatgtgagccaggggcgagagtatcgacgggccgctgtcaggcagcggctgcggatagtcgagggtataatgcagaccgcggctctccttacgcaacatcgcgcagcgtacgataagctccgccacctgcaccagattgcgcagttccagcaaattattcgagacgcggaagcgggcgtaatactcatccagctcctgctggagcatggtaatgcgccgcagggcgcgctccagcctgcgggtggtgcgcacaatccccacgtaatcccacatcagcaggcgcagttcgtgccagttgtgctggataaccaccagttcatccgggatctccacctgactttcatcccatgctggcagcgtggcgaccttctgggcgagcggcaggcgccgggtaatatcctccgcggcggaccagccatagaccaggcactccagcaacgagttcgacgccatacgattcgcgccgtgcagcccggtgtagctgacttcgccgatggcgtataaaccatcgacgtcggtgcggccattatcatccaccatcacgccgccgcaggtgtaatgcgcggcggggacgaccggcaccggctctttggttaaatcaattcccaggccgagcagcttttcataaatcatcgggaaatgctggcgaacaaacgcctcgggtttatggctgatatcaaggaacatgcagtccacgcccaggcgcttcatttcatggtcgatggcgcgggcgacgatatcgcgcggggccagctcgccgcgctcgtcaaagtccggcataaagcgggtgccatccgggcgtttaaggtgggcgccttcgccgcgcagcgcttcagtaagcaggaaattacgcgcctgggggtgatatagcgcggtggggtggaactggttaaactccagattcgccacccgacatcccgcccgccaggccattgcaatcccgtctccggaagaaacgtcggggttagtggtatattgataaaccttcgcggccccgccggtagcgagtactacggctttcgcgctgcaggtttccacccgctctttattacgattccagatccatgccccgaccacccggcgggtgcccggcaggccaatcttatccgatacgatcaaatcgacggcattgctgcgctcaaggatgcggatattaggatgggcaagcgctttatcgaccagcgtcgtctctaccgctttgccggtggcgtcggcggcgtgaagaatgcgccgatggctgtgccccccttcgcgcgtgagatgatagctctcttcgccattggcctggacctgggtgtcaaacagcactccctgatcgataagccactggacgcatgatcgggcattgctggcgacgaaagtgaccgcatgacgatcgcagagtcccgcgccggcgatgagggtatcttcgacatgggattcaatactgtccgtctcatcgaagacggcggcaatcccaccctgggcgtagaacgtcgaaccttcgctgatcggccctttactcagcacggtcaccgaactgtgctcagccaggcgcagggcaagggaaagaccggcagcgccgctgccgataatcaacacatcacaagagaagtcaggagtggtattcattgtctttgtttaatttactaaacacatttagctcacaatagcaccggtccgtgaggaatcgtacaatttttttgtctgctgttgtgacggctaaacaaaaggcgaacggaaacggcgtcttgcgcgctgaaaatgagacgcggggcaggttgatggcattggattttatagtgaaataaacggcgtgttacgatacccttcagacgggcctgcgctttttcttattgacttacctatcgtttagcaacctgggcatataatgattgataacgatctgccgccgttgccagacaaaaaacaaaaagcgtaacggaactttattgttttcatgcactccaacagtcagcttgctcataatgcagattttgggtggtgttttgaagacgcatgggaattgggtttggggagacattacctcggatgagcgagcagttaacggatcaggtccttgttgaacgggtccagaaaggagatcagaaagcgtttaatttgctggtagtgcgctatcagcataaggtcgcgagcctggtttcccgctatgtaccgccgggcgatatcgctgacgttgttcaggaatcgttcgttaaggcatggcgtgcgctggactctttccggggagatagcgctttttacacctggttataccgtatcgctgtcaacacggcgaagaattatctggttgctcaggggcgccgtccgccgtccagcgatgttgacgccaacgaggcggaaaacttcgaaagcggcggggcgttgaaagaaatttcgaaccctgagaacttaatgttgtcagaagaactgagacaaatagtttttcgtaccattgaatcgctcccggaagatttacgcatggcaattacgttacgggagctggatggcctgagctatgaagagatagccgctatcatggattgtccggttgggacggtgcgttcgcgtatcttccgggcgcgagaagctattgataataaagttcaaccgcttatcaggcgttgacgatagcggaatactggaaaagggtatcaggcatgcagaaagaaaaactttcggctttaatggatggtgaaacgctggataacgaactgctcaacgagctgagtcgttcttctgagatgcaaaaaacctgggagagttatcaccttatccgcgatacgctgcgtggcgataccgctgaggtgctgcaatttgatatctccgcccgggtgatggccgccattgaaaatgagcccgttcgtcagacggcgccgcttattcctgaatctcagcccgcaccgcatcagtggcggcagatgccgttctggaacaaggtgcgtccgtgggccagctccctgactcaaatgggcgttgccgcctgcgtatcgcttgcggttatcgtcggcgtccagcactataatggtcagtctgattccgctcagcagcccgaagcgccggtgttcaatacgctgcccatgatgggtaaagcaagcccggtaagtcttggcgtgccggctgacgcgtcagcgggaagcggccagcaggcgcaggtccaggaacagcgccgccgaattaacgccatgctgcaggactacgaactgcagcgccgcctgcacgctgagcagcttcagtttggccaggcccagactcagcaggccgcagtccaggtaccgggctatcaaactttaggaacgcaatcgcagtaatgaagcaactttggtgtgccatgtcgctcatggcaggcagcctgttgttctctgtcaacgcctcggctgatacatcgtccggggcgttgttgcagcagatgaacctggccagccagtctctcaattatgagctgtcttttgttagcatcagcaaacaaggcgttgagtcgctgcgctatcgtcacgcgcgactgaacaaccaaccgctggcgcagttgctgcagctggacggtccgcgccgggaagtggtcctgcgcggcacggaaatcagctattttgaacccggtctcgatccgttcaccctgaacggggactatatcgtcgattcgctgccatcgctggtatatagcgatttcaaacgcctctccgcggcgtatgattttatctccgtgggccgtacccgtatcgctgaccgcctctgcgacgtgatccgcgtcgtggctcgcgacggcacgcgctacagctttatcgcctggctggatgctgaaaccaagctgccgctacgcgtcgatttgctcgaccgcgacggggaaacgctggagcagttccgggtcgtctccttcaatgttggcgataacgtcagcgccagcatggagacgctggcaaaagcgaatttgccgccgcagctgtcggtgcctgaaggaggcgacaaagccaacttcaactgggcgccgacgtggctcccgcagggcgtgactgaggtttccagcagccagcgccgtcttcccacctttgacggtccggtagaatcacgtctctattccgacggcttgttcagcttctcgatcaatatcaaccgcgccacggcggccagcagcgaccagctgttgcgcaccggccgacgcaccgtcagcacgacggtgcgcgataacgcggagataaccgtagtgggcgagctgccgccgcagacggcgaagcgtatctctgacagtattaaattcaaggcagtacaatgattaaagagtgggctaccgtggtttcctggcataacggcgtggcgcaggtgcactgcgacgttaaagcctcctgcagcagctgcgcctcccgtgccggctgtggtagccgggtgctaaacaagctggggccgcagaccagccataccattagcgtgccctgcgagcagccgttggccgcggggcaaaaagtggagctggggatcgctgaaagcagcctgctgggctcagcgatgctggtgtatatggcgccgctggcggggctgtttgtaatggcgtctatttttcaggtgctgtttgccagcgatattgcgtcactttgcggcgcgctgctgggcggcgtcggcggcttcctggtggcgcgcggtctgtcgccgcgactggcggcacgtcagtcctggcagccggtgattttgaacgtcgcactgccgccggatctgctgcgtgttgatacgccttcctccgacatgggccagtgatttcactggcccttatctttatttacctttcctgttacaacgccacaatttctgcgggtatgctggatctaacagcatttcctggtttcgcggatgtagtgtagaatgcggcgttttcggattaaaaaacgtcaggcacagtacagcggcctcatgatactcgtaaggcataattaactctaaatatgaagaatatacgtaacttttcgatcatcgctcacatcgaccacggtaagtcgacgctgtctgaccgtatcatccagatttgcggtggcctttctgatcgtgaaatggaagcccaggttctggactccatggatcttgagcgcgaacgcgggatcaccatcaaggcgcagagcgtcaccctggactataaggccagcgacggtgagacctaccagctgaactttatcgacaccccgggccacgtggacttctcttatgaagtttcccgttctcttgccgcgtgcgaaggcgcgctgctggtggtagacgccgggcagggggtagaagcccagaccctggccaactgctacaccgccatggagatggatctcgaagtggttccggtactcaacaagatcgacctgcctgcggccgaccctgagcgcgtagcggacgagattgaagatatcgtcgggatcgacgcccacgacgcggtgcgctgctcagcgaaaaccggcgtcggcgtgaccgacgtgctggagcgtctggtgcgcgatatcccgccgccggaaggcgatccggacgcgccgctgcaggcgctgattatcgactcctggttcgataactacctcggcgtggtgtcgctggtgcggattaaaaacggcaccatgcgcaagggcgacaagatcaaggtcatgagcaccggccaggtctataacgctgatcgtctgggcatcttcaccccgaaacaggttgaccgtaccgagctgaaatgcggcgaggtaggctggctggtctgcgcgatcaaagacatcctcggcgcgccggtgggcgataccctgaccgccgcccgcaacccggcagacaaagcgctgcctggctttaagaaggtgaaaccgcaggtgtatgccggcctgttcccggtgagctccgatgattatgaagctttccgcgacgcgctgggcaaactgagccttaacgatgcctctctgttctacgagccggaaagctctaccgcgctgggcttcggcttccgctgcggcttcctcggcctgctgcacatggagatcattcaggagcgtctggagcgtgaatacgatctcgacctgatcaccaccgcgccgacggtagtctacgaagtagagaccacctccaaagaagttatctacgtcgacagcccgtccaagctgccgccgctgaataatattcaggagctgcgcgagccgatcgccgagtgtcacatgctgctgccgcaggagttcctcggcaacgtgattaccttgtgtgtcgagaagcgtggggtgcagaccaacatggtttaccacggtaaacaggtggcgctgacctatgaaattccgatggcggaagtggttctcgacttcttcgaccgcctgaagtccacctcccgcggctatgcgtcgctggactacaacttcaaacgcttccaggcgtcgaacatggtacgcgtcgatgtgctgatcaacggtgagcgcgtcgatgcgctggcgctgatcacccacaacgataacgcgccgtatcgcggccgcgagctggtggaaaagatgaaagatctgattccgcgtcagcagttcgatatcgcgattcaggcggccatcggtaaccacattatcgcgcgctctacggtgaaacagctgcgtaaaaacgtcctggcgaaatgctacggcggcgacgtcagccgtaagaaaaagctgctgcagaagcagaaagaaggtaagaagcgtatgaagcaggtcggtaacgttgagctgccgcaggaagcgttcctcgccattctgcacgttggtaaagacggcaaataaccctaaggagttggcatggcgaacatgtttgccctgatcctggtgattgcaaccctggtgacgggcgttttatggtgcctggacaagttcatttttgcaccgaaacgtcgtgaacgtcaggccgctgctcaggcagcgaccggcgagcaactggacaagaagacgctgaagaaagtcggcccgaaaccgggctggctggaaaccggcgcatcggttttcccggtgctggcgatcgttctggtggtacgttcatttatttatgagcctttccagatcccttcaggttcgatgatgccaacgctgctcatcggcgattttattctggtggagaaatttgcctacggcattaaagatcctatctatcagaaaacgctgatcgagaccggccatccgaagcgcggcgacatcgtggtgtttaaatatccggaagacccgcgtctggattacattaagcgcgcggtggggttaccgggtgataaggtcacctacgatccggttgccaaacaggtcactattcagccgggctgcagttccggacaggcctgcggcaacgcgctgccggtgacctattccaacgtggagccgagcgattttgttcagaccttctcccgcagcaacggcggcgaagcgagcagcggtttctggcagttgccgaagggcgaaaccaaagccgacggcattcgtcttaccgagcgtcaggagacattgggcgacgtgacgcaccgaattctgatggtgccgattgcccaggatcaggttgggatgtactaccatcagtccggtctgccgctggccacctggattgtgccgcccggtcagtacttcatgatgggcgacaaccgggataacagcgccgacagccggtactggggctttgtgccggaagccaacctggtcggaaaagcaaccgctatctggatgagttttgaaaagcaggaaggtgaatggccgaccggcgtgcggttatcgcgcattggtggaattcattaatttcctctgctgaattcacgtcgctgctgttatcgcagcggcgtgaattatttagtatttaaatccattcaaactaacgacatcccgtgtcgttgcgtatagaatatccccccgaagtttttggttgtcgctctgccgggtgacactgcacacgaaagcgtattggtctgtttcaaattactgtttgaagcgaatgctcaggtcggtttcgtgtgctgcatctttgacgcattcatttattggtaacgcatgaaccccatcgtaattaatcggcttcaacgaaagctgggctacacttttcatcatcaggagctgttgcaacaggcattaactcaccgcagtgccagcagcaaacataatgagcgcctggaatttttaggtgactccattttaagtttcgtgatcgcgaatgcgctgtatcatcgctttcctcgtgtagatgaaggcgatatgagccgtatgcgcgcgacgctggtgcgcggcaacacgctggcggagatcgcccgcgagtttgagctgggcgagtgtctgcgcctcgggccgggagagctgaaaagcggcggtttccgtcgcgaatcgattctcgcggataccgttgaagcgttaattggcggggttttcctcgacagtgatattcagaacgttgaacgcttaatcctctcctggtaccagacccgtctggacgaaatcagtccgggcgataagcaaaaggatccgaagacgcgtctgcaggagtatctgcagggacgtcatctgccgctgccgtcttacctggtggtccaggttcgcggcgaagcgcacgatcaggaatttactatccactgccaggtcagtggcctgagtgaaccggtggttggcacaggttccagccgtcgtaaggcggagcaggctgccgccgaacaggcgctgaaaaagctggagctggaatgagcgaagaaaaaaattattgtgggtttgtcgccatcgtgggtcgtccaaacgttggcaaatccacgctgttgaacaagctgcttgggcagaagatctcgatcacctcccgtaaagcgcagaccacccgtcaccgcatcgtcggtatccataccgaagggccgtatcaggcgatttacgttgatactccgggcctgcatatggaagagaagcgtgccattaaccgcttaatgaacaaagcggccagcagttcgattggcgacgtggaactggtcatcttcgtggtggaaggcacccgctggacgcaggacgacgagatggtgctcaacaagctgcgcgacgcgaaagcgccggtgatcctcgcggtcaacaaggtggataacgtgcaggaaaaagcggatctgttaccgcacctgcagttcctcgccagccagatgaatttcctcgatatcgtaccgatctcagcggaaaccggcaccaacgttgataccatcgcggcgatcgtgcgtaagcatctgccggaagcgatccatcacttcccggaagattatattaccgatcgctcacaacgctttatggcctccgaaatcatccgtgaaaaactgatgcgtttcctcggcgctgagctgccgtactccgtcaccgtggaaatcgaacgtttcgtcagcaacgagcgcggcggttacgatatcaacggcctgatcctcgtcgagcgcgaagggcagaaaaagatggtgattggcaacaaaggcgccaaaattaaaaccatcggtatcgaagcgcgtaaggacatgcaggagatgtttgaagcgccggtgcacctcgagctgtgggtgaaagtgaaatccggctgggccgatgacgagcgcgccctgcgcagtctcggttacgttgacgacctctgagttaacgcaacgtggatggatggcagcgcgcctttgtcctgcatagccgtccgtggagcgaaaccagcctgatgctggacgtcttcacggaagaatccggtcgcgtgcgcctggttgccaagggcgcacgctccaaacgctctaatctcaaaggcgctttacagccctttacccccttgttggttcgcttcggcgggcgcggcgaagtcaaaaccctgcgcagcgcggaagccgtttcgctggcgctgccgctcagcggcatcaccctctacagcggtctctacgttaacgagcttatctcccgcgtgctggagcacgaaacacgcttctccgaactctttttcgactacctgcactgcattcaggcgctcgccggggccagcggctcgccggagcccgcgctgcggcgttttgagctggcgctgctcgggcacctggggtatggcgtggattttctccactgcgccgggagcggcgagccggtagacgacaccatgacctaccgctatcgtgaagaaaaaggctttattgccagcctggtgattgataacaacacgtttaccgggcaccatttgaaagcattggcgagtcgcgagtttcctgatgttgatacgctgcgcgccgcgaagcgctttacccgtatcgccctgaagccctatctcggcggcaaaccgctcaagagccgggagttgtttcgccagtttatgcccgcgcgaaaggcgcgagccgataatacgaataatgattaacgaggattgtcatggctgaattattgttaggggtcaatattgaccatatcgcgaccttgcgtaacgctcgcggcaccgcttacccggatccggttcaggcggctttcattgccgaacaggccggcgccgacggcattaccgtgcatctgcgcgaagaccgtcgccatattaccgatcgcgatgtgcgtatcctgcgccagacgctgcacacccgcatgaatcttgaaatggcggtcaccgaagagatgctgacgatcgcctgcgaaaccaaaccgcacttctgctgcctggtgccggagaagcgtcaggaagtgaccaccgaaggcgggctggacgtcgccggccagcgcgacaagatgcgcgatgcctgtcaacgcctggcggatgccggcatcctggtctccctgtttatcgatgcggatgaagcgcagatcaaagcggcggcagacgttggcgcgccctatatcgaaatccacaccggctgctatgccgatgccaaaaccgacgccgagcaggccagggagctggaacgtattgccaaagcggccacctacgccgccagcctcgggctgaaggtgaatgccggccacggtctgacctaccacaacgtgaaagcgattgctgcgctgccggaaatgcatgagctgaatatcggtcacgcgattattggccgtgcggtgatgagcggcctgaaagaggcggtggcggaaatgaagcgtctgatgctggaagcgcgcggctaatggccattctcgggttgggtaccgacatcgtcgagatcgcccgcatcgaagcggtgatcgcccgcagcggcgatcgccttgcccgccgggtgctgagcgaccatgaatggagcatctgggagcagcaccagcagccggtgcgtttcctggcgaaacgctttgcggtcaaggaagcggcggcgaaagcgctgggaaccgggatccgtaacgggctggcgtttaaccagttcgaggtttacaacgacgagctgggcaagccgaagctgcggctatggggtgaagcaaaccttttagctgaacgcatgggagtaagcgctattcacgttactctcgctgatgaacgccactacgcctgcgccacggtgattgtcgaaagctagccaggagggcggttaaattttatccgcgtggtgcatcagcacgaatttatcccacagctgttcttcactctcgacgtgtgccggatctttcaggatcgtattcgggatcgggcacactttctggcaggttggcgtgtcgtaatgacccacgcactcggtgcagcggtcgctgttaatctcataaatgctctcacccatcgaaatggcctcattcgggcactccggctcgcacatatcgcagttgatgcattttttggtaattaacagcgccatcaggaaagtctcagaaacaacacaaacagggcgggcattatacgcccattttctgctcagaccagctttttcaccagcgcttcgctatggcgaatgcgctccggcgcccgctccagatcctgctgcaccagccccataaacagcagatcggtgagcatcatttgcgcgctggtggaggagatggccgcgctgcgcgtcgcctgctcttcggcgatagtatacaggcagtgggtcgcctgctgttgcagggcgttcgggctaaacccggtgatcgccaggatcttacagccgacgcgcagcgcttcaccggccgccatattgatctcccggcgctcgccggagtaagagatcgccagcagaagatcgtcgctggacatggcctgcaccgtcgccagcagggcatgcatatcctgctcagaaacagcgttgatgccgatcttcatcagcttccagctaaagttacgcgccaccaggccggaggcgccaatcccggtgacgatcactcgccgggcgttgcgcagcagcgtgacggcttcccgtagcgtctcttcagtgttgacgtccagcgaggcatgcatggcggcgacattgtctttaatgagtttctcgccgaccagacgcagcggatcgtcaccgcgaatgtggttatgcaccgggacggagtgcggatccgggctactcgccagcgcttcactaagggccagcttcagcgccggaaagcctttgaatcccagcttctgggcaaatttaaccacgctggactgactcacaccggcttccgccgccagctgctgcgagctgaggtgccgggtctcatcgggctggcttagaatataatcggccaactttttgtcgctcgccgccagggtgggatagcgctgacgaatacgcgttaaacagttcattggagctccgctggagccgtccggctcgtgactgacagaatttttattcgattataaggggtataccatgaattaaaaattcttaagccacaatttttccttcgcctgctactttaattctttcttaacggcaggggatgttttccctcgacatggcgtcaggctgttaagcttaccctaacgagaagcgagttctgagataaaggaggcagtttgcagcacactgaacggagagtggtgtttttcgatctggacggaaccttacaccaacaggatatgttcggcagttttctgcgctatctgctgcgccatttgccgctgaacctgttgctggtggtggcgatggggccggtgatccttgccgggctggcagtgagcggacgggcggcgcgctggccgatgagcctcctgctgtgggcgacaacctttggccgccgcgaggcggtgctgaagcggctggaagcggagtttgtcggctggtttcgccatcatgtgacggcgtttccggtagttcatgcgcggcttaccgcctacctgaccagcaccgatgccgacgtctggttgatcaccggctcgccgcagtcgctggtggagcaggtctatcgcgataccctctggttgccgcgggtgaatctgatagccagccgcaccgcgcgccgctggggcggctgggtattgaccctgcgctgcctggggcatgaaaaggtggtacagctggagaaaaagattggcgccccgctgcggctgtatagcggctatagcgatagtgagcaggataatccattgctcggcttttgccagcatcgctggcgggtaacccctcagggagagcttcagcagctggagtaatagtgtgtaattgatagcgcccatgtataatgcgccccgctttttctgctggagtggccgctgtgtctgacctcgaactcaatgatgaatactggatgcgtcatgccctgacgctggcgaaacgcgcctgggaagagggcgaggtgccggtgggcgcggtgctggtgcataacaatcaggtcattggcgagggctggaaccggccgataggccgtcacgaccccaccgcccatgcggagattatggccttacgccagggcggactggtgctgcaaaactaccgcctgatcgacgccacgctgtacgtgaccctcgagccctgcgtcatgtgcgcgggcgcgatggtgcacagccgtatcgcccgcctggtgtttggcgccagggatgccaagaccggcgccgccggctcgctgatggatgttctgcaccacccgggaatgaaccatcgggttgcgataagcgaaggcgtgctggcagagtcctgctctgccatgctgagcgacttctttcgctggcggcgggaagagaaaaaagcgctgaagaaagcccgggagcagaccggggaaagttaatacaggtggccggggagtttcatccgggcattatccatctgcttatcggcgcgaaacttgaaaaagggcagggtggtctcctgcggctgttcgagctcattggggagcacggccgggtaatcctccgccagggccagcgtttgctgctgctggcgctccttctctgacaaatagccgacaaggcttatctgatatttgcggatgttttccacataggcgtaggcctcatggccgcgggcatagccgtattttagtttgctgtaatagggtttctggctcagcaacggtaaacgcagcttaacgtccgcccagctgttaggattgcctttctgtttgcgggtgagcgccatggcgtccagcatatgggcgtaacccatattataagcggccagcgcaaaccagatgcgttcatctttcgggatcgaatccggcactttatccatcatatcctgcaggtagcgcatgccgccgtcgatactctgcgccgcatcggtgcggtcggttagacccaggctttgcgccgtattgcgtgtgagcatcatcataccgcgcacgccggtgggggaggtggcctgcggatcccagtgggattcctgccaggcgatggcggccagcaggcgccagtcaatctcgcgggcgtatttttcaaacagcggctgcacctccggaagaatattttccaccgcgcgcaggaaggtgcgggtatcgacataatcgaaatcgttgccgtggccgaggtacttctcctcgaggcgcgccagggtgccgtcttcattgatgttgttgaagaaatcaagcattgccgccgacagcgaattatcgtcgtcccgggcgctaaaccaggtgaccggctgttcgtcggtgatatcgagggccaccgccagctccggatggacgcgctgaaataggctgacggccaccgagtcggcgatggtgtaatcaagtttaccgtcaatcaccgcctgcatcagcgccgtggtaccgcgtttttcgtccacgcgccaggcaagatccgggtatttctcggcttttaaggtctgcaggtcgttgatcgccacgtggcccggagcgatagtgagctgctcggcggtcagcgccgcgagggtgcgcggccgggtattgccgacgcggtagaccagctgttgcgaaacagaatagtaggtggggccggcctgatagtttttcactcgctcctggttatagaccagtccggcggccagcatatcggcctgaccgtcgtcgaggtcgtcaaacagctgactgatgttttgccggacagttatcttaagcgttacgccaaggtagtcggcaaactgcttcgccagttcataatccagaccgaacgctttattgttcatggtggcgaaggtcattggcgagttgatggtgctgattcgcagctcgccgcgagcgataatgcccgccacgcggttctcgggtttaccagaccaggggatcgacggccacagggccgccgccagcaaaagggtgacaatgccgatcagcagataattaatctttaattttttcagagagttaatcttctgcagcttcaggttcctcagcaggcgatgtccggaaaaaacgcaaggttgtcgtcgaatgtgcggcattctgcttaataatgcgccagttggcaacttattcgcgatggtcgtcacatttattgataaacagcatcaatgattttatttctacgcaaacggtttcgtcggggcgcaggattcactataatgacgcccgtttccccccctggctcaccctgaaagcttcgaagacgagagacttatgatggaaattttgcgtggttcacctgcactgtcggcattccgtattaataaactgctggcacgatttcaggcggccaaccttccggtaagcgccatatatgccgaatatattcattttgccgatctgaatgccccgctgagcgctgacgatcgcgagcgcctggcgcgactgcttcagtatggcccgagcttaagcagccataccccgaccggtaaattactgctcgtgacccctcgccctggcaccatctctccctggtcttctaaagctaccgatatcgctcacaactgcggtctggcgcaggttgtgcgtctggagcgcggcgtggcgtattacgttgaagcctcaaccctgaccgaagcgcagtgggccgcggtggcggcggagctgcatgaccgcatgatggagagcgtcttcgacgagctggaagcgggcgagaagctgttcgctcaccatcagccgacgccggtcaccagcgtcgacctgctgggcgaagggcgtcaggcgctgattgacgccaacctccgtctgggtctggcgctggccgacgacgaaattgactacctgcaggacgcgtttacccgcctgggacgcaacccgaacgatatcgagctgtatatgttcgcccaggcgaactcagagcactgtcgccacaagattttcaacgccgactggatcatcgacggcgaacagcagccgaagtcgctgttcaaaatgatcaaaaacacctttgaaaaaacgccggactacgtgctgtcggcctataaagataatgccgcggtgatggaagggtctgaagtcgggcgctatttcgccgaccatcagaccggacgctacgacttccatcaggagccggcgcacattctgatgaaggtggaaacccataaccacccgacggccatctctccatggccaggcgcggcaaccggctccggcggcgaaatccgcgatgaaggcgccaccggccgcggcgcgaagccgaaagcgggcctggtgggcttctcggtttccaacctgcgtatcccgggcttcgaacagccgtgggaagaagatttcggtaaaccggatcgtattgtcaccgccctggacatcatgaccgaaggcccgctgggcggcgcggcgtttaacaacgaatttggtcgtccggcgctgaacggctacttccgcacctatgaagagaaagtcaccagccacaatggcgaagagctgcgtggctaccacaaaccgatcatgctggccggtggtatcggcaacatccgcggtgagcacgtgcagaagggcgagattaccgtcggcgcgaagctgatcgtgctgggcggcccggcgatgaacatcggcctcggcggcggcgcggcgtcttctatggcctccggccagtccgatgccgatctcgatttcgcctccgtacagcgtgacaacccggaaatggagcgccgctgtcaggaagtgatcgaccgctgctggcagttgggcgacgccaacccgatcctctttatccacgacgttggcgccggcggtctctccaacgctatgccggagctggtgagcgacggcggccgcggcggtaaattccagctgcgcgatattctcagcgatgagccagggatgagtccgctggagatctggtgtaacgaatcgcaggaacgttatgttctggcggtcgccccggagcagctgccgctgttcgacgaactgtgccgccgcgagcgcgcgccttatgccgttatcggcgaagccaccgctgagcagcatctgagcctgagcgacagccactttaacgatcagccgatcgacctgccgctggacgtcctgctcggcaaaacgccgaaaatgacccgcgacgtgcagactctgaaagctcagggtagtgcgctggatcgccaaccgattacccttgccgatgcggttaaccgcgttctgcatctgccgacggtggccgagaaaaccttcctcgtcaccatcggcgaccgcaccgtgaccggtatggtcgcccgcgaccagatggttggcccgtggcagatcccggtggccaactgcgcggtgaccaccgccagcctcgacagctactatggcgaagcgatggcgatgggcgagcgcgccccggtcgccctgctggacttcgcggcctctggccgtctggcggtcggcgaagcgctgaccaacatcgccgccacgcagattggcgagctgaaccgcgtgaagctgtcggctaactggatggccgccgccggccacccgggtgaagacgctggcctgtatgaggcggtgaaagcggtgggcgaagagctgtgcccggcgctgggcctgcccattccggtcggtaaagactcgatgtcgatgaaaacccgctggcaggaaggcagcgagcagcgcgagatgacctctccgctgtcgctggtcatctctgccttcgcccgtgtcgaagatgtccgtcataccgtcacgccgcagctttcgacggaagataacgccctgctgctgatcgacctcggtaaagggcacaacgcgctgggcgcgacggcgctggcgcaggtctatcgccagctcggcgacaagccggctgacgtgcgcgatgtcgcgcaactgaaaggcttctggaatgcgatgcaggccctggtggcgcagcgtaaactgctggcctaccacgaccgctccgacggcggtctgcttgtcacgctggcggaaatggcctttaccggccactgcggcgtggaagcggatatcgccgcgctgggcgacgaccatctggccgcgctgttcaacgaagagctgggggcggtgattcaggtccgcgccgcagaccgtgaggcggtggaagccattctggcggttaacggcctggcggactgcgtgcattacctcggtaaagcggttgagggcgatcgcttcgtgctgaccgccggcggtcagacggtgttcagcgaaagccgcaccacgctgcgcatgtggtgggcggaaaccacctggcagatgcagcgtctgcgcgacaacccggcctgcgccgatcaggagcatgaggcgaaagccaatgatgccgacccgggcctcaatgtgaagctctcgtttgatattaacgacgacgtcgccgccccgtacattgccaccggcgcgcggccgaaagtggccgtcctgcgcgagcagggggtgaactcccacgttgaaatggcggccgccttccatcgtgccggctttgacgccatcgacgtgcatatgagcgacctgctggccggccggaccggtctgggcgatttccatgccctggtagcctgcggcggcttctcctacggcgacgtgctgggcgcgggcgagggctgggcgaagtcgattctgttcaacgagcgcgtgcgcgatgagttcgcgaccttcttccatcgtccgcagacgctggcgctcggcgtgtgcaacggctgtcagatgatgtccaacctgcgcgagctgatcccgggcagcgacctgtggccgcgctttgtgcgcaaccagtctgaccgctttgaagcgcgctttagcctggtggaagtgacgcaaagcccatccctgctgctggaaggcatggttggctcacggatgccgattgcggtctcccacggcgaaggtcaggtggaagtgcgcgacagcgcgcatctggcccagctggagagcaaaggtctggtggcgctgcgcttcgtggataacttcggcaaagtgaccgaaacctatccggcgaacccgaacggttccccgaacggtatcaccgcggtgaccagcgaaagcgggcgcgcgaccatcatgatgccgcacccggaacgcgtcttccgcaccgtaagcaactcctggcacccggagaactggggcgaggatagcccgtggatgcgtatcttccgtaacgcgcgtaaacagctgggttaatcttcccgccgcgcttcacgcgaacgtatcagccccctgcctgacagggggctttttttatctgtgatggtcggcacgccagggtgtcgggaattgccgacaactgcgatattgtagtgtcgtcaataggcgacacttaagttattgatttaaatgatgagtaatcggtagcctatttggtgtcgctaaatagcgacaatgcgggtgaaaaataaacagtggtagtacgactgttcctgcggttaaagccatatatatcaatatgttaataaaatgttttgagagctggcatagttcatgcataatattaaccagtggctcattcaccttcttatgtcagccccttcgggacgcgctacataaacttcgaatgacgcacaaacaggtgcctgccgtccaactcctgataacagcctggctttatcagacatcgggcgaaacgtcgagtaaggcaccgcctcattcctgaacaaagccaggccttgcgcctggctttgttgtttctgcggcgcagcactcagcggtagcgcttttctccggcgcgctcctcagttagcatcgaccagagctaatgattgagacaacatccttgaagcgactctctcttttcccccgttcgctgcgtcagctggtgacgctctcctttgtgctgatcctgctgccattgctggtgctggcctggcaggcctggcagagcctgaacgccctcagcgcccaggcggcgcatattaaccgtaccaccctggtcgacgcccgacgcagcgaggcgatgatcaatgccgcactggagatggagcgcagctatcgccagtactgcgtgctggacgatccgacgctggcgcgcgtctatcaaaaccagcggcagcgctacagccagatgctggacgcccacgccggcgtgctgccggacgagaagctctggcaggcgctgcgtcaggatgtcagcgatctggcgcagctgcagtgtaaaaatagcggccccgatgcccaggcagccgccagactggaagttttcgccagtaataacagcgatatggtgcaggcgacccgggcggtcgtctattctcgtggccaacagctgcagcaggagatagccgaacgcggccagttttttggctggcaggcgctggtgctgtttctgctgagcctggcgctggtgctactcttcacccgcatgattatcggcccggtgaaaggcatcgaaagaatgatcaatcagctgggggcagggaagtcgctggacgacgccgcattgtttaccggcccgcgcgagctgcgatcggtgggcaagcgcatcatctggctcagcgagcgcctggcgtggctggagtcgcagcggcatcaatttcttcgccatctgtcgcatgagctgaaaaccccgttggccagtatgcgtgaaggtaccgagctgttggccgaccgggtcgcggggcccctgacccctgagcagcaggagattgtcgagatcctcgacagcagtagccgtaacctgcaaaagctgattgaacagctgctggactataaccgaaaacaggccgacggcccggtggctcgcgaagcggtggacctggtggacttggtggaaaacgtcgtggcggcgcacagcctgcccgcgcgggctaaactgatgcataccgaactgacgctgcaggcgcggcgttgcctggcagagcctgcgctattgataagcgtaatggataatctctactccaatgcggtgcactatggcgctgaatccggtaacatccgtatccatagctaccggcacggagagcaggtgcgtattgatgtcgccaacagcggcgaaccgatcccggccgcggaaaaaaacatgatattcgagcctttttaccaggggagtcaccagcgtaaaggggccgttaagggcagtggactggggttgagtatcgcccgcgactgcgtccggcagatgcaaggggagctcagcttagttgatgcgcccgccgggcaggtctgttttcgcattacgcttccctcagcgccggaataatccaacttatgaatcgatatcggggaactatgtcccaattcctggcctggcgccgttccctcagcggatggctgctttcaggcattgcttgtctgacgctggcggggtgttccgccggcttttcaccgcataccgcggaaggtaccgccgcccccgggcaggcgcagcatcaggtggccgattttgtcgcggtagactgcgcggatatctgggcgcacagcagcgatgccagcgacaaaaatcccctctactggctgcggggcattgactgtgccgatcgcctcgcgccggcgcaggcgcgggcggaggcgaaacgccataccgacgacagctggcaggacgcgttccgtcgcggcatcctgcttgctgatgctaaaattacccctgaggagcgccgcgacctggtggcgcgtctcgataccttcagcccgcaaatcgccgttcaggtccgcccgctgtatcagctctggcgcgacggccagacccgtcagctgcagctggtggaagagcgtgcccgttacgctaagcttcagcagtccagcgatagcgaactggagacactgcgtcagcaggagctggcgctgcgcgagcagctggagctgaccacccgcaagctggagaacctgacggatatcgaacgccagctctccagccgcaagccgggcggcaatttcggcagcgaaaaagtgccggaggtgatccatgacgatccgtaaaccggcgcgtttactgctggtggatgacgatccgggactgttgaagctactgggcatgcgcctggtcagcgaaggctacagcgtggtcaccgccgagagcgggccggaagcgctgcgcgtgctggggcgtgagaaagtggatctggtgattagcgatctgcggatggatgaaatggacggcctgcagctgtttagcgagatccagaagggccaccccggcatgccggtgatcattctcactgctcacggttcgattcccgacgccgtggcggctacccagcagggggtgttcagcttcctgaccaagccggtcgataaagatgccttatataaagccattgatgaggcgctggagcagcgctcgccggccaccgacgaagcctggcgccaggcgactgtaacccgcagcccgctgatgctgcgcctgcttgagcaggccggaatggtggcgcaatcggatgtcagcgtactgattaatggccagagcgggaccgggaaggagatcgtcgcccaggcgatccacaacgccagcccgcgtcatgataagccgttcgtggcgatcaactgcggcgcgctgccggaacagctgctcgaatccgaactgtttggccatgcgcggggcgcttttaccggcgcggtcagtaaccgtgaaggattattccaggccgctgagggtggtacgctgtttctcgacgagatcggtgatatgccggttgcgttgcaggtgaagctgctgcgcgtcctgcaggagcgcaaggtgcgcccgctgggcagcaaccgcgatatcgaaatcaacgtgcggattatctccgccacccaccgcgacctgccgaaggcgatggcccgcggcgagtttcgtgaagacctgttctaccgcctcaacgtagtgaacctgaaaataccgccgctctccgaacgcacggaagatattccgctgttggccaaccatctgctgcgtcagtccgccgatcgccataagccgttcgtgcgggcattttccagcgatgcaatgaagcggctgatggccgccaaatggccgggcaacgtgcgccagctggtgaacgtgatcgagcagtgcgtggccctgacttcgtcgccagtgatcggcgacgcgctggttgagcaagcgctggagggcgagaacacggcgctgccgaccttcgtggaggcgcgcaatcagtttgagctgaactacctgcgcaagctgctgcaaattaccaagggcaacgtcactcacgccgcgcggatggcagggcgcaaccgcaccgaattctataagctgctgtcgcgccatgagctcgacgccaacgactttaaagagtagctccgcactatagcgcaagttatgatacggtaagcaaccggttacgcgattaagacaggaaccccatgaaaaagattgatgcgattattaaacctttcaaactggatgacgtgcgtgaagcgctggccgaagtcggcatcaccgggatgacggtaacggaagtgaaaggctttggccgccagaaagggcacaccgaactgtaccgtggtgccgagtatatggtcgattttctgccgaaagtaaaaattgaaattgtggtgaccgacgatatcgtcgatacctgtgtggataccatcatccgtaccgcacagaccggtaaaatcggcgacggtaaaatctttgtcttcgacgtggcgcgggtcattcgtattcgtaccggcgaagaagacgacgcggcgatttaacgctcgccgctcgctgcagtattgccgggtggcgctgcgcttacccggcctacaaatccccgcgcgtcggggcttacagcaccttatgcgggccgaagcattcgtaatgaatgttgtctttgttgacccctaattcgaccagctgcttcgctgcaaactgcataaacgctaccgggccgcagagataatactgcatctgcgggtcgcgaatattgtccgccactgctgctaaatccatcaaaccttcgctatcaaaacgtccagcctgacggtcggcctcagtcggggtgcgataccagacgtgagaggtaaacgccggcagcgccgcgccgagcgccttcacttcatcggcaaaggcgtgaacgtcgccattttccgccgcatggaaccagttcacctgaccctgatgaccgctcttcgccagcgcatccagcatcgccagcatcggcgtttgcccgacgccgccagagagcagggtgaccggcgtctgtggcttaacgttaaggaagaaatctcccgccggggcggccagatagaccacatcgccttcgctggcatggttatgcagccagctggaaacctgaccgccttcctcgcgtttaaccgcaatgcggtagcctttgccgtccgctttgcgggtcagggaatactggcggatttcctgatattcgaagccttccggtttcagccagatggccaggtactggccaggctggtaatcggcgaccggctggccatcaaccggttcgagctcaaagctggtgataagctggctgcgcggggttttcttcacgatgcgaaacgcgcgggtcccttcccagccgccggttttactggcgttttgctgatagatctcggcttcacggccgataaagacgttcgccagcacgccgtaggctttaccccaggcatcgagcacttcctggcccggactgaacatttcatcgagggtcgccagcagatggctgccaacaatattgtactgctccggtttgatctggaagctggtgtgtttctgggcgatcttttccaccgccggcagcagggcaggcaggttatcgatattgctggcgtaggcggcaatagcgttgaataacgcttcacgctgatcgccgttgcgctggttgctcatgttgaagatctctttgagctccggattatgcgcgaacatacgatcgtagaaatgggcggttaatttcgggccggtctctaccagcaggggaatggtggctttcaccgtggcgatggtttgagcgtcaagcatagcgtgcttccttatgtgttatcttaatgatgcattttaaatgcatcttaaagaaataaccctgcgttgtaaatggttctttaacacattcccccgatccagttacaacatgaagagtttgcatcacaaacctgaaaagaaatccgttgatactgagagaggcgttattgctcaaagccttgtgtcatgcggagccaatcgtttgcgtaaaatcctttgtcaagacctgttatcacagaatgattcggttatactgtgggccgttgtccaatcggaccgcctttttaggccgaaattttattgttagctgagtcaggagatgcggatgttaaagcgtgaaatgaacattgccgattatgatgccgaactgtggcaggctatggagcaggaaaaagtacgtcaggaagagcacatcgaactgatcgcctccgaaaactacaccagtccgcgcgttatgcaggcgcagggctctcagctgaccaacaaatatgctgaagggtatccgggcaagcgttactacggcggctgtgaatacgtcgacgtggttgaacagctggcaatcgaccgcgcgaaagaactgttcggcgctgactatgctaacgtccagccgcactccggctcccaggctaactttgccgtctacaccgcgctgctgcagccgggcgacaccgtgctcggtatgaacctggcgcagggcggccacctgactcacggctccccggttaacttctccggcaaactgtacaacatcatcccttacggtattgatgagtccggtaaaattgactatgacgacatggcgaagcaggctcaggaacacaaaccgaagatgatcatcggtggtttctccgcttactccggtatcgttgactgggcgaaaatgcgtgaaatcgctgacagcatcggcgcttacctgttcgtcgatatggcgcacgtggcaggcctgattgccgctggcgtgtacccgaacccggttccgcatgctcacgttgtgaccaccaccacccacaaaaccctggcgggtccgcgcggcggcctgattctggcgaaaggcggtagcgaagagctgtacaaaaaactgaactctgccgtgttcccaagcgcgcagggcggcccgctgatgcacgttatcgcggcgaaagcggtggcgctgaaagaagcgatggagccagagtttaaagtttaccagcagcaggttgcgaaaaacgctaaagcgatggtggaagtgttcctgaaccgcggctacaaagtggtgtctggcggtactgagaaccacctgttcctgctggatctggtggataaaaacctgaccggtaaagaagctgacgccgctctgggccgcgccaacatcaccgtcaacaaaaacagcgtgccgaacgatccgaagagcccgttcgtgacctccggtatccgtatcggttctccggctgtgactcgccgcggctttaaagaagcggaagtcaaagagctggctggctggatgtgtgacgtgctggacaatatcaatgacgacgcggtcattgagcgcgtgaaaggtaaagtgctggatatctgcgcccgcttcccggtatatgcgtaagcgttagcgttgacatcaaaaaggccgcgtatgcggccttttttgcgtctggagattagcggcggtcgagggagatcgccccggggccggttattgccagcagcaggaaagcgccggcgatgctgacgtttttccagaagttaatcatgttcggcaataccgcatcgccagtcatatcccagtagtgatggccaatcaccgccgtgcccagggtgtagaaaataaagatgaccgccagcgggcgggtgaaaaagccgagcacaatcagaatcgcggcaggcacttccataatgacggcgataatcgccgccagggtcggcatcggcgcgccggaggcggccatgtactgcaccgtaccgtcaaagcccagcagtttggggtagccaaaaagaataaacagaatcaccacggcgatgcgggcgataagcagcaacagagagcgggaagcgccaaaatcaaaatagcggagtgagttcataatcagctcgttatgagagacatgtgatttaaacgtaatacacaaatttgcgctccgccacgttcgtttatgactaaaccagcgtctgcaattgctcctcaacgtacagataacctatccccatcagctgctgggcgcgcgtcagctggccaaagcctatttgggtggcgtgcgctcgcggcgtatccctgtggtcaaaggggttaaaacccgtttgtttgacgatactttccagccactgctcaccgaaggcgcagctgcgcccgtaaagccagatttgattaatatttaatatattcaggaaattatagaggcttaagccaatcgcgttggcagcgttatcaacccatgcgcgaatttgcacatctccctctttccaggcctcaatgagcgacgccgtggttaactgctcgggggcgagcgttgcttcaggctgcgttttgagccacattcgggcctgttttttcagcgcgctgagagaggcgacggtttcgaggcaaccgtatcttccgcagtcgcaggctttgccgtcaggattgacaatcgtatgcccaatctgcccgctgccgtacagactgccgcgataaatatgatcgttaatcacaaatgacgagccgataccgtagtcgacgttgatcacgcaaaaatcctgctgtgtaccctgatgctgccacttctccgccagcgccagcatcacgcagtcgttatctacccgaacctgcacgccaagccgctcctcaagcagatactttatttcgatcggtgttttccagcgtgcctggggcatggtttgtgaaacgccggtaatcggatcaacctgtccatgcacgccaagggcgagattgatgctgtgctgcgggtagcggcggtggatatgccgccagcattcaacgatggcctcaagcagggcctgaggagtgggcgcgttgaccggcaaatgctgatggccatccactgccagcaggcgggcgtcggcaagctgatattcaatgctggtcggggtgatattcatgcacagtgtccaggcgccgtgctcggggatctggtagctgccgctgttcacgccccgtttgctcaagtgttccgttgagtgaccgatcaatccctcgctaagcagctcggccagaatattgctcaccgccggaatggagagaccggtgagttgagagagctgtgatttactgagctgcttttcccgccacagatgggaaagaaaaatcgacttattggcctgccggacccgggcgttattaaagccagtacgctgcatacacttaactcccttaactatattgcgtgagcattgcgcattttaacagcgaattggcgatatagactcctgttattgcaacttttacttcgttttgtttagtggaggcatcatgtacggttcggttaaggtctggcaggaaatcatttcattaccaacgtggacaacgggcgcggaagatccgaaccctatgtttctggaaaaacgtgtttatcaaggatcttccggcagcgtctatccctacggcgtaattgataccctgaccggcgaacgcgaaatgcgcgattatcaggcagtgtggatggagaatgatttccttcgggtcatgctgctaccggagcttggcggccgtattcaccgggcatatgacaaagtcaaacaacgtgatttcgtctattacaatgaggtggttaagccagccctggtagggctgctcgggccctggatctccggcggaatcgaatttaactggccgcaacatcaccggccgacgacctttaaaccggtcgatttttctattcagcagggagaaaacggcgcgcagaccgtatggatgggggaagcggagcccatgcgcggtttgcaggttatggccgggtttacgctctatcctgaccgcgcgctgattgaaatcactggcaagatcttcaatggtaacgccacgccgcgccatttcctgtggtgggccaaccctgcagtaaaaggcggcgatgcccaccagagtgtattcccacccgatgtcaccgctgtattcgaccatggtaagcgtgatgtttccgctttcccgattgccaccggtacctactacaaagtggactattctgcgggggttgatatctcccgttataaaaacgtcccggtacccacttcgtatatggcggagaagtcggattacgattttgtcggcgcttatcatcatgacgagcgaggcgggttactgcatgttgccgatcaccatgtctctcctggcaagaaacagtggagctgggggtacggggattttggccaggcctgggatcgaaatctgactgatgaaaatggcccttatattgagctgatgaccggcgtcttcaccgataaccagcctgactttacgtggcttgcgccttatgaagagaaggtgtttgtgcaaaatttccttccctacagcgagttagggatggtgcaaaatgccaatacacagctggcactgaagctggttcgcgagtctgggcaactgcagcttggcgtatatgccattgctccgctaaatcatatcgtggttgaactcagcgctgaccatcagccattgtacgaaactcagctgacgctgaagcccggtgagagctggcagcagacgctgccggaaaatggcgtcgggcgcttaaccctcaaagtgaaaaccgccgagaaccagccgctgctggattatcaggaacatattacccaacagacgccgctgcccgaaccagctatagcgcccgcgttaccggaagcgatccacaatggcgacgagctctattttatcggccagcaccttgaacaatacaaccacgcaagccgctacgccggggattactatcgtcgggcggttgagctcgatccgcaggattatcgcaataatgttgccctcggtaccctggcgttcaacagtgccgactgggcgctggcggaacagtgtgcccgtgctgcgctacagcgcgcgcatcgtttgaataagaacccgcgagatggcgaagccagtatgctgcttgccagcgtgctggaaaggatgggggatgatgcaggcgcctgggatcactattacaaagcctcctggagcggtaactgccgtgacgccgcctggtggtcgctggcgcggctggcgatgaagcgcggtgatgttgccgatgcgctggaaaaagtaaacaccagtctgcggttcaacgccagcaatcctctggcgatggggttgaaagcgctggcattagccaacagtgggcagaagaaagcagcgctagagtttattttcgcctctcttgagcaatacccattgagctatccgctgcactgcgcgcgctggatgattgagcggagcgacgacgcgcgagaaaccctgctgcgcatcacggggcgcagaggggtcaacgccagcctgctggcgggttggctgctctctatcggacagacgtcggcggtgaaagaggttcttgcggttctggacagtcaggaagcgctgccgatgctctggcgtgcgtcgctaagtgatgatgccaatgaacgccaacagtttattgccgccgccgagcactgccatgcgcacaatgttcgtttccctaactcgctcgatgaagttcagatgctgcagtcgctgggcgacagcgcttttgcccgctatctactcggttgcttctggtacagcaaacgtcgctatgacgaggcggtgagctgctggcgcgagacgctcgaaaaatctcccgattatgcgcccgctcatcgtctgctgggcgtttactcctggaataaacagcaggatgcaacgcaggcgctggcttatctgcagcgcgccgtagcgctggagccggacaatgcgcgcttcctgtttgaactcgattttttgcaaaaattactggccaggccggtacatgagcgactgacgacgctggtggaacgtaaagccggggtgctgaagcgggacgacctgaccgctgaactgctaagcctatggaacgcgtccggtcattatgccgatgccgccgcgattctggatacgcgcgtattccatccctgggaaggaggagaagggaaaatcaccggccagtatttgctcaatcagctccatcgggcattacagttcatcgagcgtggggcgtttaaacaggccacggactgtctgaaagccgcattacgctatcccgacaatctgggggaggggcgactgcctgggcaaacggacaacgatatctggtatttgctgggctactgcgcagaacaggctggggatgcgcagcaggcggcggaatattaccagcttgcccggcaagggggctcaacgctggacgccgggcggtactacaacgatcaacccgccgattaccttttctggcagggcattgcgctgcgtaagagcggtaacccagcgcaggccgagcagcacttccgccattttatcgactgggccgcgcagcatcgggatgacgttccgcaagtcgatttttttgccgtctctcttccggacctggtggttctcgatgtatcagcgcagcagagacatctgcagcactgcttgtttattgaagcgctgggccatctggggctgggcaacgtatccgcctgccagcagaggatgcagcagcttctgcaaataaatccggctcatgataaggcgcatctgattcgccatgccctgcaaagcggcattttttcctgaacctcaatgggcgggctcggcccgcctgaaccctactgttccctgcgtttcccttatagaggaatcattatgaacaacgcgcagacacatctgaaaatgggctacgtctggacgatttgtctggtcgccgcctgcggtggtttactgtttggctatgactgggtggtgattggcggcgctaagccattttatgaagcctggttttcaattacggacccggcgcagtccggctgggcgatgagctcagcgctgttgggctgtattttcggcgcattaatttcgggatggtgcgcagacaaactggggcgcaagctgccattaattctttccgccgtgctgttcagcgcgtcggcctgggggacggcggtcgccagtcatttcgatatgtttgtggtttaccgcattgtgggcggcgtagggattggtctggcttccgctctcagcccgctttacattgccgaagtcagtccggcagagaaaagagggcgttttgtcgcggtcaatcagctcaccatcgtgattggcgtgctggccgctcagttaatcaatctgatgattgctgaaccggtggagccgggggcgacgcagcagatgattgtggacagctggaatgggcagatgggctggcgctggatgttcggtgcggaactggtgccggcgctggcgtttctggtcctgatgttttttgtccccgagtcgccgcgctggctcatgaaggccggtaaaccggagcgcgcccgggctgcgctggaacgcattggttctgccgactatgccgacaggatccttcgtgaaatcgcgcataccctggaaaaggataacaataaagtctcctacggcgcgctgttggctccccaggtgaaaccgattgtgatcattggcatggtgctcgccatattccagcagtggtgtgggattaacgtcatctttaactacgcgcaggagatttttgcctcggcggggttcgatattaacagcacgctgaaatcgatcgtcgcgacgggcgtcgttaatctggtctttaccattgcggcgctgccgctggtggataaaatcggtcgccgtaaattaatgctgcttggcgcttcgggattgacgctgatctatgtgctgatcgccggcgcttacgccatgggcattatggggtggccggtactgttgctggtgctggcggcgattgctatttatgcgttgaccctggcgccggtgacctgggtgctgctggcggagatttttcccaaccgcgtacgtggactcgcgatgtctttaggtaccctggcgctgtggatcgcctgtttcctgttaacctatactttcccgctgcttaatgccggtctgggcgcggcaggaagcttcctgctgtatggtgtcatttgcgctgccggctacctctatatcctgcgcaacgtcccggaaacgaaaggtatcaccctcgaagcgctggaagagcagctggcgcagcgtcatacgggcgtgaatgcggcgaagcaggagcagatgcgctaatggcggaagagtggattctggagaacgcgcatctgcggatgtgcgtctcttctctgggcggcaaagtgcaaagtttattctcgcggcaatatcaagcgccggtgctatatgaaaatcccgccggcggcatgtttccgatgctgccattggccaatcgcgtcgccggcaaccgttttatttttcatgggcaggagattgtcctgccttgccaccatgccgacgagtatttctttcttcacggtgacggctggttacagcgctgggatattattgagtacggcgccgagtattgtgtattacagctgcgtcggcagcatgcctgcggtttcgattatctggcgcagctccgctaccagttgctgcgtaaccagcttatagcggagctaacgcttacccactatggggaggtccctgcgctttacggctgcggctttcatccctttttccctttcgatgaacgcagcaaggttcagttccaggtcagcggttactggccggaaggggagaatcacttacctctcaactggcaaggaaacttgcccgactatgccaatttcagcgtggctcagttcggtgaagatcgttggctgaacgtgggttattccggctggggcgggcgggcgagggtaagcaatgacgtgatgaatatcacaattctatcgcaaactccgtggttgatgctgttcagaatgcaaggtgaatcattcctttgcctcgagccgcaaagccatccggtaaacgcccacaacatggacgggcagccggggctgcgagttttaggcgcgggagataagctgaatttttcgctgaaaatcatcatcgagggggcataaataacgagctatcagcagacaagagcatcttgcgcccgccggggtttatcgccagactatcgccaccattcgggaggaaatcatggtcttgcactccacgcgctggctggcgctcagttatttcacctacttttttagctacggtatttttctgcccttctggagcgtctggctggccggaaacgggctgactccggaaaccatcggcattttgcttggcgccggtctggtggcccgttttctcggcagtctgctgattgccccgcgggtgagcgatccctcccggctgatcgccgcgctgcgcgtgctggcgctgttaaccttgctcttcgcgctggccttctgggccggcagccacgtagcatggctgctggcgatcatcatcggcttcaacctgttcttttcgccgctggtgccgctgacggatgctctggccaacacctggcaaaagcagatcaccatggactatggccgggtgcggctatggggctctattgcctttgtaattggttcggcgctgaccggcaagctggtgagcctgttcgattaccgggcgatcctgctgatgctaagcctgggggtcgcctcgatgctgctcggcatgctgcttaagccgtcggtgatgccccagggggagtcgcgccagcagcagggggccggaatggcggcctggctgacgctggtgcgccaaagctggcgctttctcgcctgcgtttgtctgctgcagggagcgcatgccgcctactatggctttagcgccatctactggcagcaggccggctattccgcctcggcggtcggttatctgtggtcgttaggcgtggtggcggaagtggtgatcttcgcgttgagtaaaaaggtgttccgccgcttcagcgcccgcgacctgctgttgctctccgccgcctgcgggctgattcgctggggactgatgggctggaccacggcgctgccgggactcatccttgcgcagatccttcactgtggcaccttcacggtgtgtcatctggcggcgatgcggtatatcgccgcccgtcagggtagcgaagtgatccgtctgcaggccgtctactccgcggtggcgatgggcggcagtattgccatcatgaccgtcttcgccggtttcctctatcagaacctgcaccagggcgtattttgggtgatggccctgctgacgctcccggcgatggctatacggccaaaagcggtggcggcctagtcctcgagcatggcgcagatatgctgctgctggcgttcagtgaagtagttctccgcgtggatcagcggcggcgaaaacagcggcagcgccgtcgcatagggggtgacgataagcgtcacccctttgggcgcaccttccttctgaaagcgctctacgctctggtatttgatattcagcggcagcagcgttagttcgcgcagctgttgttccagggcctcttcaatagctgggttgtcatcggttagcaacagcacctgtttctcgtgcaggtcgcttttctgcatcagccaggcgccaaagatcaccgcgattaaaccggtctcttcctcattaaaacggatgtgccaggcctcctcgaattcgctcaatgccgcctgggtggtacgcagtaagcgagggtagagccgggtcacttcctctgtgagcgtgctgtcgatgccgatagcaaacacgctgcggatcaacgcctgcgacaaatggatatagagttgatcgctgagcccctgctcatcactgaacgctctgccagcgaggatctgaaagcggtggatcaggccggagatagccagccgcaggcggcgatcgtgcgggtgaccgtcgcggaccgggtcgggggttttgagcaacataaacagcagcgagaggaaaaaaggttctccgacatggggcggagcgccgacccgacgctgccagtggcggacaatctcctgcgccagggtgaactcggcggcggtttgagcccagcgttgctgttcctcattgaagtccggagagtatccccggtgatgttcgagcagacagtactgcaggtacaagcgcagaaactgcacgtcgcggcagtcaaactggcgattgagcgcccgcgcgcagcggttcaccagcgcctgcagattggtatcatcgtataaggtgcgggcaatgccttcctgtttaagctgcgttttcagcgccggggtaaaatgatgattaacgaactgtgggcagaggcgcagcccccgccgcagcgcatgcagcagacataaacgttggtcgagcgcggcgccttcaatccgatagctgccgtccacctgtgactggagggtcaaacggtggtaacgctgaatttcgcgtccggtctcctcaatatcctgccgggccgtggtctcatcaacgaggttgatcctgccaagccgttcagtcgtcaccgactgtccgggcagataaaacatcaggagcacctggctacggcgctgtggactggaaagcgcagatggtggttcaatgacggtcatcatctggtaagttccagttagggtttccgctaaggatagacaatgaccgcggcgtgggcagggaagagcgtccgcttttactcaggattgctggcgaagttcacagaatttttcacgtgaggaacagatgaacagagtgaaacaatgcacaagcgcggcgtttttcatggttttatcatggtcggccgctgcgcatccgcatagcttcatcagcctgcaaagcgagccggtggtcaaggacggtctgctgagcgcctttaaaatgcgctggacgatggatgaaattacctcatcggatctgctctatgatgccggaaacgccaaaccgggcagcgaagtctggaaaaagctggcggcggaggtgatggccaacgtgctcggtcagcactatttcagcgagctgtggcataacggtcagcgggttaaatttgacaatcgtcccgacggttacggcctcgaacgtgacggactgcaggcggtactcacctttactctgccgctggcgacgccgcaacccattgccgggcagacgtttaccttttccaccttcgacccgacctactacgtcgatatgttttatgacaaggatagcgatttttccctgcccgcagggctgcgggccgcctgtaaggcaacggtgatgacgccaaaaccgaacgacaaaatgctctcatacgcccagtcgctggataaagcggatgcgccgccggaggatatggcgctgggcagctattttgcccagaaggtgaccctgacatgtcagtaatttttactccgcgtgcgcgatcttcgcgctggaaagcgctgtggccgctggcgctgttgctggctgtgagcatcatcggcggcatttggctgtggcgggcgtggccgcaggtgctgatgcagagcgcagtctggcagcgttcgctcaatctggaactcagccgcctgctgcaggcggtggcggagaacccggcggcggcagggctgtcgctgctggggtttagcttcgtttacggggtgctccatgccttagggcccggacacggtaaaattgtcattacgacctggcttgccacccatcccgcgaagctgaaatcaagcattggcctgacgctggccgcctctttattacaggggctggtggccatcgcgctggtggtcgtggtgctggcgctgctgcagctgccggcgcgccagctgcacctcagcagtttctggctggagaaggggagctatttgctggtgggtgcgttagggctgctgctgtgctggcgggcgttaaaaaagctgcgtctgctgctgcgccggccaacgtttaccgcttttaccccgcatcatgttcataacgaacactgcggctgcgggcatcagcatctcccggccccggagcagctgcaggccggcgacgactggcgggctcgcgccgcgattgtcctgtcgatgggcatgcgtccctgctcgggggcgatcatggttctgctgttcagcaaggtaatcggcgtttttggctgggggatggcggcggcgctggcgatggcggcgggaacctcgttgactatcacggcgctggcgctgttggtgcatgggttccgccaactggcgatccgcctcagtcgccatcaggcgccagcgttatggaagcaggttagttgggcgacgctggcgctggccggcggcgtcatattgctggcggcggcaggggtgatgtggctcagcgccgtccctgccggcggtgggatccgtccgttttagacagacgccgggcgcaaatcctaaagtgggcgccagcgcttgccgctggcgaagcgatgctctagttttccgcttttcggcggatgacaaggagtcgctatggccgcaaatatcgtttctcccgcgcagagcgggcggttctattatggctgcgccggcgccgccgggctgctggcgggcctggcgatcgtattctggtttccatccctggccagctggtggccgtcagatctggtgcgtgtctaccacgccatgccgtatgttatgcgattcggggtggcgagtgtcgcggatattccgctggtggcctacgccaccctaacgctgtcgggcttcgtgctggccttttgtcatcccggtcacagtaaactgcccattgttgcctgggctgtgcataaccagccctcgccgcgggagatggtcgactggatcctgcgcagctgggtgttgcagttcggttttctggtgatcattttctggcgtttcgcgtttatgggtaagctaagcagcgacaggctaatgcagatcgtgggcatctttaacgacgtatgctatctggccacgctggtgctggctggaatactgctgcgcgacggctggcgcgactttcagggcgttgccgcaccggcaggcaatattcgcattccgctgatctttgccctgagcttttatctgccgtttcagctggtatggattttactcagtgcgcagcagtatgagctgccgctgtggggatggctgctgctggttccggcgatggtcggcgtgctgctcgccaggctgacggtggtagggatagcgctgtgtttccggcgctggctggggccgcagggctgtctgcgctggcgcggaccgctggccttgtttagcggcctgacggtactgtgcatcggcggcaatgcggtgattcgccagatcctcaacatgataaaatgacataaaaaaaggaagccgcggcttcctttttgacatcagtaagagattaacgcttcagcgcgtcgctcagctgctcgcgcatgttcgccagcatcgctttcaccacgcgcgggttaccggcaacgatgttgcccgtcagcatatagttatgaccgccggtgaagtcgcagacaatcgcgccagcttcacgggcgatcagctcgcctgcggcgaaatcccatggtttcagggcgatctcaaagtaaccgtcaacgcggccggcggccacataggccagatccagcgcggcagagccggtgcgacggaagtcggcacattcggtaaacatgttgccgagaatattcatgtaggtggtggcgtgctgcttcgctttgaacgggaagccggtcgcgataatggtgccgtcgaggtcgcgagcgttgctgccgcgcagacggtagccgttcagctgcgcgccctggccgcgggtcgcggtaaacagttcgttacgcatcggatcgtagaccaccgcgacttcagtacgccctttgatgcgtacggcgatggaaacagagaagtgcggcagacgtttaacgaagttggtggtgccatccagtggatcgataacccattgaacatcctgctcttcgccagcgtgttcaccgctttcttcggtgataatggtgtgctgcgggtaagatttgcgaatggtttcgataataatcgcttcggcggctttatcgacgttggtcacaaaatcattgctgcctttctggctggtttctacggtgtctggcgtttcgtagtgtttggcaattaaattacccgccttgcgcgcggcgcgcacggcgatgttcagcatcggatgcatcggtctctctcactggatgttaaagaacgggaaaaaacggcgcatataatagcagccaaatctgcttatgtctccgttttatggtagcatgcacgaataatctttagccgaagaaccataatgctgcaaaatattcgaatcgtactggtagaaacttcccataccggcaacatgggctccgtagcccgcgcgatgaaaaccatgggcttaactaacctgtggctggtcaatccgctggtcaaacccgattcgcaggcgatagccctggccgcgggcgccagcgacgtgatcggcaacgcgcagattgtcgatacccttgatgaagcgctggcaggctgtagcctggtggttggcaccagcgcgcgctcccgcacgctgccgtggccgatgctcgacccgcgcgaatgcggtctgaaaagcgtcgccgaaggtcagcatgcgccggtggcgctggtctttggccgcgagcgcgttggtctgaccaacgatgaactgcagaagtgccactatcacgtggcgatcgccgccaacccggagtacagctcgctgaacctggcgatggcggtgcaggttatcgcctatgaagtgcggatggcctggctggcggcgcaggagcaagcgcagccggcggttgagcatgaagaggcgccgtacccgctggtggacgatctggagcgattctacgaccatcttgagcagacgctgctggcgaccggctttatccgcccgaatcatccggggcaggtgatgaacaagctgcgtcgtctgttcacccgcgcgcgtccggaaagccaggagttgaacatcctgcgcggcatgctggcgtctattgagcagcagaataaaggtaagtaaccgcgttaacgccggatggcgcttcgcttatccgggcaacgaatcgggctcgcctggcgggatgaaggtatcaggctatgcggaagtaaaacggcacggaaagccaaatacctgactaaaacagtcaagtaaatagttgaccaaattactcgggaatgtcagacttggccctgctatgcaatacccatattaataaaaagcccggccaggggcgagtttgaggttaagtaagacatgagactgacatctaaagggcgttatgccgtgaccgcgatgcttgacgttgcgctcaactctgaaacgggcccggtgccgttggcagatatttcagagcgtcagggaatttcgctttcctatctggaacagctgttctctcgcctgcgtaaaaatggcctggtttccagcgttcgtggcccaggtggtggttatctgttaggtaaagacgccggcagtatcgccgtcggcgaagtcattagcgccgtggacgaatccattgacgccacccgttgccagggcaagggcggctgtcagggcggcgataaatgcctgactcacgcgctgtggcgcgacctgagcgagcgcctgaccggcttcctgaacaatatcaccctcggggaactggtgaataaccaggagatcctcgatgtttccggtcgtcagcatcagcacgaaacccagcgcaatgcgcgcacccaggacgcgattgacgttaaactgcgcgcctgagtgacccgtcccgtttcgggctgcggctgacagggcaaggcggcgcgaaacggcgggacaacgattataaagagctttcagaatcaggccgggatgctccgacattccgtgtactcggtcgtacatcaagccggttgcctgattccttgcattgagtgatgtacggagtttaagagcaatgaaattaccgatttacctcgattactccgcaaccacgccggtggacccgcgtgttgccgagaaaatgatgcagttcctgaccatggacgggacctttggtaacccggcctcccgttcccaccgttttggctggcaggctgaagaggcggttgatatcgcccgcaatcagattgccgagctggtcggcgccgacccgcgcgaaatcgtctttacctctggtgcgactgaatccgacaacctggcgatcaagggtgcagccaacttttatcagaaaaaaggcaagcacatcatcaccagcaaaaccgagcataaagcggttctggatacctgccgtcagctggagcgcgaaggcttcgaagtgacctacctggcgccgcagagcaacgggattatcgatctgaaagagctggaagcagcgatgcgtgacgacaccatcctggtttccatcatgcatgtgaataacgaaatcggcgtggtgcaggatatcgctaccatcggcgagatgtgtcgcgcccgcggtatcatttaccacgtagacgccacccagagcgtgggcaagctgcctatcgatctgagccagctgaaagttgacctgatgtccttctccggtcacaaaatctacggtccgaaaggcatcggcgcgctgtacgtgcgccgtaagccgcgtattcgtatcgaagcgcaaatccacggcggcggccacgagcgcggtatgcgttccggtactctgcctgttcaccagatcgtcggcatgggtgaagcttaccgtatcgccaaagaagagatggaaagcgagatggcgcgtctgcgcacgctgcgcaaccgtctgtggaacggcgtgaaggatatggaagaagtgtacctcaacggcgacctcgagcagggcgcgccgaacattcttaacgtcagcttcaactatgttgaaggcgagtcgctgattatggcgctgaaagacctggcggtttcctccggttcagcctgtacttccgcgagccttgagccatcctacgtgctgcgcgcgttaggcatgactgatgaactggcgcacagttctattcgtttctctttaggtcgtttcactaccgaagaagagattgactatgccatcgatctgattcgcaaatccattggccgtctgcgcgagctttctccgctgtgggaaatgttcaaacagggcgtggatctgaacagcattgaatggtcacatcactaattcggcaccaataaggagaattcatcatggcttacagcgaaaaagttatcgatcattacgagaatccgcgcaacgtcggctcttttgacaacagcgacgagaacgtcggcagcggcatggtcggcgcgccggcctgcggcgacgtgatgaagctgcagattaaagtcaacaatgaaggtatcattgaagacgcgcgcttcaagacctacggctgcggttccgctatcgcttccagctccctggttaccgagtgggtgaagggcaaatcgctggacgaagcgcaggcgatcaagaacaccgatatcgccgatgaactggaactgccgccggtgaaaatccactgctcgatcctggcggaagatgcgattaaagccgcgattgcggattacaaaagcaaacgtgaagcaaaataattagttgaggttttgttatgtcgattactcttagcgacagtgcagcagcgcgagtcaatgccttcctggcgaaccgcggtaaagggtttggcctgcgcctgggcgtaagaacctccggctgctcgggtatggcctatgtactggagtttgttgacgagccggcggctgaagacaccgtgtttgaagacaaaggcgtgaaggtcgtgatcgacggcaaaagtctgcaattcctcgacggcactcagctggacttcgtcaaagaaggcctcaacgaagggttcaaattcactaaccctaacgtcaaagatgagtgcggctgcggcgaaagctttaacgtataatcggtactcctcaaccccaccgcggtcacgccgtgcgtggggttttaatttagatgcatgaccctgaggttactatggactatttcaccctcttcgggttaccagccagctataccctctcgcttgaacaactggctgtccggtatcaggatctgcagcgccagtaccatccggataaatttgccagcgcgcctgcggcggaacagcttgcggcggttcagcattccgccactataaaccaggcctggcagacgctgcgccatccgctgactcgcgcagaatatctcctttcgctgcatggcttcgatctggccagcgagcagcataccgttcgcgataccgcgttcctgatggaacagctggaattgcgcgaagagctggatgagatcggccaggcgaaagacgacgcgcggctggaaggttttatcaaacgggtgaaagcgctgtttgatacccgtcagcagctgatggttgaccaattgcataatgagagctgggaggcggcggcggacacggttcgtaagctccgtttcctcgataaactgcgcagcagtgctgaagaactcgaagaaaaactgctcgatttttaattttcggaagcaattatggccttattacaaattagtgagcccggcctgagcgccgcgccgcaccagcgtcgtctggcggccggtatcgacctgggcaccaccaattctctggtggctaccgtgcgtagcggccaggccgagactctgcccgatcatcaaggccgctatctgctgccgtcggtggtgaactaccacgcttcggggctgaccgtcggctatgacgcccggcttaacgccgctcaggatcctgccaataccatcagctccgtgaagcggatgatggggcgctctctcgccgatattcaaaaccgttacccgcatctgccgtatcagctgcaggccagtgaaaacggcctgccgatgatccagacggccggcggcctgctgaacccgattcgcgtctccgccgatatcctcaaagcgctggccgcccgggcgaccgaagcgctggccggcgaactcgacggcgtggtcattaccgttcccgcttacttcgatgacgctcagcgccagggaaccaaagacgcggcgcgtctggcgggcctgcacgtgctgcgcctgctcaatgagccgaccgcggcggctattgcctacggcctcgactccggccaggaaggggtgattgcggtctacgatctcggcggcggcacctttgatatctccattctgcgtttaagccgcggggtgtttgaagtgctggccaccggcggcgactcggctctcggcggcgatgatttcgatcacctgctggctgactacctgcgcgagcaggcgggcttcagcgaccgcagcgataaccgtctgcagcgtgagctgctggatgccgccatcgcggcgaaaatcgccttgagcgatgccgaggcagcgcacgtcgaggtcggcggctggcagggcgatatcacccgcagccagtttaacgatctgattgccccgctggtaaaacgtaccctgatggcctgccgtcgggcgctaaaagacgctggcgttgaagcgcaagaagtgctggaagtggtgatggtcggcggttcgacccgcgtgccgctggtgcgtgagcgcgttggcgagttcttcggtcgcactccgctgacctccattgacccggacaaagttgtcgccatcggcgcggcgatccaggccgatatcctggtgggcaacaagccggacagcgaactgctgctgctcgacgttatcccgctgtcgttaggcctggaaaccatgggcggcctggtggagaaagtgatcccgcgtaataccaccattccggtggcccgcgcgcaggagtttaccaccttcaaagatggccagacggcgatgtccattcacgtgatgcagggcgagcgtgaactggtccaggattgccgttcgctggcgcgctttgcgctgcgcggtatcccggcgctgccggcgggcggggcgcatattcgcgttaccttccaggtggatgccgatggcctgctgagcgttacggcgatggaaaaatcgaccggcgtggaagcctccatccaggtgaaaccgtcttacggtctgaccgatggcgaaatcgccaccatgattaaagattcgatgagctacgccgaacaggatattcaggcgcgcatgctggctgaacagaaagtggaagccgcgcgcgtactggagagcctgacaagcgcgctggccgccgacgccgcgctgttaagcgccgcggagcgtcaggccatcgatgccgctgcggagcaggtacgcgccgccgcggcaggcgacgacgctgacgcgattaaagaagcgattaaaaatatcgacacacaaacccaggaattcgccgctcgccgtatggatcagtcggtccgtatcgcgctgaaaggccaatccgtggacgaggtttaaaatgccaaaaattgtatttctgccccaccaggacctgtgtccggatggcatcgttgtggaagctgagaccggtgaaaccattctcgatgccgcgctgcgtagcggtatcgaaattgaacacgcctgcgaaaaatcctgtgcctgcaccacctgccactgcatcgtgcgtgaaggttttgactcgctggcggaaagtagcgaagatgaagacgacatgctggataaagcctgggggctggaacctgacagccgtctgagctgccaggcgcgcgtcaccgacgaagatctggtcgttgagatcccgcgttacaccatcaaccacgcacgcgagcactaatatggcactgaaatggaccgacagtcgcgaaatcggcgaagccttgtatgacgcttacccggatctcgacccgaaaaccgttcgctttaccgacatgcatcagtggatttgcgatttggaagagtttgatgatgatccaaacgcatccaatgaaaaaattctcgaggcgattctgctagtctggctagacgaggccgaataatttcgcgttaagcgaaaacattttaacgggctgccatagggtggcccgtttgctaagaaggataatgataatgaccgaagctatgaagattacgctttctactcagccagccgatggacgctggggagaaaaagcgacctggagcatcaataacgacggcatcgctctacatctcaacggtaaagacgacctcgggcttatccagcgcgcggcgcgcaaaattgacggcatgggcatcaagcacgtcgccctgagcggcgaaggctggaacaccgatcgcgcctgggccttttgggccggctataaagggccgaaaggtcagcgtcaggtcgaatggccatcccttgacgacgcgcagcgcagcgagctggataaccgcctgacgatcatcgactgggtgcgcgacaccatcaatgcgccggcggaagagctgggtccggagcagctggcgcagcgcgctgtcgacctgctgtgcggcgtggcgggtgagaagataagctatcgcatcaccaaaggcgaagatctgcgcgagcagggctatcttggtctgcataccgtgggccgcggctccgagcgcccgccggttctgctggcgctggactataacccgaccggcgataaagaggcgccggtatacgcctgcctggtgggcaaaggcatcacctttgattccggcggctacagcatcaagcaaagcgcctttatggattcgatgaaatccgatatgggcggtgcggcgactatcaccggcgcgctggcttttgccattacccgtgggctgaacaaacgcgtgaagctctacctgtgctgcgccgacaacctgatcagcggtaacgccttcaaactgggcgatattattcattatcgcaacggcaaaaccgttgaagttatgaacactgacgcggaaggccgcctggtgctggcggatggcctgattgacgcctcggcgcagaagccagagctgatcatcgacgccgccaccctgaccggcgcggcgaaaaccgcgttgggcaatgattaccacgcgctgttcagctttgacgatgcgctggcgaatcgcctgctggcgagcgctcaggcggaaaacgaagccttctggcgtctgccgctggccgagttccaccgcaaccagctgccgtccaactttgctgacctgaacaacaccggcagcgcggcctatccggccggcgccagcaccgcggcgggcttcctgtcccacttcgtggaaaactaccatcagggttggctgcatatcgactgttcggcaacctaccgcaaatctgccgttgagcagtggtcggcgggcgccaccgggcttggcgtgcgtaccattgctaacctgctgacagctgagtaatggcctggccgggtggcgcccgcgcttacccggccaggaaaaccatatgcccgcgtggacgaatggccgccgggcaattcattgtgaagtagccaaactatgtcagatacaaaaaatgaattagaaaccctgctggaaaaagcggcgactgagcccgcccatcgtccggcatttttcagcgcgctgctggaggccaccgtctgggtgccgggcagggcagccgatggcgagcagattgtcgaagatagcgcgctggatctgcagcattgggaaaaagacgacggtacctcggtgatcccattctttacctcgctggaggcgctgcagcaggcggtggcggatgaacaggccttcgtgatgatgccggcccgcacgctgatggcgatgacgctgggcgaatcgttattcctcaacccgaagctgccgagcggcaaagagttcaccccacgggaaatcagccatctgttaggcgaagagggcagcccactgagcacccagacggtactggaaggcggcgaagcgctgctgctgtctgaagtcgccgaaccgccggcgcagatggtcgattcgctgaccacgttgttcaaaacgctgaagaccgtcaagcgggcgtttctgtgctcgattaaagagcgcgccgatgcgccggccaacttattgatcgggattgaagcggaaggggatattgaagccattatccagaccaccggcagcgtggccaccgataccttgccaggcgacgaaccgatcgatatttgccaggtggtggaaggcgagaagggcatcagccattttatgattgcccatatcacgccgttctatgaaaagcgctggggcagcttcctgcgcgattttaagcagaaccgcatcatctgacagcgggggcggcagcccccgctgtttctttctgcttccagttcgaggcacaaaagcggggtggcaaaagctaatgcagggcggcaaagattcgcggataggcagacaccatgtgatagaggagaaatcccgtcacgcacagtgtgacaatgccgttgaagagcgccatatccccgcgccaggcccggcacctctcttcgcccagcagagaacgtagcgctgccaccagcccgccgaccagcataaacgccagtaacacccctgccatttgcgcgataacaatgtaccagcccagcggcgtattcacgtcccgggcgctcatcagcgcgatctgcgccggcaaaatcgtctggaacccgagggtaagtatcatgagaagacgcaagtccgccagctgagcgtcgaacgtccgggccaggcgccgggcgtcacgcaggagcagcacccctgacgccaccgccgcggcaacgctgatgtgctggagaataaaaatatataacgccagggttccggatgggactcgggacaaaaagaacagattgcaaaagaccatgaccagcaggccaaattttgtgacccaggcacggaatacctcgccgggccagcgccggcttgacgctgggttatgcatcatccacgcggcaagggtcgacttaccgtaaccgggcgcgagcagcaccatcagaaaacccagcagcgcctggtgaccataggtgatcagtgggacctcttccagagtgaccccgagaaagcgggtatacacggagactggcgcaggcaccaggcttagccatgtccggttccattgcggccaaaaataaaggatcgcgccgcctgccagcaggccagctatacctcccagccagggaaggcgcggtgaataagccgaatgtgggttagagactaatgccattttcactccttgtggtgacatcagattgggatggactggatgcgctatcagccctgaggaattctgtaccagtgctctgcctccccatcaggcaaagcgaactcggcaggaacaagccctgcggcagcacagagtaaccggtttagcgagaagcagaagaaagtgggagagaaaatcagaaattatttagtgaccgcggaacgggaggcccgcggtcacgccgtgtttacggagcggcaggggccggttcaatcggcagatcgctccgcgcgccccattcgctccaggagccgtcatacaggcagacgccgttcacgccaagcgtggtgagcgccagcacgaccaccgccgccgtcacccccgagccgcagctggcgatgatcggccgttcaaaatcgacaccctgacgtaaaaagatgtcgttcagctcgtcaacggttttcagttcgccgttaatcaccagatccgtccacggtacgttcagcgcgccggggatatgcccgcggcgcaggcccgggcgcggttcgtcggcctggccgttaaaccgggccgccggacgggcatcgacaatctgcgccgatccttcatggctgaccaacaggacgtcggtcagacgcttaatttgttgaggatcgaaccgcacgtcgaattccccttcggccacctccggcatcccttgttccagcggcagttcgtcgcgccgccagccctccagtccgccggccagaattgacaccttctctacgccaaaggtgcgcagcatccaccacgcgcgcggggcggaaaacagattgccttcgtcatagaccaccagatgcttatcgctgcagacgcccagttcgcgcatggcgacggcaaacgcttcggcccgcggcatcatatgcggcagcggactggtgtggtcggatagcgcctcgatatcgaaaaacagcgcgttcggcacatggccggcgcggtattccgcggccatatcccgcagggcctcctgcccggcgggcgccatgcgggcgtcgataatctgaatttccgggtcatcaatatgttctgccagccagtcggcagcgacaaaaaacgaggtggacataggtgcctccgttttattattcatgactgaattgtcggcgttttagctggcgctgacaagttaaggacgccagagtggggacggcgtcacggcacttttctgattaatcggcagaaacccgcttcgtcactgttgagaagcgccgccataacgcataataaatgtgacaaattgcatcaggctcatcggccgaggggttagaaggatgaaaccatttcgtttagcggcgctatcactagcgctccttaccgcattttcattaaccgggtgtgatgacagcggtacaccgcaggcctcggccccggcgccagccgcggatagcaacccaggcgcgacggcaaaaccggaccgcgcccagctggcggcgctggcggaaaaaagccagggtaaagcgctgacgctcctcgacgcctcggaggtgcaactggatggcgccgcgaccctggtgctgacgttttccgtcccgctgcagccggaccaggatttctcgcgcagcgtgcatctggtcgacaagaaaagcggtaaggtggacggtgcctgggagctggcgccgaatctgaaagagctgcgtctgcgtcaccttgagccaaagcgcgagctgattgtctcagtcgacccgacgctgaccgccctgaacaaggcgacgctcgataaaccgtttgagaagaccctgaccacccgcgatatcgcaccgagcgttgggtttgccagccgcggctcgctgctgccgggcaacgtggtcgccgggctgccggtgatggcgctgaacgtcgataatgtcgacgttaatttcttccgcattaagccggaatcgctctccgcctttgtcagtcagtgggaataccgtaactcgttaagcaactgggaatctgatgaactgctgaagatggcggatctggtctacagcggccgcttcgatctcaacccggcgcgtaatactcgcgaaaagctgctgctgccgctgagcgacatcaagccgctccagcagcctggcgtctacgtggcggtcatgaacccggcgggccgttatagctacagcaacgcggcgacgctgtttaccctcagcgatatcggcgtctcggcgcatcgctaccataaccggctggacgtttttacccagagtctggaaaacggcgccgcccagtcgggcattgagatgcagttgctcaatgccaaagggcagaccctggcggaagcgaaaagcgacagccagggccacgtcaccctgcaaaccgataaagaagccgcgctgctgctggcgcgcaaagaggggcagaccacgctgctcgacctcaagctgccggcgctggatctggcggaattctctatcgcaggcgcgcccggctttagcaaacagttctttatgtttggcccgcgcgatctctatcgtcccggcgaaacggtgatccttaatgcgctgttgcgcgatagcgacggcaagccgctggcggagcagccggtgaaactggaggtggttcagccggacggccaggtgatccgctcggtgatgagcaaaccagtgaatggcctgtaccagtttacttatccgctcgacagcggcgcggttaccggcatgtggcacattcgcgccagcgccggcgacaaccagccgcgcgaatgggatttccacgttgaagactttatgccggaacgcatggccctgaacctgacgccgcaggccgcgccagtcgcgccggatgccgacgtcacctttggcgttagcggcgcttatctctacggcgcgccggccagcggcaaccagctgcagggcaagctgttcctgcgcccgctgcgcgacgccgtcgctgcgctgccgggcttccagttcggcgatattgcggaagaaaacctctcccgtagtctggatgaagtccagctgacgctggacgaaaaaggccatggcgaagtgaccacctcaagccagtggcaggatagccattcgccgctgcaggtggtgctgcaggccagcctgctggaatccggcggtcgcccggtgacccgtacggttaagcagccgatctggcccgccgaggcgctgccggggatccgcccgcaatttacgctgaaggacgtttacgattaccgcaccgataccaccgtgaaacagccggtggtggatgaaaacagtaacgccgcgtttgatatcgtctatgccgacgtcaaaggcgagaaaaaagcgatctccggtctccaggtgcggctgatccgcgagaggcgcgactactactggaactggtccgacagcgaaggctggcagtcgcagttcgatcaaaaagatctgcaggagggcgaggagtcgctggacctgcaggccggccagatcggcaaagtgagcttcccggtggagtggggatcctatcgcctggaggtgaaaggaccggacgacgtggtcagcagcgtgcgcttctgggcgggctacagctggcaggataacagcgaaggcgccggcgcggcgcgtcctgaccgggtcaccatgaagctggataaaccgagctataaaccgggcgacaccatcaggctgcacatcgccgccccggcggcgggtaaaggctacgcaatggtggaatccagcgaagggccgctgtggtggcaggaaattcacgtcccggcggaggggatggacctgtcgatcccggtggataaaacctggaatcgccacgacctctacctcagcacgctggtggttcgtcccggcgataaatcgcgctcggcaacgccgaaacgcgcggtgggcctgctgcatctgccgctgggcgatgaaaaccgtcgcctgacgctggcgctggaggccccggacaaaatgcgccccaaccagccgctgacggtgaaagtgaaagccagcgtcaaagagggcgaggcgccgaaacaggtcaatgtcctgctctcggcggtggatagcggggtactgaatatcaccgattacgctaccccggatccgtggaacgccttctttggccagaagcgttacggcgcagatatctatgacatctacggccaggtgatcgaagggcagggacgtgtggccagcctgcgcttcggcggcgatggcgacgagttaaaacgcggcggcaaaccgccggttaaccacgtgacgatcgtcgcccagcaggcgcagccggtggtattgaacgatcagggcgaaggcacggtgacgttacccattggcgattttaacggcgagctgcgggtgatggcccaggcgtggacggcggatgacttcggcagcagcgaagataaagtggtggtggccgccccggtcatcgccgagctgaacactccgcgcttcctcgccagcggcgatactacgcgtctggcgctggatctcagcaatctgaccgataaaccgcaaaccctgcaggttcaccttaccgccagcgggctggtaacgttgagcgagggtcaactgccgccggtgcaactggcgccgggggcgcgcagcacgctgtttataccagtgagcgcgctggcgggcttcggcgatggtcaggttaatgccaccatcagcggcctgagcctgccgggcgaaaccttcgccccgctgcaaaaacagtggaaaatcggcgtgcgtccggcgtacccggcacagaccgtcaacagcggcgcagtgctgcagccaggtgaaagctggcagccgccggcggcgcagagccagggctttgccccgcaaacgctgcagggccaactgctgctcagcggtaaaccaccgttgaatctcgcccgctatatccgcgagctgaaagcctatccttacggctgccttgagcagaccgccagcggcctgttcccgtccctgtataccagcgcggcgcagctaaaggcgctgggcattagcggggacagcgacgaaaaacgccgcgcggccatcgatgtcggtatttcacgcctgctgcagatgcagctggaaaacggcggctttgcgctatgggatagagaggggccggaagagtactggctgaccgcctacgccatggacttcctcgtgcgcgccagcgagcagggctatagcgtaccggtcaacgccattaataaaggcaacgagcgcctgctgcgctatctgcaggagccgggcctgatgaccgtgcgctacagcgacgacgcccaggctagccgctttgccgcccaggcatacgccgcgctggtgctggcgcgtcagcaaaaagcgccgctcggcgccttgcgtgaaatctggagccgtcacgaccaggcgcgatccggcttgccgctgctgcagctcggcattgcgctgaaaactatgggcgatgcgccgcgcggcgacgccgccctgaagctggcggttgccaccccgcgccaggatgagaatcgttggctgggcgattacggtagcccgctgcgcgataacgccctgaagctggcgctgctggaagagaataagctgctgccggaggtgcaaactcagctgttgagcacgctgtcggaagaggcctatggccagcgctggctgtcgacccaggaaaccaacgccttgttccttgccggacgtacgctggcggacctgccgggcagctggcaggcgcaaacctcgctgcaggcggagccgctggccggcgacaaagcgcaaacccgcaacctcgacggcgatcggctggcggcgctgcaggtgagtaataccggcagtcagccgctgtggctgcgtctcgacagcagcggctatccgcaaagcgcgccgcagccgggcggtaacgtcctggggattgaacgcactattttcgatacccaagggcagcagaaatcgctgtcttcactgcgcagcggcgaactggtgctcgtcaagctggaggtgaccgccaaacgcaacgtgcctgacgcgctggtggttgatctgttgccagccggtctggagctggaaaaccagaatctggccagcagcagcgccagcctgcaggagaatggcgacgcggtgcaaaacctgcttaaccggatgcagcaggcggatattcagcatatcgagttccgcgatgaccgtttcgtcgccgccgtcgctgtcaatgaaggccagccggtgacgctggtctatctggcgcgggcggtgacgccgggcacttatcaggtcccgcagccgcaggtggaatcgatgtatgcgccgcagtggcgggcgacaggagcggccagcggtccgctcaccgtgacgccgtaaatgcgcgtattgcctcgggtaaaacgccgctggcgctggctggcggcgtttatttttctgctgtggctggcggtgctggcggccgatcgcctgtggccgctgccgctgcatgacgtcacgcctgcccgtgtggtggtggcggaagacgggacgccgctgtggcggtttgccgacgcgcagggcgtctggcgttatccggtcacgctcgccgacgtgtcgccgcgctatctgcaggcgctcatccagtatgaagaccgctggttctggcgccatccgggggtcaatcccttcgcggtgctgcgcgccgcctggcaggatcttacttccgggcgagttatctcgggcggcagcacgcttaccatgcaggtggcacgcctgcttgatccccatccacgcaccttcggcggcaagctgcgccagctgtggcgagcgctgcagctggagtggcatctgtcaaaaagcgacattctaaccctctatttgaaccgcgcgccgtttggcggcaccctgcaggggatcggcgcggccagctgggcctatctcggtaagccgcctgccaggcttagctacggcgaggcggcgctgctggcggtacttccccaggcgcccagtcgtttacgtccggaccgctggccgcagcgggcccaggcggcgcgtgataaagtgcttacgcgaatggtcagccagggcgtctggccggagcaggcggtaaaggaagcgatggaggagccagtatggctgtttccgcgccagatgccgcagctggcgccgcttttttcacgccgcgcgctggcgaccagtcgtgatgaaaaggtggtgacgactctggatgccggactgcagcggcaactggaagatctggcgctgaactggaaatcgcgcctgccgccgcgcagttcgctggcgatggtcgtcgtcgaccacacggatatgaaagttcgcggctgggtgggctcggcggatatcaccgacgacagccgcttcggccatattgatatggtctcggcggtacgctcgccggggtcggtgctgaaaccctttatctacgcgatggcgatggatgaggggctgattcacccggcatcgctattacaggatgtgccacggcgttttagcgattatcgccccggtaatttcgacagcgggtttcatggcccggtgagcgccagcgaggcgctggttcggtcgctgaatctgccggcggtgcaggtgctcgaagcctatggaccaaaacgctttgcggctaatttacgcaacgccgggctgcccctgacgctgcccgctggcgcagagccgaatctgtcgctaatcctcggcggcgccggggcgcggctggaagatattgtcgcggcgtacagcgccttcgcccgccatggcaaggcggcgcggctgcgcctgaagccgagcgatccattgaccgagcgcgcgctgatgtcgcccggggcagcatggatcgtccggcgtattttggccggcgaagcgcaaccggttcccgatgcctcgctgccgcaggcggtgccgctggcgtggaaaaccggcaccagctacggctatcgcgacgcgtgggcggtcggcctcaatgcgcgatatctgataggcatctggaccgggcgcccggacggtacgccggtggtgggccagtttggcttcgccagcgccgtaccgctgctcaaccaggtcaataatctgctgctggcccgcccggcgatgagccgcggcgggctgccgagcgatccgcgcccggcaacggtcagccaggggacaatctgctggcctggcgggcaggatctgccggcgggcgacagcaactgtcgtcgtcgcctggccagctggcttttggatgccagccagccgccgaccctgctgctgccggggcaggagagcgtacgcgggatccgcttcccggtgtggcgcaatgaacacggcgaacgggtggcggcggattgtcccggcgctcgggaaagccaggtcgaagtctggccgctgccgctggatccctggctgccggccagcgaaaggcggcgcgcgcgcctgggtccggcatcggagtcatgcccgccgttacagactcaggataccgcgccgctggtgctgtccggcatccgtgatggggcggtgataaaacgtctcccgggtgaggcgcgggtgatgttgccgctacaaaccagcggtggggaggggcggcgctggtggtttattaatggcgaaccgttagaggccgccggcgcaagaaccacgctaatgctggataaacccggcgagtggcagttggtagtgatggatgaagcgggtcagacggcggccgccagcttcaccctgcaataaccagggtaaatttgttgttggcggtttgtgttttcaatactcatcttattttaacaaaatgttaccttcatccgtaggcaggggcggggatgctcattataatgcgcgccaggccatacaatcgtatgtgcaacaacagaacatttaattagaggtaatcatggctattgaacgtactttttccatcatcaaaccaaacgcggtggcaaaaaacgttattggcagcatcttttcccgctttgaagctgcagggttcaaaatcgtcggcaccaaaatgctgcacctgaccgttgaacaggctcgtggtttctatgctgagcacgaaggtcgcccgttcttcgacggtctggttgagttcatgacctccggcccgatcgtggtttccgttctggaaggcgaaaatgcggtacagcgtcaccgtgacctgctgggcgccaccaatccggcaaacgccctggcgggtaccctgcgcgctgactacgctgacagcttcaccgagaacggcacccacggttccgactctgtagaatccgctgcccgcgaaatcgcgttcttctttgctgaaggcgaggtttgcccgcgcactcgctaatctcctgcgtctttcacgccacagcattgttggcttccttcgcgcaccccggtcacatagttatctatgctcccggggatttgcgaactcgccgtctcgctgtgacctgaaatactttggagatacaaacctcgtcttttcgaccgtcgcgggtcggctgcgcgcgttcaccccggtcacatagttatctatgctcccggggattaatgagaggctcctgcctctcaccggaggccagcctacggctggtcaaattcgttcccgacgaatttgtcacttgcttgccgccttgcgacaatcgaaaagccttagaggattgagcagtcagttacagattttttttcattgctttgtgcaaacgtggcaatgatgcgccagaatttgtagaatatagcgcccctggacgagcagtcgctctccggggcgtttctttttcaacccacctggggccataacgtgtaataacgaggccggaaaatattatgtctgaacaaattgtcacgcctgataccgccgctctgacggtgccgaacaaagatgccaaaatcaacctgctggatttaaaccgtcagcagatgcgcgagtttttcaaaaacatgggcgagaagcctttccgcgccgatcaggtgatgaaatggatgtatcactactgctgcgacgactttgatgagatgaccgacatcaacaaagtcctgcgcagtaaactgaaagaagtggcggagatccgcgccccggaagtggttgaagagcaacgctcaaccgacgggaccattaaatgggcgattgccgttggcgatcagcgcgtcgagaccgtctatatcccggaagaagaccgcgccaccctgtgcgtctcctcccaggtaggctgcgcgctggagtgcaaattctgctccaccgcccagcagggctttaaccgcaacctgcgggtatccgaaattatcggccaggtttggcgcgcggcgaagatcgtcggcgcggtgaagaccaccggcgtgcgtcccattaccaacgtagtaatgatgggcatgggcgagccgctgctgaacctcaacaacgtcgttccggcgatggaaatcatgctcgacgatttcggctttggcctttccaagcgtcgtgtaaccttgtctacctccggcgtggtgccggcgctggataaactcggcgatatgatcgacgttgcgctggcgatctccttgcacgcgccgaacgacaccattcgtgacgaaatcgtcccgatcaacaaaaagtacaacatcgagacgttcctcaactcggtgcgcggctatatttcgaagtccaacgccaaccagggccgggtgaccatcgagtacgtgatgctggatcacgtcaacgacggcaccgagcacgcccatgagctggcggcgctgctgaaagatacgccgtgcaagatcaacctgatcccatggaacccgttcccgggcgcgccgtatggccgcagctccaacagccgcatcgaccgtttctccaaagtcctgatggagtacggctttacgaccatcgtgcgtaaaacgcgcggcgacgatatcgatgccgcctgcggccagctggcgggcgacgtcattgaccgtaccaagcgtacgctgcgtaagcggatgcagggcgaagcgattgacgtaaaagcggtctgacaaatgatgacccgtgcagcgcaggcggcacgggtcatatttatggccgatagccaggcgaaatacgctgattcggttaataattacggtgcgtttttgtcgactttgaggcagtatgtagcggcacaacaaccgcttagcattcaattttgattcgtctctgtgatcgcgcggctgacagtcctatactgtgaggctgacgtagcacagatgtctcgcggcgccggctttttcccgcgctgaactttaaatttcacgtaccagtagttgtagcgaatgaatactgaagccactcaagatcatcaagaagcaaacaccacgggcgcgcgtctgcgtcacgcccgcgaacaactcggacttagccagcaagcggtggccgaacgcttatgcctgaaggtgtccacggttcgtgatattgaagacgataaggcccccgccgacctcgcctccaccttcctgcgcgggtacatccgctcctacgctcgcctcgtacatattccagaagacgagctgctgccgatgatggccaagcaggcgcccatccgcgcggcgaaagtcgcgccaatgcagagtttctctttaggcaagcgccgcaaaaagcgcgacggctggctgatgagcttcacctggctggtgctgtttgtggttatcggtctgagcggcgcctggtggtggcaagaccataaggcgcagcaggaagagatttcgaccatggccgatcagtcttccgcagagctgaacggcggcgacgccaacagccagaacgtgccgctggataccagcgcccctgcagccccgaccgccgatagcgccgcgaacagcgcgccaaccgataccgccagcgcaccgaccaccagcgcgccggcccagacgccagcggataataacgctgtcgtggcgccttcccaggccaatgtcgataccgcggggacgacgccggcagctccggctaccaccccagcctcgccgttgccgaccgatcaggcgaacgtcacgactccggcggcgtcggcgcaggatctggtgatgaacttttccgccgactgctggctggaagtgagcgatgccaccggtaaaaaactgttcagcggcctgcagcgtaaaggcggtaacctgaacctgagcggtcaggcgccgtataagctgaaaattggcgccccggccgcggtacagatccagtatctgggcaagcctgtcgatttaagtcgttttatcagaactaaccaggttgcgcgtctgaccctcaatgccgaatcatcaccggcgcagtaacagacgggtaacgcgggagatttttcatgcataaccaggctccgattcaacgtagaaaatctaaacgtatttacgttggtaatgtgccaattggcgatggggctcccatcgccgttcagtcaatgaccaatacgcgcaccaccgatgtggcggcgaccgtaaatcaaatcaaagcgttagagcgcgtaggcgcggacattgtccgtgtctctgttccgacgatggacgctgctgaggcgttcaaacttatcaaacagcaggttaacgtcccgctggtcgccgatatccactttgactaccgtattgcgctgaaagtggcggaatatggcgtcgactgcctgcgtatcaacccgggcaacatcggcaacgaagagcgcatccgcatggttgtagattgcgctcgcgataaaaacatcccgatccgcatcggcgtcaacgccggctcgctggaaaaagatctgcaggaaaaatatggcgagccgacgccgcaggcgctgctcgaatccgccatgcgtcatgtcgatcatctcgatcgtctgaacttcgatcagtttaaagtcagcgttaaagcctccgatgtcttcctggcggtggaatcctatcgtctgctggcgaaacagatcgatcagccgctgcatctcgggatcaccgaagcgggcggcgcgcgcagcggcgcggtaaaatcggcgatcggtctgggactactgctgtccgaggggatcggcgatacgctgcgcgtctcgctggcggcggatccggtggaagagatcaaggtcggcttcgatatcctcaaatctctgcgtattcgttcccgcggcattaactttatcgcctgcccgacctgttcacgccaggagtttgacgttatcggtacggtgaatgctctggagcagcgtctggaagatatcatcaccccgatggatgtttcgatcatcggttgcgtggtgaacggcccgggcgaagcgctggtctccacccttggcgtcaccggcggcaacaagaaaagcggcctgtatgaagacggcgtgcgtaaagatcgcctggacaacaacgacatgatcgaccagctggaagcgcggatccgcgccaaagcctcgatgctcgatgaagcccgtcggattgatgttcaacaggttgaagcaaaataacgtgttgggaagcgatacgcttcccgtgtatgattgaacctgcgggcgcgaggcgccggggttcatttttgtatatataaagagaataaacgtggcaaagaacattcaagccatccgtggcatgaacgattatctgccgggcgaaaccgctctctggcagcgcattgaaggctcactgaagcaggtgctcggtagctacggttacagcgaaatccgtttgccgattgtagagcagaccccgttattcaaacgcgcgatcggcgaagtgaccgacgtggttgaaaaagagatgtataccttcgaagaccgcaatggcgacagcctgacgctgcgtccggaagggacggcgggctgcgtacgtgccggcatcgaacatggtctgctgtacaatcaagaacagcgtctgtggtacgtcgggccaatgttccgtcacgagcgcccgcagaaaggtcgctaccgccagttccatcagatcggcgccgaagtgtttggcctgcagggcccggacatcgacgcggagctgattatgctgaccgcgcgctggtggcgtgagctgggcatctccgagcacgtcagcctggagctgaactccatcggttcgctggaagcgcgcgccaactaccgcgacgcgctggtggcatacctggagcagtttaccgataaactggatgaagacagtaaacgccggatgtataccaacccgctgcgggtgctggactccaaaaacccggacgttcaggcgctgctcaacgacgcgccggcgctcggcgattatcttgacgaagagtcgaaagcccactttgccggcctgtgcgcgttgcttgacgatgccgggatccgctacaccgtcaaccagcgcctggtgcgcggccttgattactataaccgcaccgtgttcgagtgggtgaccaccagccttggttcccagggcaccgtctgcgccggcggtcgttacgacggcctggttgagcagctgggcggtcgcgctaccccgggcgtgggttttgccatggggctggaacgtcttgttttactggtccaggcagtgaatccggaatttaaagccgatcctgttgtcgatatatacctggtagcctccgggaccgatactcagtctgctgcaatgcgtctggctgagcaggttcgcgatgcgctgcccggcgtgaagctgatgaccaaccacggcggcggcaactttaagaagcagttcgcccgcgctgacaagtggggggcgcgcgtcgcgctggtggtcggtgaatcagagattgctgacggaaacgtggtagtgaaggatttacgctcaggtgagcaaactaccgtaacgcaggagagcgttgccgcgcatttgcgcacacttctgggttaatctcccgggaattattagtcaggagaaggactgcgtggaaacttttaacaacgagaacgatcaggtcgatgcgctgaagcgtttctttgccgaaaacggcaaagcgctggcggtcggggtgattttagggattggcgcgctggttggctggcgctactggacctcccatcagcaggataccgccagagacgcgtcgctggcttacgagaaggcgacttccgcgctgaaatcgaatacgccagaagtgctgtcaggggcagagaaattcgcggctgacaataaaaatacctacggcgccttcgcctctctcgagctggcacagcattttgttgaacagaacgatctgccgaacgctgaaaagcagctgcagcaggggctggcggccgcatctgatgataatctgaaatcggttatcagtatgcgtctggcccgcgttcagctgcaaatgaaacaggctgatgcggcgctgaaaaccctcgacagcatcaaaggtgagggctggaccgccattgtggccgatttgcgcggcgaaattctgttgagcaaaggcgataagcaaggggcccgtgcggcgtgggaagctggcgtgaaaagcgatgcttctcctgcgctcagcgaaatgatgcgtatgaaaatgaataatttgtccatctgagagggactcgatgcaattgcgtaaattactgttgccagggctgctttccgttaccttgctgagcgggtgttcgctgtttaatagcgaagaagatgtggtgaaaatgtcaccgctgccgacggtagaaaaccagtttacgccgtccacgtcctggagcacctcggttggcgatggtatcggcgaattttactctaaccttcatccggcctttgccgacggcgtagtgtatgctgctgaccgtaaaggcaccgtcaaagcgctgaacgccgacgacggcaaagaggtgtggtcggtgaatctggcggagaaagatggttggttctcgcgcacgccagcgctgctttccggcggggtgaccgtctctggcggccatgtttatatcggcagcgagaaagcgcagctttatgcgctgaataccagcgatggtaccgtggcctggcaaacccgtgtcgccggcgaggcgctgtcgcgtccggtggtgagcgatggcatggtgctggtgcataccagcaacggccagctgcaggcgctaaacgagactgatggggccgtgaagtggaccgttaacctcgatatgccggcgctctccctgcgcggcgagtctgcgcctgcgaccgcctacggcgcggcgatcgtcggcggcgacaacggccgcgtcagtgcagtattgatgcagcaggggcagatgatttggcagcagcgtatttctacggccaccggcccgacggaaattgaccgcctgaacgacgtcgacacgacgccgatcatcgttaacggtgtggtttatgcgctggcttataacggcaacctgaccgcgctggacctgcgtagcggccagattatgtggaaacgcgagctgggttcggtgaatgatttcatcgtcgatggtaaccgtatctacctggttgaccagaacgatcgcctgctggcactgaccaccgacggcggtgtaaccctgtggacgcaaagcgatctgctgcaccgtttgctgaccgcgccggtgttgtataatggcaatctggtcgtcggcgatagcgaaggctacatgcactgggttaatccggaagatggccattttgtggcgcagcagaaagtggacagctccggcttcctgaccgacccggtggttgccgatggtcgactgctgatccaggcgaaagacggtacgctgtacgcgattacgcgttaattaccgctgtcgtgagtgattaagaaacggcccctggcagacaggggccgttttgacttttttaaaaacgtcgttaagacgatgttgcttagtgattgtatgaggcatttaacatgatacctgtggtcgcgcttgtcgggcgccctaacgttggaaaatccacgctctttaaccgcctgacgcgcactcgtgatgcgctggttgcggatttcccggggctgactcgtgaccgtaagtacggtcgggccgaagtcgaaggccgcgaattcatctgtatcgataccggtggtattgatggtacggaagagggcgtggaaacccggatggcggagcagtcgctgctggcaatcgaagaggccgatgtggtgctgtttatggtcgatgcgcgtgcgggcctgatgccggcggacatcgcgatcgctaaacacctgcgctctcgtgaaaagcccaccttcctggtggctaacaaaaccgacggcatcgacgtcgaccaggcgatggcggacttctggtcgctcggcctgggcgatatctatccgattgccgcttcgcacggccgcggcgtgaccagcctgctggagcaggccctgctgccatgggtcgatgaggttaatccgcaggaagaagtggatgaagacgccgaatactgggcgaaattcgaagccgagcagaatggcgaagcggaagaagagccggaagacgacttcaatccgcaggatctgccgatcaagctggcgattgtcgggcgtcctaatgtcggtaaatcaaccctcaccaatcgcatcctcggtgaagatcgcgtggtggtctacgatatgccgggcaccacccgtgacagcatttatatcccgatgcagcgtgacgagcgcgaatacgtgctcatcgataccgctggggtgcgcaagcgcgggaaaatcaccgacgtagtggaaaagttctcggtgatcaaaacgctgcaggcgattgaagacgccaacgtcgtgctgctggtgatcgatgctcgcgaagggatctccgaccaggacctctcgctgctgggctttattcttaacagtggccgttcgctggtgatcgtcgttaacaagtgggatggcctgagtcaggaagtgaaggagcaggtgaaggagaccctcgactatcgtctgggctttatcgactttgcccgggtgcacttcatctccgccctgcacggcagcggcgtcggcaacctgtttgaatcggtacgcgaagcctacgacagcgctacgcgccgcgttagcaccgcgatgctgacccggatcatgaacatggcggcggaagatcatcagccaccgctggtgcgtggccgtcgcgtgaagctgaaatacgcccacgccgggggctacaacccgcctatcgtggtgatccacggtaaccaggtcaaggatctgccggattcctacaagcgctacctgatgaactacttccgtaaatccctggacgtgatgggcacgccaatccggatccagttcaaggaaggggaaaacccgttcgctaacaagcgtaacaccctgacgccgaaccagatgcgtaaacgtaagcgcttgatcaagcacatcaagaaaagcaaataatcattaaacccgcttcggcgggttttttgtggccgccatgccggtaaatgtcaaaaccttccgccataatcccgcgatacttcgccgggaacagagcggctcaaaggtggacttactatgcagattggttttatcggcctcggcgcggtggtggaaaccgcctatttaccggcgctgcgtcgcctgggggacgtcatcgaccgctgccagggctatgacctggactgcagcagagcgctgccggggatccagcgctgtagttcgctgtcggcgctgctggccgaacccctggatacgctcttcattaccacctcatcacttcagcatctgcccgtactggagagggcgttagccagcggcatttcccgcatcgtggtggaaaagccgatcgtggccaaccttgagcaggccgcccggctgcgggcgctgctggcgccgactgagcaggccgcgcgggtgctggctcttgaccactggatggcgcgaggcgttgcgctgaacgctcctggcccgctgtggcgggcggaaggggaggccagcggcctgcctccgccgcacctgtcagcgcaggatatcgtctggatcgaaggttatttgcaggagccaagcggctttaacagcgctggtgagccggtcgcactcaattttgccaccggggagctggatacccggcagctgcgtcaccctgatggggtgatcctcgatatcggcacccatgtcctggcgatgctccgcgaaaccctgcacgccagcggaggcgatacggcgctgagcctttcccttcgggtggcgaaagaccgcctcggccatgacattgctcctggggatacgagcactgccgagggggaggcgcatctgcagggaaccctgggcactatcccgctcaatatctggctcaacaaatacgcgggtcccgcgggcgggcaaaagggaatgcggataggactgcgggacgggcgaataattaccttcgatcgcgcccctgagggcgaagtggtgacgctacaggacggcgagcgggtgcagcgctggacccggcccggggcgatctatacgcactgtcttgatgagcagatcctcggcgctgataatctgtttatccgggcgccggacagcgtggccgggctaacgcagcgtaggcttgaggaagtggaatggctgctcaggttgcagcagcaattacgcggcccgcattaaacccggaacatgataaaataggtgcagataaacgttgaaaggaatggttatggaacttgattgccctctgtgccacgcgccgttagatgtcaaaggcagtagcgcgcattgcgcccagtgcgaaagggtgtttacccttgaggcccgctgcccggaatgccaccagccgctggaggtgctgaaggcgtgcggcgcggtggattacttttgccagcatgggcatggccttatctcgaaaaaacgggtggaatttattccgctggtttagtgggcgaaggctttctggcccgcgtttttttcaccgtcgcgatctgcttcacttcgctttcgacccagccgtctttcaggcgggtggtgagcagatcgccggttttgacctgttttgtctgcttcagcaccgtaccgtcgctcaccgaggtgacgctgtagccccgcgccagggtggctaaggggctcaccgcctccagatgggtcaccgcgttgccaaaccgttcacgccgctcgctgaggcggccacgcataatttccgccagccggtattccagctgctggatccgcgactgcgcgcggtggatccgcggctgcgggttgtagtgattcagacgctgaacggtgcgcttttgccgctgttctgcgcgcttaagctgtgactccacggcgatacgcatccgctggcgcaggcgttccagggcggtctgctggcgggccaagcgcagctgtggatgctgttgctgcaggcgatggaacagctgggtaaaacggcgctggcgactggcgaggaaatagtccatcgccatttccagccgctgctgtccggactgcagctggcgcagcagctcctgctggttgcggctgacgatttccgcggcggctgagggagtcggtgcccgcaggtcggcaacaaaatcagcgatcgtgacgtcggtttcatggccgacggcgctgacgatagggatctggctggcgaaaatagcccgcgccacccgctcatcgttaaaactccacagatcctccagcgaaccgccgccgcgtccgacaatcagtacgtcacactcctggcgcgcgttggccagcgcgatggcgcgcacaatctgcccgggggcgtcgtcaccctggaccgcggttgggtagatgatcaccggcagcccgggatcgcggcgcctgaggacatggagaatatcgtgcagcgcggcaccggttttcgaggtgatgacgccgacgcagtgggcgggagaggggagcgcctgcttatgtttttgctcgaacagtccttccgccgttaactgcgctttcagctgctcatacttctgctgcagcaacccttcgccggcgggctgcatgctttcgacgataatctggtagtcgccgcgcggctcatacagcgtgatgttggcgcgaaccagcacctgctgcccgtgctgcgggcggaacgtgacccggcggttgctgttgcggaacatcgcgcagcgcacctgggcgttatcgtcttttaaggtgaagtaccagtggccggaggagggctggctgaagttagagatctcgccgttgatccaaacctggcccatttcgcgctcaagcagcagacgcaccgtctgattgaggcggcttacggtaaaaattgcgggggattgagagggtaacatgtgagcaagatcaaactttaaatcagcaggttattcagtcgatagtaacgcgctcagaggggatggcaagtattatttgcaaaaaagggtagatgcaatcggttacgctctgtataatgccacggcaatatttatccaccctggtcgagatattgcccatgctacgtatcgctaaagaagccctgacgtttgacgacgtcctcctcgttcccgctcattctaccgttctgccgaatactgccgatctcagcactcagctgacgaaaaccattcgtctgaatattcctatgctctccgcagccatggataccgtaacggaagcgcgtctggctattgccctggcacaggaaggcggcatcggctttattcacaaaaacatgtccatcgagcgccaggcggaagaagttcgtcgcgtgaagaaacatgagtccggcgtggtcaccgacccgcagactgttctgccgacgaccactctgcgtgaagtgaaagagctgaccgagcgcaacggtttcgccggctacccggtggttaccgaagaaaacgagctggttggcatcatcaccggccgcgacgtgcgtttcgtcaccgatctgaaccagccggtcagcgtctacatgacgccgaaagagcgtctggtcaccgttcgtgaaggcgaaagccgtgaagtggtcttcgctaagatgcacgaaaaacgcgttgagaaagcgctggtcgtggatgaaagcttccacctgcgcggcatgatcaccgtcaaagacttccagaaagcagaacgtaaaccgaacgcctgtaaagatgagcagggccgtctgcgcgtaggcgcggcggtcggcgctggtgccggcaacgaagagcgcgtagatgcgttggtagcggcaggcgttgacgttctgctgatcgactcctcgcacggtcactcagaaggcgttctgcagcgtatccgtgaaacgcgcgcgaaatatcctgacctgcagatcatcggcggcaacgttgccactggcgcaggcgcacgcgcgctggcggaagccggctgcagcgcggtgaaagtgggcatcggcccgggctccatctgtactacccgtatcgtcaccggcgtgggtgtgccgcagatcaccgctgtttccgacgcggtggaagcgctggaagggaccggtattccggttatcgctgacggcggtatccgtttctccggcgatatcgccaaagcgatcgccgccggtgcggcggcggtgatggttggctccatgctggcgggtaccgaagagtccccgggtgaaatcgaactctatcagggtcgctcttacaaatcctaccgcgggatgggctcccttggcgcgatgtccaaaggctcctctgatcgctatttccagagcgataacgctgctgacaaactggtgccggaaggtatcgaaggccgcgtggcctataaaggccgcctgaaagagatcattcaccagcagatgggcggtctgcgttcctgtatgggtctgaccggctgtggtaccattgacctgctgcgtaccaaagctgaattcgtacgcatcagcggtgcgggcattcaggaaagccacgttcacgacgtgaccatcaccaaagagtccccgaactaccgtctgggctcctgatttcttcgcccgaccttgcgtcgggcgatttatttactctgtttcacttgcctcggaattagcgtcaatgacggaaaacattcataaacatcgcattctcatcctcgacttcgggtctcagtatactcagctggtggcgcgtcgcgtgcgtgagctgggcgtctactgtgagctgtgggcatgggatgtcacggaagcacagatccgcgaatttaatccaagcggcatcattctttccggcggcccggaaagcaccaccgaagagaacagcccgcgcgcgccgcagtatgtgttcgaagccggcgtgccggtatttggcgtctgctacggcatgcagaccatggcgatgcagctgggcggccatgtagaaggttctaacgagcgtgagtttggttacgcacaggttgaagtggttaacgacagcgcgctggtgcgcggtatcgaagattccctgaccgcagacggcaaaccactgctggacgtgtggatgagccacggcgacaaagtgaccgccatcccagcggacttcgtgaccgtcgccagcaccgacaactgcccgttcgccattatggccaacgaagaaaaacgcttctacggtgtgcagttccacccggaagtaacccacacccgtcaggggatgcgtatgctggagcgcttcgtgcgcgacatctgccagtgcgaagcgctgtggaccccggcgaaaatcattgacgacgccgttgagcgtatccgtcagcaggttggcgacgacaaagtgatcctcggcctctccggcggtgtggactcttcggtgaccgcgatgctgctgcaccgcgctatcggcaaaaacctgacctgcgtattcgtggacaacggtctgctgcgcctgaacgaagcgcagcaggtgatggagatgttcggcgaccactttggcctgaacattgttcacgttgaaggcgagcagcgtttcctcgacgcgctggcgggtgaaagcgatccggaagcgaagcgtaaaattatcggtcgcgttttcgtggaagtgttcgacgaagaagcgctgaagctggacgacgtcaaatggctggcgcagggtactatctaccctgacgttatcgagtctgccgcttccgccaccggtaaagcgcacgtcatcaaatctcaccacaacgtgggcggcctgccgaaagagatgaagatgggcctggttgagccgctgcgtgagctgtttaaagacgaagtgcgtaagatcggcctggaacttggcctgccgtacgacatgctctaccgtcacccgttcccgggccccggccttggcgtgcgcgtgctgggcgaagtgaagaaagagtactgcgacctgctgcgtcgtgcggacgctatcttcatcgaagagctgcacaaagctgatctgtataacaaagtcagccaggcgttcactgtgttcctgccggttcgttccgtcggcgtgatgggcgatggccgtaaatacgactgggtggtttccctgcgtgcggtggaaaccatcgacttcatgaccgcgcactgggcacacctgccgtacgatttcctcggccgcgtctccaaccgtatcatcaatgaagtgaacggtatctcccgcgtggtgtatgacatcagcggcaagccgccagcaacgattgagtgggagtaatccccggcgttagctgagtaaaacgaaaccctctgtgtttacagagggtttttttatagctgctacattaaggtctcccacctgacggcaagcgctaatcgcgcatatattgatgcatctgggccgccgtcagatcccactggcttccttcaaacgggggcatatagctgccatcatcttcgccaatctcagcggcagtgagctgattgagtttatcgttcattgtcattaacagatcccggtatttctctggctcccgggcgaggttatgattttcttcggggtcgttaaccagatcgaaaagttcaacatcattattctccagcagctcggccagggaagcaggaatatgatgctgcttgagcgaaaagtagcgggcaaatttatagtgtccatcgttgatcatacggatccctgagcgatgggaaaaatcaggatggagtgacgcgatcgcttttttaaattgatcgtgcgggagtttttctccagccagctttctgaattttgccgtgtattgcgcatccatatacaggatcatgccgtaacaataaagcgaacccggacgcagcgcatttaagcccgcttgctcaggatgcgccagtaatgggctcatatcccggcctttcctgccctccaggactttctctcgcagcgaccgatcgcgtccagtcagaccaatcagggtcggtactaaatccagatgattagtcaaactgttgcagcggatgtttcccggatacgccggatggcgaatgatcatcggcacatggatctgctctttgtacaccgaggaacctttaccatgcatctggtgggagcctccgagttccccatggtcggcggtaaagacgataatcgtattttgcgtcagttgaagattatcaagttcattgagaatcgcctcaagatgctggtcattatcgcgaatacagttgaaataataatccagtaatttgcgccagcgccggtcttcatcggggaactgtccctccatcaccgccctggcattctggtactctttatgggcggcaggtctgccaggctcatcgagcggctgatggcggtttgcaggcagcggatagtctggccagctttgctgatagatttggttgtgcggggggtgggttggcagcagggtgtggttttctttatccattggccctttccactgcacctgctcaccatgctcatcggtgtcgataaacatgacatcgtgggggttaaccaggtttactgccgcgaaccagggtttattttcatcattcagcgggcggccggtgttacgtagccaactaatggtctgccccgtggtgactgaatcaaagaaatagccgcccttacttttcccgatgacatcgccaatgccgtgataatcagagaaaccatacttttccataatttcatgcagtcgcggcgtcgggatctcacccaggtccatttcttctaccgatttaccagcgaccggctgatcgatctcccgggtaagatgccatttacctttatacgccgtgtaataacccagttcacgcatcatatggcccacggtacgtaattccgggtccagatcgtaattcatccaggggaagccaagattatcaaacatccgggtgtgcggcatatggagcccggtgtacatgacagagcgcgatggcgtacaaacgttggccgtgttctgatgattggtaaaagtgatacccgttttcatcaggcgttcccggcccggcaccggaaagggataccgctcgaaataacgttcctgatcgcaggttatgagtaaaatattgtagccttcgggcagtgtgtcagggatttcgccggtgaaaggaatatcccatgccgctttcgcggcggcattattttgtgcggcgtttcccgtctctggtaacaggctcacgacagcggcaatccccagacctttgaggagatcgcggcgatttccatctattttatttggttctttcatcttcagactccgttaattgtaatatattttgccgaatctccgggataagactcataatgagcgcgggcggctggcaatttaataaaagccttcgcatgacgttcatatagggcgtgatatggccgaaaaaagttaaatagccgctgcacaggtaattctgtgcttcgtcgtcatggatggtaaaacggtgtttagggcatcccccatggcaggcaaagcgccagtggcagctctgacagcgggcagagagttggcccttttgcttcccgaactgttgctgaaatggcgagctcgccatcgctgccatagcatcttgcttcagattacccagtttatattccgctgagacaaagtgatcgcagctgtagacatcgccgttttgctccaccagtaaactctgcccacagacaggctgcatggtgcagagcgtggcgggctggccggcccatacgccgagcagattatcaaagtactggataaacaccctgccaacatcgttttccagccagtcgtcgaaaacactgcacaaaaatttgccccagccctcaggggtaactgaccagggagcaggggagtcaacgagaggaataaactggagatggtgaaggtttagctcgcggctcaggcagcgatagagacttttcccctggcttgcagactggcgactgaccaccaccatggcattcaccggaacgtcatgctgctgcaggcagcgtatggcctgcacaactttttcccaggtgggttttccgcagcccgtcgtacgccaggtgtcgtggagtgacgcagggccatcaatggataatccgaccagaaatccatgacgacgcaaaaaacgagcccatttatcgttcagcaagatgccgttggtttgcaggctgttggcgatgattttgttaccacggtaacgctgctggagctcgaccacctttgcaaaaaaatccagcccgcataaggtaggctcaccgccctgccagcaaaactcgacgttttgcgagggggtcgatgaaatggtgttgtgaatgtacgcttccagcgtgaggtcgtccatggtggcataccctggacgcggaacctcgttttccagataaaaacaataccgacaggccagattgcatcgattgccgccgggttttgctacggtattaaaattagcgctcattctttgctatgctcgaacgttttcgatgaggaagagagtaaagctaattgtgttaccggaggtgtggctaatgttaccgatggcgactggctttattttttggatcattatgcaagcgaaaaatacaggcggtatcgttatttttcgcaggtgacagcatgccctgctattctcttaaaaatttcatcattgatttggtgaatgtattttcattaaaaatttatagtatgaataatgcctgccatatggctataagcgcaggcgtaaattatcaagggcgtagtgatccacgtttactcttcagcaaggttgtttttggctatcggttggtcaacggccgctgccgggtattctacattacgttcatcctgcgccttacccgcctcgcgcaccatcgccagcgccagtccggcaacgatcaacgttaacccggtggacacccacattccgccgataatgcccagccggtggttcagccatgcgtaggcaaagggtgaaacagctgccatcagttgcccggggatcagcaggagacccgtgcggctggcgtagctttctgcgctaaacagcgccagcggcagcgtcgctttgacaatcgtcaccagcccgttaatcgcgccatagcccagcacaaacccggctgcgcatccggcataggtcgtgctgctcaatccaaggagaaaacagagcggcatgacgagcgcagtaaaacgcgttagcgtgagtgaggtgacccggggaccggccagcacttcccccagccgggcgccggtctggccgaatccccacagcataccgacggcaaccggcagaccaaagtggctgataaactccggcagatgggtagaggtaccgttagagatgaaggtgatcagcgcaataaagatcgcgtaacgcgccccgttacgccggtcgccctctgctgtcgctggcgaggctggtgatttcgccgctgaactgagccgctggcgaggcagttgataactcagccatgcgctcagcaggccaaacagcgcatagatccgcagagcattctgccagggcatgatggttaataacgcctcgcccagcggccagaagagggcagaggccagaccgccagcgagagtgatatgagagatagttttccgcgcctgctgaccgtacagattcaccactgcggcgaacagcgcatcatacagtgagagccgcatgccgatgccggtcagcagccaggcgccgtaccagccggccagcgaagggcgccaggccatcatggcgcagctggcggctatcagtaaggtaccgctggtgaccaccagccttccgccaaagcgagccagcaacctggcaacgaacggggagacagcggccatcatcagcatcgcaagcgtcaggccgagatagatctgcggcaaggaccatcctttgtcggcggcgatagccccggcaaaggtgccgggcatataaaaagagatcccccagttgatgagttgctgaccgcccgcggtgaaggcaaggcgtcggggaatagcgtttatttccatggtttttcattccgttaagacagttgtcctgagcctacccggcaggctattgttctggcagagcggctaccttatgcgcggtataagagaaacttttatgacaacactgaacctgggaaatctggcgaccttccggctggtcgtacagcgcggcagcttttctgccgccgccgacgcgctggggatctcccaacctgccgtcagcctgcaggtacgtcagctggagcagtttttacagaccaggctgctggagcgaaccggacgtgggatcaaggcgacggcggcgggaatggcattgctggcccacagcgagcagatcgatcgggcggtgaatagcgcggtgcagtcggtcagcgcattcagtcaggaggttaatggatcgttgacgctggggactggcgcgacggcctgcattcatcttcttccaccgctgctgcagcatcttcgtcagcagcacccgctgctgacggtgggggtgaccaccggcaacacgctggatatcgtccgcgcggtggaagaaaaccggctcgatctcgggctggtcacgctgcccgtgcaggggcgcagtctggcggtgactgcgatgttagatgaggagttcgtgaccatctatgccagccgcgagacggagatgccggcggtttatactcccgccgagctgcaggcgcagccgctcattgccttcgaggcgggtagcggcacgcgggatctgattgaccgctggttccgctcggcgggactggcggtgacgccggtaatgcagttggggagcatcgaggcgattaagcgcatggtgcgggcagggctgggctacagcatcgtgccccgcatggcggtggagcgggtggaggatcgcgacggattacgcgtacactcgctggcgccgcggctataccgacagctggcggtagtcatgcgtcaggacaaaattgtgacaaaaggtatcgctgaaatgctgcgcctgctgcataccgtgcgcttataaatcgccgacggcaaaattaccgcatcaaagacagtacttcagcagcgagcggctctgcctgcggagtgtggcgcttgcagtattagaatcaaaagattactcgcggggggagggttcgacggtgagcgatgactcctgcgacgcttttttatcctgatgatggtaccaggcgccgatggaggagtagacaaagcgtccaaagaagaagagaaagctgataagcagtacgatacgggtcatgcgacggttaaatcgatgtcgtttacgcatactgggtgcctgactcacaaaaggatccttgaagtatacccgaagatgggcgatgggggtattaaggcacaggaacgagatggggtcaattgatgcagatgtaaaagtgcggcagtgaaaacattaattaatgttatataagataatcgtcgtatttacatgctcactttattagccgtgaaatgtcgggaaaaataagatttattaatgttggtgtcagcatttgttgatttatatcaatagtctccttctcttggccactaaaatcagcggacgttaccgtgtcgttattatttacgcggtcagcatgggtggttggatgcctgcctgaatatgcctcgcgggagcagaggcactctgtagagcacctatgaatttattaaaatactatcaacaatatcgcgacaagtggtgggctttaccgctcgttctgcctgcgctgttattaccggtcgccagatgggcgaatacctacaccatgctcaatggtcatatggtatttttgtattatcttcccctggcgctggtgctcagcctgatgatgttttttggttgggcggcgatccctggcattattattggcctgctgttaactctggcccacggcatgatgcttgagcaatccatcggtgtactgttccatttccttatcccctgcgtgctctgctggggcggctaccgcatttttgtcccccagcgtcagcaggtctcacacggcaacgtccgactgatgccgcatcgtctgttctggcaaatgctgctcccctcggtcatttttctgattttgtcacagattgccgaatatcttggactccatccgcgcacaacggaaatgaccggcgttacgccatttagtttacgttcattaatcacctttcaggcgctaatggtagggtgcctgaccggcatgccgctgtgttattttgtgttacgggtcattcgtaatccttttcatttacgcggctttatttctcaggttcgcttacaaattgatccaaaaataaaaaaaattgaaattatttgctgggcgacggtattaattctgctactgtggctattattgatgccgcttaatgatagcagcaccatatttagtacgaattatacgttgtcattgctgatgccggtgatgctctggggtgccatgcgttttggctatcgctttatctcactgatctggacgccggtgctgattgccgtgatccattttcattaccgttacttaccaatttacccaagctataacacccagttggcgatcacgtcatcaagctatctggtattctcgtttattgtcgcctatacggcgatgctggcgacacagcagcggctgatctacgctcgcgtccggcagatggccttcctcgacccggtggttcatatgccgaacttgcgggcgctgagccgggcgctcaacggcacgagctggtcgacgctctgttttctgcgcattcctgagcttgaactgctggggcgccactatggggtacttttgcgaatccagtataagcaaatgctggcgaaccacctgagaacgctgctgcagcccaacgaagcggtatatcatcttgccggtcacgatttagtgttccgtctcaatagcgaagggcaccaggcgcgcattcacttaattgaccgctccctgcgacagttccgtttccactgggacggggtccccctgcagccgcggatcggcatgagctattgcagcgttcgctcgccggtcaagcatctgtatttactgcttggcgagttgaacaccattgccgacatgtcgttagccagcggccatccggaaaatttacagcgccgcggcgcgggccatgttcagcaggatctgaaagataaagtcgtgatgatgaaccgcattctcaaagcgctggaacatgaccattttgtcctgatggcgcagcctatccagggcattcgcggcgatcgctatcatgaagtgctggtgaggatggaaggggagtcgggtgagctaacggggccaaacgagttcttgccggtggcgcacgagtttgggctgtccacgcgggtggaccagtgggttattgagcatacgctggcctttatggacgccaaccggcgggcgctgcccggtctgcggctggcgatcaatctttctccggtgtcgctgagccgcagccagtttcctcaggaggtcgaagcgctgctgcaggcctacaacattgagccatggcagattattttcgagctgaccgagaactacgcgctcagcaatcccgagctggtctgccagactttagaacatctgcgggcgctgggctgccgggtggcgatcgatgattttggtaccggctacgccagctacgcccggttaaaaacaatgaacgtcgacattcttaaaatcgacggcagttttattcgcaatctgcttgccagcagtcttgattaccaggtcgtggactctatttgtcgtctggcacgtatgaagaacatgcaggtggtggccgaatatgtggagtcgccggaaatacgtcaggcggtcatcacgctggggatcgattatatgcagggctatgatatcggggtaccggtacctctgacgcagttggcggaggagatgaccggctgagcagcaaaaagccgggcgtaagcgcccggctcggttgatagccagagatacgatcaggcgtctggctcttcttcagcaatcttcagcatccactccggcacgccttcccagtactgttgctctttttccagatccagcagcaccagcgcattctggctaaaccagttgtgcggaaacgtcagcgtccagtggtgagcttccgtctgcaggcgcagcgtcggcggcgtagtggtagcctgacgctggttattcagcagtacgcccaggcgcagtagctgaattagcggcagaaactgctttttcctgaatagcgtaaagcgcggcagatcgtcgagcttgatcgctttgcgatgatagcgtacgagggtggccatcagcatctgctgctcctgattgaagcccggcaggtcgctattttggagaatgtaggccgagtgacgatgcatgccgctgtggttgatattcagccctacctcatggagcatcaccgcccatttcaacagcgccgcgaggtgcggattggccagcttgggattctgctcctgccactgctccagcatctgggtggtagtttccagtacccggcgcgcctgttcgcgatcgatgttgtactgatttgccagactctgtgccgtgcggctacgaatatcctggtggcggaagcggccttccatctcgtacaggacaccttcgcgcagcgcgccatcggacagacgaagttctttgatggccagcgcgtcaaacacaccgcagaggatcgccagcccaggcgcaaagaccgctttacggtcttctgagagaccgggcagactgagcgcgtcgaagtttttatgcttcaacagctcatttaccagcatctcgaggcgctccggcgtaataaatccgtccttctcgcccatcgccaccagcacttcctgggcggctttaatggtgccggaggcgcccagcgccacggtccatccctgaatacggaactgccaggccagcgtctccagcttctgcaccgccgccaggcgcgcgcgctggaagttttctttattgataacgccgccagggaaataggcctgcgagaagctcacgcagcccatgcggcggctttccaccaggcggggctcaaaatcttcgccaatgaccagctcggttgagccgccgccgatatcaatcaccagcttgcggccgcgctccggctgcgtgtgctcaacgcccataaaaatcaggcgtgcttcttcattaccggagatgatctcgattgggtaggggatcactttttccgcgcgtttaagaaactccgccgcgttggtcgcctgacgcagcgtatgcgtcccgacgatacagacgctggagggggagaacccctgcaggcgttcggcaaacagcgacaggcagttcagcccacgggtcatggcttcttcgctcaacaccgagttttcatcgaggccatcggccagatgtacgcgctgtttcaggcgtccgatgatctgcatggcgccgtcgacgacacgggcgatcaccatatgaaaactgttcgaaccaaggtcaaccgcagcgaactcctgcggccgaggggtgttatcgtttattggcataggttagtcgggttgttcgagtgatttgagataatcgtaaatcgccatttgcgcgcgcactttacggcgattgccgcgcggcacatagcggttactcagttctttatcaagatagcgcgcttttaccgtatcgttgaacaggatatcaaaaatatccagcacccgctgcttcagacgcggatcgagcagcggagcggcaacttcgatgcgataatcgatgttacgcgtcatccagtcggcagaggagagccagacctgtttatcgccaccgttttcaaaacagtagacccggtcgtgctcgaggaaacggtccacaatactgatgacgcggatattttcgctgataccttccagacccgggatcagcgagcacatgccgcggatcagcagattaaccggcacgccggagctggaggcggcatacagtcggtccaccagacctttatccaccagattgttcagcttcagcgtaatcccggacggttgcccgttttgcgcattggcgatctcgcgatcgatcatctcatacagcagacgacgcgagttctgcggcgacaccaacaggtagtcgaagctaaccggacgataggggttctcgataaagttaaacacccggcggacttcattggtaatgcgcgcatcggcggttaacagcgaatagtcggtgtagatccgcgccgtcttctcgttaaagttaccggtgccgatgtgggcgtagcgcaccacctcatcgccttctttacgcgagataaggaacagcttggcgtggatcttcagacctggcgcagagaagataacgtggactcccgcttccgtcaggcgtttcgcccagtgaatgttagcctcttcatcgaagcgcgcctgcagctccaccactacggtgactttcttaccgttgtgggcggcgtggatcatcgcgtcaataatgcgcgaatccttggccacgcggtaaatgttgattttgatcgccaatacgctggggtcgaaggaggcctgacgcagcagctccagcacgtgctcaaaggtgtgatagggatagtagagcagcacgtcgcgttcgcgaatggcgtcgaagccgttgcggaatttatcaaaccacagatgacgcaggcgcggcatgggtttattgaccagattggccttaccgacgttcgggaagccgataaagtctttaaagttgtgatagcggccgcccggcagcattgagtcatagttggaaatggagagcttatcgcgcagcatttcgaccatcgcatccggcatatcgcgctggtagacgaagcgaaccggctcggcggtcaggcgctgcttgaggctggaggacatcagctccatcaggctcgactccatctcatgcaccagatcgtactcggcgtcacgggtcatcttcatcgagtaggcgttcagcgcatcgtaatcaaagaagcctttaaaaatatcgtccaggcaatagcgcaggatgttatccaggaggatcattggcttgcggcgacgcggcgcttccggcggcaggttcacgaagcgcggcactttatccgacggtatttccagcagagcatagttgatgttttccccgcggataatctccaccgccagataggtgtaatcatctttcaggaactgcacgaggtccgtttcgcggttgatcaggatcggcgagatatgctggcgtaaatactgcttgaagtagttgcgcagccaggcctgctgattgacggacagctggcgctcgttgatcaggaagatctggttacgcgccatctccagcaacagttcattatacagactatcgaattcctgatcggccttcagaacgcgggcctgaattttgcctaacaggtggcgagaatgggcggtactgccttgttcttcactgataataatccggcgcttcagctcagcgaagcgcactttgtaaaactcatccaggttgttggagtaaatccctaagaagcgcatgcgctcaatcagcgggttactcttgtccgccgcttcctgcagcacgcgttcgttaaaagacaaccagctgagttctttttcgatgtatagcttttcctggcccattaccgctcacactccgttttactcacaggacgtagactattatgacgaatttttctgcgtagcgatttactgtgtcacaacaatatgacagtaagaagaattatttctgtgagatgtttgattagtaaacacttttaattaaaaaaaagccccgcgatgtgctcatgcggggctggttgttcattcgtcggcggcatagccctgcgggggaagctgtcgctcatccagccaggcgtggttgcctgccatgcgcagacgtccatcgacgaaccagctgatgaccagcggataaatggcatgttcctgggcctgaacccgcgccgtgatttcctcctcgctgtcgccagtgaagaccggcaccttggcctgcaggataaccggcccaccgtccagctcatcggtgacgaagtgcaccgaggtaccgtgctcctcgtcaccgttctccagcacctgacgatgagtatgcaggccaggatacttcggcagtagcgagggatggatgttcagcagacgtccctgatagtggctgacgaacgccgggctaaggatacgcatatagcctgccagcaccaccagatccggggcgtaggcgtcgatttcatgcatcagctgacgatcgaacgcttcccggtcggcaaactgactttgcgccagcgcatgggccgggatgccggccaggcgcgcgcgctcaaggccgaacgcatcagccttgttactgaataccgcacgcagggtgccgtttatctgtttccggccgcaggcgtcgatgatcgcctgcaaattgctgccgctaccggaaatcagcaccacgatgtttttcatgcaatgaccacacgctgttcggaatcggaggctttgatatacccgattttccacgcgttttcacctttgtcattcagcagggcaatcgctttgtccgcttccgctgccggcagggcgataatcatccctacgccgcagttaaaggtacggtacatttcatgctggctgacgttaccggcggtttgcagccagttgaagacggatggccactgccaggaggactcatcgatgatcgcctgggtgttatccggcagcacgcgcggaatgttttcccagaagccgccgccggtcaggtgagcaatagcgtggacgtcaacgctggcgatcagatcaagcaccgatttcacatagatgcgggttggcgccagcagatggtcggccagcggtttaccgtcaaggtcggtagtttgtgggtcaacgccgctaacctcaatgatcttacgcaccagcgaatagccgttagagtgcgggccgctggacgccagcgccaccagcacgtcgccatcggtcactttgctgccgtcgatgatttctgatttttccactaccccgacgcagaaacccgccacgtcgtaatcttcgccgtggtacatcccgggcatctctgcggtttcaccaccgaccagcgcgcaaccggactgcaggcagccttcggcgatgccgttgatgacgctggctgcggtatcgacgtccagtttaccggtggcgtaataatccaggaaaaacagcggctcagcgccctgaaccaccaggtcgttcacgcacatggcgaccaggtcgataccgatggtgtcgtgacgcttcagatccattgccagacgcagcttggtaccgacgccgtcggtgccggagaccagtaccggctcgcggtatttctgcggcagtgcgcacagcgcgccgaatccgcccagtccccccatcacttccgggcgacgggttttcttcaccacgcccttaatacggtcgacgagagcgttgcctgcatcaatatccacgccggcatctttatagctgagagaggttttatcggtcactgcgaagtctccacgcgtttgcggtaagcaagaaaaatcggcgcaattctaacagggaaagcaaacgtttgcgagcctgctttacagttggcgtaaaaccgctgatgaatggttaaatttgatactgctcacgaaaatgaaaccgggtacagtctggtgcttgcctctacgtaaaggaatcctcattatacgactgaaaccggtttccgtgttggtttgccacgcattttgtcggtgattgacgcgggtcaggagagggatgaatgaagattgcggcatttgatatcggtggcaccgcgttaaagatgggcgtgatggcccgcgacggcaggctgctggaaaccgccaggcagtcaatcaatgacagcgatggcgatcggatcttacaggcaatgctgtcgtggctggcggcccatccgtcgtgtgaaggaatagccatcagcgcgccgggctatatcgatccgcacagcggttttatcaccatgggcggcgctatccgtcgatttgataacttcgccatgaaatcgtggctcgagacgcgaaccgggctgccggtctcggtggaaaacgacgccaactgtgtgctgctggccgagcgctggcagggcaaagcggcggagatggccaattttctggtgctcactatcggtactggcatcggtggggcgattttctgccaacaccagctgatcaacggggcgcgttttcgtgccggcgaattcggctacatgcttaccgaccgtcccggcggacgcgatcctcgtcgctattcaatgaatgagaactgcactctgcgggtgctgcgccatcgctatgcgcaacatattggcgcgccgctggatagcgtgacaggcgaactgattttcgaccgctatgacgccggcgacccggtttgtcagcgtctggtcgccgagttcttcaatggcctgggccatggcctttataacctcgtccatatcttcgatccgcagaccatttttatcggtggcggcgttgtggaacgcccaggatttctgacgctactgcgccagcatctggcctggttcggcattgccgactatctcgataccgtcagtcacggtaacgatgccggcctgattggcgcggtttaccattttaatcagctgtatcgttcgccagacgacgatcgacattagggagagactatgtccggatttaaagcaggttttctgtggggcggcgcggtcgcagcgcatcagttagagggcggctggcaggagggcggcaaggggatcagcgtggcggatgtgatgaccgccggcgcccacggcgtgccgcgggaaattaccgacggcgtggtggccgggaaaaactacccgaaccatgaggcgatcgatttttatcatcgttatccacaggacctggcgctgtttgccgagatgggcttcaaatgttttcgcacctcgattgcttggacgcgtattttcccgcagggcgatgagctggagcccaacgaggctggcctgcagttttatgatgatctgttcgacgaatgcctgaaacacggcattgagccagtcattacgctgtcgcattttgaaatgccttatcacctggtcaccgagtacggcggctggcgcaaccgcaagctaatcgactttttcgtgcgctttgccagggtcgtcttcacccgctatcaacataaagtgaagtactggatgacctttaacgagatcaacaaccaggccaacttccatgaggactttgcccccttcaccaactccggtttgaaatatttgccggatgaagaccgggaaccggtgatgtaccaggccgcgcactatgagctggtggccagcgccctggcggtgaaagcggcgcgcgagatcaacccggcgctgcagattggctgcatgatcgctatgtgccccatctatccgctgacctgcgccccggacgatatgatgatggcgatgaacgccatgcaccgccgttactggtttaccgacgtccacgtgcgcggtcgctatccgcagcatctgctcaactattttgcccgccgcggctttactctggatatcaccgaagccgatcgtcaggcgttaaccgagggctgtgtcgactacattggctttagctactatatgtcgttcgctaccaaagccaccgaagacaaccccttgcttgattatgatgaaaccaccagcctggtctccaacccgtacgtcaaaaagtcggactggggctggcagattgacccggtcggcctgcgctattcgctgaactggttctgggatcactaccagctgccgctgtttattgtcgaaaacggctttggcgcgattgatgtccgcgaagcggacggcagcgtcaatgaccagtatcgtatcgattatctctccgcccatatcgcggagatgaaaaaggcggtggtcgaggatggcgtcgatctgatgggctacaccccctggggctgtatcgatctggtttccgccggcacgggggaaatgaaaaaacgctacggctttatttatgtcgataaagataatgaaggcaatggcacgttggcacgcagccggaaaaagtcctttgcctggtatcagcaggtaattgccagcaacggggagaacctgtcgtagtcgggtggcgctaacgcttaaccgacctacaatacacgtaggcccgcgtaagcgtatggactgcaccccgcacccaagccggagcctcgcctccggtttttttgtctctaaatcactttgcttgatatacgtcaagcaagatgggtatggcacaatccgcaaaaagcggtataatcccgcgattttttttgtggctgcccctcagaggagaaagagaatgaagattgtggaagtcaaacacccactcgtcaaacacaagctgggcctgatgcgcgagcacgacatcagcaccaaacgcttccgtgaactcgcctcagaagtgggcagcttactgacttatgaagccaccgccgatctggagactgagaaagtcactattgaaggctggaacggtccggtggaagtcgagcagatcaagggcaagaaaattaccgttgtgcctatcctgcgcgctggcctcggcatgatggaaggggtgctggagcacgtgccaagcgcgcgtatcagcgtggtcggtatctatcgcaatgaagaaaccctcgagccggtgccttacttccagaaactggtgtctaacatcgatgaacgtatggcgctggtcgttgacccgatgctggccaccggtgggtcgatgatcgccactatcgatctgctgaaaaacgccggctgcaccagcatcaaggtgctggtgctggtggcggcgccggaagggattgccgcgctggagaaagcccacccggacgttgagctgtacaccgcctctgtcgataagggactgaacgagcacgggtatatcattcccggtctcggcgatgccggcgacaagatttttggaacgaaataaaatataccgcgaaaaaagccgactttgagagtcggcttttttttgaataaaagtaatccacagcaaataacagacgactctcagaggaatacactatgacgcgccgtgccatcggggtgagtgaaagaccgccgcttttacagacaatcccgcttagtttgcaacatctgttcgccatgtttggcgcaacggtactggtgcctattctgttccacattaacccggccaccgtcctgctgttcaacggcatcggtacgctgttgtacctctttatctgtaaaggcaaaattcccgcttatctgggatcaagcttcgcttttatctccccggtgctgctgctgttgccgctgggctacgaagtggcgctgggcggctttattatgtgcggcgtgctgttctgcctcgtctcctttattgtcaaaaaagccggtaccggctggctggatgtgatgttcccgccggcggcgatgggcgccatcgtggcggttatcggcctcgaactggcgggcgtggcggctaatatggccgggctgctgccggccgacggccagtcaccggacagtaaaaccattattatctcgatggtgaccctggcggtgacggtgttcggatccgtgctgttccgcggcttcctggcgattatcccgatcctgatcggcgtgctggtgggctatgcgctgtcgtttgtgatgggcgtggtcgataccaccccgatcgccgaggcgcactggttcgcgctgccgactttctacactccgcgctttgagtggtttgctatcttcaccatactgcccgccgcgctggtggtgattgccgagcacgtggggcatctggtggtgaccgccaatatcgttaagcgcgatctgatccgcgacccgggcctgcatcgttcgatgtttgccaacggcctgtcgacgatcgtttccggcttcttcggttcgacgcccaacactacctacggtgaaaatatcggcgtgatggcgattacccgggtctacagcacctgggtaatcggcggcgcggcgatcattgcgattctgctctcctgcgtcggcaaactggcggcggctatccagatcatcccggtgccggtgatgggcggcgtttccctgctgctgtacggggtgatcggcgcctcggggatccgcgtactgattgaatcgaaggtggattacagtaaagcgcagaatctgatcctcacctccgtgatcctgatcatcggcgttagcggcgctaaagtgcacattggcgccgccgagctgaaagggatggcgctggcgactatcgtgggcatcgccctcagcctgattttcaagcttatcagcgtcctgcgtccggaagaggtggtcctcgacgcggcggatagcgaagagtttaaataacgatcgcctgaccgggcggcgatcccgcccggttctctcctgacctaaatctgtggtaaactcttcgcgtttttctgtaagcctatgttgaggtccatctgaacgcaccggcacagctctctttgccactgtatcttcctgacgacgaaaccttcgcgagtttctggccgggtgataatccttccctacttgccgccctccagaacgtactgcgccaggaacacagcgggtacatttatatctggtcacgtgaaggggcaggtcgtagccacctgttacacgccgcctgcgcggagctttcccagcgcggggatgcggtaggctacgtgccgctggataaacggacgtggtttgtgcccgaggtgctggaggggatggaacagctggcgctggtgtgcatcgataacatcgagtgcgtcgccggcgatgagccctgggagatggccatctttaatctctataaccggatcctggaatcaggcaaaacccggctgctgatcaccggcgatcggccgccgcggcagctgaatcttggcctgccggatctggcctcacggctggactgggggcagatctataagctgcagccgctgtcggatgaagacaaactgcaggcgctgcagctgcgcgccagactgcgcggcttcgagatgccggaagatgtgtgccgcttcctgctgaagcggctggatcgcgagatgcgttcgctgtttatgaccctcgatcagctggatcatgcctcgattaccgctcagcgcaaactgacgatccccttcgtgaaagagatccttaagctttagtccgccaggggagtcagctcctgctccgtcagcccggtcaaccgggcgaccaggtcgcgcggaaggccgctgtgcagcatagcgacagcgatgcgctgcgcctcttctttccgtccttcctgacggccttgcgccaggccccgctccagcccctgttgttccagatattccgcaatcgtcatcaacgtctccttatgctgcggcgtacgtaacgccagctcgcgaatgaatttaatcggctcgcgcgtgttgcctgactgtaccagatagtgcatcagggcttgtacctgcgattccgtcgccagtccagtcaataataattcgctcagcttgtcgaggagctgcgccagatcgcgttgtcgaatatgtttttgcagtaactccagcgttgccatgcgctggtgggtggcaatctcgtcatccggaatgacggttatgtccgccagcggaaacgccccgtgataaaggtggccggccagctccggagcgacgaattcatcgagccagcgcagagagaacggataggggctcaccagaccgtggtagaagagaacagggatcaccagcggcaggcgatcgtggccggcatcgagatggcgctgcatggcggcgatggcgtagcgcatcagacgaaaggccatatgccggtcgggcgtgctctggtgttcgataagcgcataaatataaccgtcgcccgccgtggttttcagggaatacaaaatgtcggcgtaaaagggacgcagatcgtcttcgacaaaatgcccggactcgagatgcagcgtacgcagatcgcacactttaagcagcgtctcgggcagatacagctgcaggaaatcacgggcggtatcgggatgggagaggtaggtcttaaacacggcgtcatggggcgtggaggtcggctttttcatgttcatccgtccagtggattgagcgatggatgaacagtagcaccgtccggcgggcgggagatattggcgtgaaagatctggaatcgcccacgtaaaaaaaagcgccgcgcaagcgcggcgcgggtgagttagcttacgatctcaagaacctgttccggcgggcggccaatacgcgcctggccgcggctgacgacgatagggcgctcgatgagtttcggattgtcgaccatcgcctgtatcagcgccgcgttgctgagagccgggtcggccagattgagcgatttatacagatcctctttctggcgcatgagctcgcgggggctctccatacccagcagctgcagcagctggcgcagcgtcccggcatccggtggcgtctcaagataaagcaccacctcaggatcgatgccgcggctctgcagcaggctcagcgtttcgcggctcttggagcagcgtgggttatggtaaatttttaccgcgtcggtcatggggtctccttacattttttgatagggacggaagcgagcctgcagatcgcgtagctgatcgatacgggcatcgtaacgtgcctgctgcaggctaccgagtttcacctgcgagctggcgctgctgagcagggaaatcgcctgctccagctggccgaccagcgccatgctttcagcccgcgccgccagctcctgatcgcgattgcccagcgcgccttccgcctgggccagcaggtcccagccgttgccatcctctttataggtaaaggtataccggttcagaatggtcgccgcttccccgggctgcccgccctgcagcagggcgttggccaggttcaactgcagcaccggattagtacgtagctcgcgggcgtttttaaggcgattgatggcgtcgctggttttcttctgtccgaggtcgatatcggtggccagatcgagataccaggcattttgcgggtcggcgttgagcagcggctgcagcgttttgcgtgcctggtcaaagttattgctttccatcgccagcagagcgcgaccatactgggcggcatgctgttggcggatattgcctttatcccaggcgttcagcagatcggtgcccagcttgttgtcgccgttggtgtacatcccgagggtacgcgccttcgccagatagaagtccgccgaggactgtaccaccaccgggcgcatctggttggcgcggttacgggcatcggccagtcggctttccggcagggggtgggtgagcaacatttccggcggtcgcgtcgagtagcgcgactcgtcaagcagtttacccataaacatcggcatggcctgtgggtcgaaacccgagcgctgcagaacctgaatgccaatccggtcggcctcttcttcgttctggcgggtgaagctgatcataccctgctgggtgccggccagcgtcccggtcagggccgccattccggcctgcgggctggccatcgccagcagaatcgaacccagggcaccgacccaggtcagcggcgcattgcgcttctgatcttccatcgcgcgggcgagatgccgctgcgtcacgtgggagatttcgtgcgccatgacagaggccagttcgctctcgttatcagagtagcggaacagggcggagtggaggaccacattgccgccgaagaaggcgaaggcgttgatctggtcgttattaatcaaatagaagtggaacggggtacgcaccgagttggcgtgagccaccagacgcatacccagcccgttgatatattgcaccagcagagggtcgttgatcagcggcgcgctaccgcgcagttggcggacgtagtaatcccccatctgcatttcctgaccgattgacagagtgcttcctgcggaggttcccatgtccggcagggtatctgcggagtcagcaaaagcaggacctatcgaacccagcgtcagcgacgcgatcgcggtcgccaccagcgttttcttcaactgcctgaacataacctctgtcctgtaatgtgggtgtgccagtttgaccgattgtgcggcgtaatgttccctggccgcatcccagcgagtttagctggcgttggccgccttgaaaatatgttcttcatggcggagaacggtttgactgcggcgcatcaaaaagcgaagtcttttttgtgacatttcgatacaattccctggattgtcgccgcttggcccttcagggaaggttttatgcttgagatgttaatgcagtggtaccgccgtcgattcagcgaccctgaggcgatagcgctgctggttattttgcttgccggtttcggcattatgttctttttcagcggcctgctggccccgttgctggtggctatcgtgctggcctatctgctggagtggccgaccgttcgtctggagcgcatcggtctgtcgcgcacctgggccacctcgctggtgctgatcctctttgtgggcatcctgctgttgctggcctttgtggtgctgccggtagcctggcagcaggggatctacctcatccgcgatatgccgggcatgctaaataagctctctgatttcgccgccacgctgccgcggcgctatccggcgttaatggatgccggcattatcgatgcgatggcggaaaatatgcgcacccggatgctgacggtgggcgactcggtggttaagtactctctggcctcgctggtggggctactcaccctggcggtctatctggtgctggtgccgctgatggtcttcttcctgctgaaggataaagagcagatgctcaacgcggtgcgccgcgttctgccgcgcaatcgcgggcttgccgggcaggtgtggaaagagatgaaccagcagatcaccaactacattcgcggcaaggtgctggagatgattgtcgtcagcgtcgccacctggataggctttattctctttggcctcaactactcgttgctgctggcggtgctggtgggcttctcggtgctgatcccctatatcggcgcgtttgtggtgaccattccggtggtgggggtggcgctgtttcagtttggcgctggcaccgagttctggagcctgtttgcggtctatctgattattcaggggctggacggtaacctgctggttccggtgctgttctcggaagcggtcaatttacacccgctggtgattatcctgtcggtggtgatctttggcggactgtggggattctggggcgtcttcttcgccattccgctggccacgctgattaaagctgtggtgcatgcctggccggatggtttggcggtcgacgactaaggcaatgagaataaaaaaagacgccgggcgagggcttcctctcccggcgtcttgctttgcatcaggcgttttctttcagccagttcagcaccacgtcgtggtgattgctggttttgaaatcatcaaagacgtgttcgattttgccatcggcatcgatgaggaaactaatccggtggatcccgtcgtaggttttccccataaaggatttttcgccccagacgccaaactgctcgcaaacctgatggttttcatcagacagcagcgtaaagttcagcagctctttttcggcgaaacgggagagtttttccggtttatcggtgctgatgcccagcacttcaacgccggcttttttcaggtcgtccatattatcgcgcaagccgcacgcctgtacggtgcagcccggggtcatggctttcgggtaaaaataaaccaggacacgttgtccctggaagtcggttaaatttacttcctcgccgtcctggtccggtaagctaaatttcggtgcgatatcaccggctttcagtggggtcatgggttaaactccatcctgttcatcatgctgtgaataattaacgatgttaatactgccttgtgcgttcagttctgtacatagggctttgaacgcttgttcgatatttgctgcattttgcgtcgcaggactgtgggcagttatctggataaaaagctgcgcggaatcgccgtctcccggctgcgtgcgggacaccagctccgcaatattcatattccatgtatcgcacagggcagtaaagcgctcgatgatatgcggtgagtccggcacctcaacctggacccaaacggtgtttggcatggcctgcggcgggcgcgcagtggtgcgtttcatcacgatcaacagctccagctccgcgcctttcagcggcagagttgattcgatcaggttaatcgcattccacgacccggaaagcagcatgataaacgtaaactcatcaccgagcatggccagccggctgtcttcgatattacaaccgcagctgctgacgtggcgagtgatcgtattcacgatgccgggacggtcagcccccagggcggtaataaccagatagtgttgtaatgaggctgtcaaacctgttcttcctttaaaaaggtgaggtaacattaggaaagcataaaaaaaaccgccatacaacatccctgatggcgtcgggtctcttgcttttattacagctccaaacgtaacattgagaatcttgtcgcacttctgctctgaggatggcccatgttcacgggaagtattgtagcgcttgtcacgccgatggatgaaaacggtaatgtctgccggacaagcctgaaaaaactgattgattaccatgtcgccaacggaacctcggcgatcgtttcggtagggactaccggtgaatccgcaacgctgagccatgaagagcatggcgacgtggtgatgatgacgctggagctggccgacgggcgtattccggttatcgctggaacgggagccaatgcaaccgcagaggcgattagcctgaccaaacgttttaacgacagcggtgttgttggctgcctgacggtcactccttattataaccgtccgacccaggaaggcctgttccagcactttaaagctatcgccgaacatactgacctgccgcaaattctgtataatgtgccgtcccgtaccggttgcgatatgctgccggaaaccgttggccgtctggcggaaattaaaaatattgtcggtattaaggaagcaacagggaacttaagtcgcgttcaccagatcaaagagctggtttcagacgactttattctgctgagcggtgacgatgcgaccggtatggacttcatgcagctcggcggcgtaggcgtgatttctgttacggccaacgtggcggcgcgcgaaatggccgacatgtgccgtctggcgctggcgggtcaatttgccgaagctcgtgcgattaaccagcgtctgatgccactgcatacaaaattatttgtcgaacccaatcctatcccggtgaaatggggatgcaaggcgttgggtcttgtggcgaccgatacgctgcgcttgccgatgacgcctatcaccgatcatggtcgtgaagccgtcactgccgcgctgaagcatgccggtttgctgtaaagtttagggagatttgatggcttactcagtacagaagtcgcgcctggcgaaggttgcgggtgtttcgctggttctactcctcgcggcctgtagttctgactcgcgctataagcgtcaggtgagcggtgatgaggcctatttacaggcatcaccgttgagcgaacttcatgcgccggcggggatgatcctgccgattcaggtgggtgattacaatattccggtggctaacagcaccggcgcggtcggtaaagcgctggacattcgtccgccggcgcagccgctggcgctggtgagcggtgcgcggacccagtttaacggcgataccgcgacgctgatggtcgagaacggccgcagcggttcgctgtgggcacaggtcaccagtattcttcaggcgaagaactacgttatcgccaagcgcgatgatgcgagccagacgctgaacaccgactgggttgagtggaaccgtcttgatgaagatcagcagtatcgcggtcgttatcaaatctccgtcaaaccgcagggttatcagcaagcggtggtcgttaagctggtgaatctggagcaggcgggtaaaccggttgccgatccggcatctctgcagcgctacagcaccgctatgctgaacgtcatttcggaaggccttgacatgaatgccaccagcgcccagaacgccgcacagcgcagcgcgggggccaccttcgacgtgcagagcgccgccgacgataccggcctgccgatgctcgtagttcgcgcgccgtttaacctggtgtggcagcgtctgcctggcgccctcgagaaagtggggatgaaagtgaccgacagcacgcgctctcagggcagcatggcgctgacctataagccgctgtctgacagcagctggcaggagctgggcgcacgtgacccgcagctggtctccggcgactacaaactgcaggtcggcgacctcgataaccgcagtagcctgcagtttatcgacccgaaaggccacaccctgacgcagtcgcaaaatgacgccctggtagccgtattccaggccgcatttaacaagtaatcaaaagggctggagcaatccggccctttttcatgtatagtgacgcaaacgtgtgcgtggccatataatcctgtaaatcgccgcgttaaggctgctccagtcgcctgactgcagttcgccccgcaagcgtacagcatccgctccaacgcccgttgcaggatgttatgtaagaccgacacgtcattttttggctcaatatcactggagtagtgaaagatgaaaaagcaagctgagttgtatcgtggtaaggcgaagacagtatacagcaccgataatccggacctgctggtactggaattccgtaacgatacgtcagcaggtgatggcgcgcgcatcgagcagttcgatcgtaaaggcatggtgaacaacaaattcaaccatttcattatgagtaaactggcagaagcgggcatccctacccagatggaagcgctgctctccgataccgaatgtctggtgaaaaaactggatatggtgccggtagagtgcgtggtgcgtaaccgtgcggcaggctcgctggtaaaacgtttaggcattgaagaaggtatcgagctgaatccgccgctgttcgacctgttcctgaaaaacgatgctatgcacgatccgatggtcaacgactcctactgcgaaaccttcggctgggtgagtaaagagaatctggcgcggatgcgcgagctgacctacaaagccaacgacgtgctgaaaaaactgttcgatgacgccggtctgattctggtggactttaagctggagtttggtctgttcaaaggcgaagtggtgctgggcgacgagttttcgccggacggcagccgcctgtgggataaaaacaccctcgataaaatggacaaagaccgcttccgccagagccttggcggcctgatcgaagcctacgaagaagtggctcaccgcctgggcgttaagctcgactaacccgcccgccgccagaagatggcctcatcttctggcgtctcttgctgtttcctgtggtaatcctgcgctgaaccgcctacgatctctgctattgatacataacagggaatgaggtgcttatgcgctggcaagggcgtcgcgaaagcgacaatgttgaagatcgacgtggacaatcaggctcgccgtttggcggcggcgggggcggcggcttccgtctgccgagcgggaagggcggcattgtactgctgattattgtgctggtggcgggctactacggcgtggatttgaccggcatgttgaccggcgaaccgatgccgcagcagcagacctccacgcagcgctccatcagtccgaaagacgatgaagcggcgaagtttacttccgtcattctggctaccaccgaagatacctgggggccgatctttgaaaagatgggccgccagtacccgcagccaaagctggtgctctaccgcggcgcgacccgtaccggctgcggcaccggtcagtcggtgatgggccccttctattgtcctgccgacagtacggtctatatcgacctgtcattctacgatgagatgaaaaataaactgggcgccgacggcaactttgcccaggggtacgtcattgctcatgaagtgggtcatcacgtacaaaaactgctgggcattgagccgaaggtccgccagcaacagcagcatgccacgcaggccgaagccaaccgcctgtcggttaagatggagctgcaggcagactgcttcgccggcgtctggggtcataatatgcagcagcaggatattctggaaactggcgatctgcaggaggcgctgaacgccgccgaggccatcggcgacgatcgtctacagcagcagagccagggacgcgtggtgccggacagttttacccacggcacctcgaaacagcgctacacctggttcaaacgcggtttcgatagcggcgatccggcgcagtgcaataccttcggcagcgcgctgtaatcgtcccccatgatggacgcgctgcttaacctcaccgcgcaaatggcgcgggaggggatccgtcgcctgctggtgctcagcggcgatgagagctggacgctgcagcaggcgcaggcgctacgggagaggctcggcggcgatggcctgtgggttggccccgagccggtttctgcgccctgcgtggcgcccggcgcgctgaaaacgctgctggggcgggaagtgatgcacgcctttttcgatgcccggcgcgggtttgatgtggccgccatggcggccctgagcggcacgctgcgggcgggaagctggctggtgctgctgacgccccccttcgccgactggccgacccgggcggatgaggactctctgcgctggagcgatacgcctgaccctatcgttacccctaactttgttcaccgctgctgtcggcagtttatcgccgatccggaggtgttgctctggcggcagtcggaccggccacgtttcccgctggccgccccgcgtccagactggcatcccgccgatggccgcccgcaggccgagcaggcggcaatccttgagcaactgatacgcctgccgcccggtatcgcggcggtgacggcggagcgtggacgggggaagtctgcgctggcgggcatgctcctgcgccagcttgggggcgaggccatcgtcaccgccccaacgcgtagcgctgtcgaggtgctggccagctttgccggggagacgttgcgctttatggcgcccgatgcgctgctggcgtcgaaagaaaaggcggcgtggctgatagtcgatgaggccgcggctatcccggctccgcttctccggcagctggtgagccgttttccccgcacgctactcaccacgacggtgcaagggtacgagggcaccggtcgcgggttcctgctgaaattttgcgccagtctgccccatctgcaatccttcaccctgagcgccccgatccgctgggcggcgggctgtccgctggagtcagccatcagtcagttgcttatctttaacgatgaggcatttcgcgacgcgccgatgggggagatagccctggaggcggtcaatcagtcctgctggcaaacgcagccagcgctaccggaggcgatgtaccagctattgtccggggcgcattaccgaacttccccgctcgatctgcggcgcatgatggatgctccgggccaggctttccgctgcgctcgcaccggcggcgcggtggcgggcgccctgtggctggtggccgaggggggactttctcgcgaactgagccgggcggtatgggcgggttttcgccggccgcgcgggaatctggtcgcccagtcgctggcggcgcacggcggcagtcccctggcggcgacgctgcgcgggctgcgggtcagtcggatcgctgtccatcccacccgccagcgggaaggcctggggcggaagatgatcgccgatatcgccgccgatgccgctggctatgactatctctccgtcagcttcggctataccgctgagctgtggcgcttctggcaacgctgcgggtttaccctcgtacggctgggtacccatcgcgaggccagcagcggctgctatacggcgatggccctctatccgttgaccgcggcagggcgccagctggcgcagcgggaggcgcagcggctgcagcgcgatgaatactggcttcgcccgtggcgagaggaatccgcgccgctgccggccgtcgcagacgctatgcttagtgatgaggactggctggaagcggcgagctttgccttcgcccaccgcccgctggccgcggcgctgggctgcctcaaccgcctactgatgcaggccgacatgccgttgccggccctgcggggacgactgcagggcaaagaggaggccgcactctgcgccgtgctgcagctgacggggcgtaaagccttgcaggcgagatggcgtcgggaggccgctgacgccttgcgcttccttgatgcagcgcgcgctgatgcgctgcgtcagcaggtggcgcatctgcaatttttttaactaactcattcagttaaatggcatggtcatatctggcgagcggcgtacactgcccgcaaacactaaggagacagccatgaaacacgatcattttattgttcaaagtcctgcgacgcctgcgcaacagctgttgctgctgtttcatggcgtaggggataacccggtctccatggggcaaatcggcagctggttcgcgccgcagtttcccgatgcgctgatcgtcagtatcggcggggtggaaccttgcggccccaacggtcggcagtggttttcactgcagggggtgacggaagagaatcgtcagcagcgcatcgacgccattatgccgacctttattgaaattgtacgctactggcaggaaaagagcggcgtcagtccacttgccaccgcgctgatcggtttctctcagggggcgattatgtcgctggagagtatcaaagcggcgccggatctggcttcgcgggtcatcgcctttaatggccgctatgcgacgctgccggagacggcaacgacggccactaccattcacctgatccacggtggtgaagatcgggttatcgacctggcgtgggcggtgtcggccgaggaggcgttacagcaggcgggcggcgacgtgaccttagatattgtcgacgatctcgggcatgccattgacgatcgcagtatgcagttggcgatcgagcgtctgcgttataccgtgccgaagcactattttgatgaggcgctgagcggcagtacgccaaaaggggatgatatcatcgaaatgctgtaaccccggagagcggggttacaggcgggcggtaccgcgataaaggcaaacttacggttttttcgactggtcgtgcttcggccagtcgtcgtcgtcgtcccatttatcgttaaaatcacggtgcggcggcagatcgggtttgttgttgaggaattttttgtggtcaacgcgatttagatctttaatcacgttgataattacccccaccaaaaagaccagcaccagaatccaccagtgtttaataagccattccatgcgcgcttcctctttacgtcaattcgtcaggcgaccagctgttccatgacgcgttgatacatccgcgccagcagctgcaggtcggcggcgttcacacattcattaattttgtgaatcgttgcgtttacggggcccagctcaaccacctgcgcccccatgcgcgcgataaaccgtccgtctgaggtgccgccgttggttaacagctgcggtttgatctcattatagtgctcaatcgcgttgacgaccgcatccaccagcttgccccgtccggtgaggaacggctggccggagagccaccactccacgctgtaacgcagctggtatttttccagcagggcgatcacccgggatttgatcatctcgtccgtcagctccgtactgaagcggaagttgaactggacgaacatatcgccggggatcacgttattgctgccggtgccggactgcacgttggcgatctgcatgctggtcggcgggaagaactcattgcctttatcccactcgatattgaccagttccgccagcatcggtgccgcgaggtggacagggttatcggcaaggtgcggataggcgacatgcccctgcacgccgtgaatagtcaggttgcaggtcagcgagccgcggcggccgtttttcaccacatcgccgaccacttcggtactggaaggttcgccgaccagacaatagtccagacgctcgttacgcgccatcagcgtctccaccactttgacggtgccgtttttggcgctggcctcttcatcagaggtgatcaaaaacgccagtcggcccctgtggttcgggtactgcgcgacaaaacgctctgcggcaaccaccatcgccgccagcgagcctttcatatccgccgctccgcggccaaacagcatcccgtcgcggatggtcggttcgaacgggggattgatccagcggtcggcgtcgcctgccgggactacgtcggtgtggccggcgaaggccagcgtctcgccgtggccgcgccaggcccagaaattctgcgtatcgccgaaatccatcggttcaacggtaaagccgatcgcacgcaggcgttcaatcattaacgcctggcatcccgcatcatcggggctaagggaagggcggcgaataagctgctgagccagctcaatgaccgggcaagacatagactatacctcgttaaactgctgataacttgcttcactaaaacccagcagcataggacgaccgggcgcgcagagcaatgggcgtttgataattgccggcatttccagcatcaatgcggctgcggcgtcggcattatcgatgctattgcgcagcgactcgtcaagtttgcgccaggtggtgccacgggtgttcagcagcgcctgccagcccagctcggcaataaaggtatccagttgcgcacgctcaaggccatcggcgcggtaatcatggaagcgatactcaatccgatgcgcttccagccagcggcgggcttttttaatggtatcgcagtttttaattccgtacatggtgagcatagataaaccttttacattcaattaagcggttaactcagatatttccgaatatataagtcttactgaaataatacgtgattcagatgaataaatataactttttaccggggatctcattcgatatatcgggtggttaaatgttggccacctgtgggcatgatgtgagggctttaacattattgcaaaaatgttgtctgaggttgctctacgtcacattatgtttacatacgaagcggcatagtagcgacaaccagaggttttatctctgtcagcggtccataagacaatcagagcaataggggagcacaacttcccatcggtaatgaagttatatagaatcgaccataataataagagaggctattatgattgaacatgaattggggaactggaaagactttattgaaggcatgcttcgtaaataaatttccgcaatgtgagcaggggaataacgcgaagtaaataagcgcgctagggttctgaacacataaagaaggcgaccaccgtggtcgccttttctgttattacgcctcgccgccgaagctcgtcggtttattgcggacgctcctttagcggaaaacggcgacgcaccagcacaaagaacagcggcacgaaaaagatcgccagcacggtggcggagatcatcccgcccatcactccggtgccgaccgcatgctggctgccggaaccggcgccggtgctggtcgccatcggcagcacgccgaagatgaacgccagcgaggtcatcaggatggggcgcaggcgctgacggcaagccgacagcgtggcgctgagcagatcctggcccttctcgttgagctcattggcgaactcgacgatcagaatggcgtttttcgccgacaggccgatcaccgtcaacagacccacctggaagtacacgtcattctccagcccgcgcatccaggtcgccagcagggcgccaatcacccccagcggcaccaccagcatcaccgagaacggcaccgaccagctctcgtacagcgccgccaggcacaggaacaccaccagcagagaaatcgcgtacagggccggcgcctgagcgccagagaggcgttcctggtaggacatggcggtccattcgaggccaaagccggtgggtaactgcgcggccagcttctccatcatgtccatcgcggtaccggtactgatacccggcgccgcctcaccgacgatctccaccgctgagtagccattgtagcgctccagccgcggcgagccggtctcccagcgcgaggtggcgaaggccgagaatggcaccatcgtgccgctgctattgcgcacgtaccaaagattgatatcgtcaggcagcatccggtatttcgccgccgcctggacgtagactttctttacccggccgcgatccataaagtcgttgacgtagctcgacccccacgcggtttgcagcgtatcgttgatgtcgtcaatggagacgcccagcgcctgcgctttacgctgatcgatatcgacctgcagctgcggactgtcatcgagcccgttatgccggacgcgggtcaacagcggatttttcccggccagctcaagtagcgtatcgcgcgccgccatcagcgcatcgtgccccttcccggcatgatcctccagctccatatcgaagcctgccgaactgccgaggccgctgatcgccggcgggctgctggcgataacccgcgcttcgttaatctgattaaacgctttggtggcgcgttcaataatggcaaaggaggtgccggtttgcgggtcgcgctggtcccagtctttgagacgaacgaacatacgggccacgttctgcccattgccgccggggccggagccaacggtagcgaacaccgactcgacgttctgcttctcgttattgaggaagtaatcttccgccttctgcaccaccttcagcgtctgctgctgggtgctgccgctcggcaactggaccgaggtggtgaacatcccgcgatcctccagcggcaggaacgaggtcggcaaatgcagaaacaggaacaccatcccgccgagcaggacgacgtagatcagcatccagcgcagcgagcggtgcagtattttgccgacgaaggtttcgtagcggctggcgctgcggttgaaggtgcggttgaaccagccgaagaagccttttctttcatgggattcacctggcttaacaggcttaagcagcgtggcgcaaagggcaggggtgaggatcatggccaccagcaccgagaggaccatcgccgcgacgatagtgattgagaactggcgatagatggcgccggtggtgccgccgaagaaggccatcggcacgaataccgccgacagcaccatcgcgatccccaccagcgcgccctgaatttgtcccatcgatttgcgggtcgcctcgcgtggcgacaggccctcctcgctcatgatgcgctcgacgttctccaccaccacgatggcgtcatccaccagcaggccgatcgccaacaccatcgcgaacatcgtcagggtgttgatgctgtagccacaggcatacagcaccgcgaaagtgcccatcagcaccaccggcacggcgatggtcgggatcagggtggcgcggaagttctgcaggaacagatacatcacgaggaagaccagcaggatcgcctccagcagggttttcaccacgtcggtgatggaagccttcacgaaggaggtggtctcgtaggcgaccttatattccagaccgtgggggaaaaactgcgccagctcattgaggcgattgatcacgcgctccgcggtggccatttcgttggcgccggaagccagcttgatcccgaggcctgaggccggctggcggttgtagcggctaagatagtcgtacttctccgcccccatttcgacggtggcgacatcgcccagcgtcacctctgaaccatcctgattgacgcgcagagtgatattgcggaactgctccggggtttgcagcagagattgcgagttgatggtggcgttcagcgcttgcttatcgaccgaaggcgtcccgccaagctggccaacggcaatctgggcgttctgcgaactgatggcgtcggtaacatccttggtggtcatctggtagctgttgagcttcgccgggtcgagccagatgcgcattgagtattgcgaaccgtaggcgtcgatatcccccacgccgttgacgcggctgagcgggtcctggatgttactggcgacgtagtcggcgatatcttgtttatccatactgccgtcagtggagacgaaggcgagcgtcaggatattggtatcaccggtcttgcgtaccgtcaccccttggttttgcaccgcctgcggcagcttacgcatcgccgactgtagctggttctgaacctgctgcacggcttcatccgggtcggtaccggcggtaaagctgagggtgatcgtcgcctggccggtggcgctgctctgggaggacatatacatcaggttatcgaggccggtcatattctgttcgataacctgagtgacggtattctccagggtttgcgcggaagcgccgggatagttggcggtgatccgcacattcggcggggcgaggtcgggatactgttcaaccggcagcgacaaaatggcaagggtgcccgtcaggcataacaggattgccagcacccatgcaaaaatggggcgatcgataaagaaattcgccatcagaataaaaacctcatatgcacattttcttgttattgcacagcctgtgccactttagcgccagcctctccggcaatcgtggagaaattaaggagatagtgtaatttatcatgttgcttttgccgtatcgtaaagaaacctcgagctttcctgccagcaggtagcgagtctgcttcgtcaccgcagaccggcgcattatcccttgccggtgtgaaacctcatttcatttaagtcaaaaaaattgatccaaaacggattctctccagaaaaagtttatcctgggcaattggacattgttccggcgtcatcttgtcgggtaataaataggcatgcgcattgaggggttattcaccaagaagacaaaaggaagccatgaaccactttattttgagcgatagccgaaagtgcatcggctgccaggcctgcgaagtggcctgcgtgatggcgcataacgaggagcaacacgtgctgaccccgcagcgctttttgccacgtatcaccgtgatcaaagcggagggccagcgtaacgccatcacctgccgccactgcgaggacgccccctgcgtccgcagttgtcccaacgacgccatcgcccagtccggcgacagcgttcaggtccgtcaggagaaatgcattggctgtaaatcctgcatggtggcctgcccgttcggggtgatgcaggtggtggtgacgccgcaggccgcaggcctggtgaaagccagcgcgcacaagtgcgatctatgccagggccgcgaggcggggccggcctgtgtggaaaactgtcccgcgcaggcgctgaccctcgccgacgatgagacgttgatcaccctggcgaagcagcggcgactgcgctcggcatgccaggaggtgcagccgtggcagcgcgctacgccgctctgcagccagcccaatgctggcgcgaaggtcaggcaaatggcgatgacgcccccgcgcggggagccggataagctggcggcggaggtgcgtaagagccactttgaggagatctatcagccgttcaccccgcagcaggcgcagcagcaggccgcccgctgtctcacgtgtggggagcacagtatttgcgaatggacctgcccgctgcataaccatatcccgcagtggattgagctggttaaagcggggaatatcgccgccgcggtcgcgctttcccatcagaccaactgcctgccggagatcactggccgcgtctgtccccaggaccggctgtgtgaaggcgcctgcaccctgcgcgatgaaagcggggcagtcaccatcggcaatattgagcgctatatttccgaccaggcgctggccagcggctggcgtccggacctttcgcaggtgaagccgagcggcaagcgggtggcgattatcggcgccgggccggccgggctggcctgcgccgatatgctggtgcgccacggcgtccagccggtggtcttcgaccgtcatccggagattggcggtctgctgaccttcggcattccggcgttcaagctggataaatcgctattggcccggcggcgggcgatcttcagcgagatgggtatccgctttgagctcaattgcgaggtggggaaagatatctccatggcgacactgctggccgagtatgacgcggtgttcgtcggcgccggaacctatcgctccatgaaggctgggctgccgaacgaagaggcccccggggtctacgatgcgctgccgttcctcatcgccaacaccaaacaggtgatggggctggcggcatcggcgcaagagccttatgtcaacaccgccgggctgaacgtggtggtgctgggcggcggcgatacggcgatggactgcgtgcgcaccgcgctgcgccacggcgcccgccaggtgacctgcgcctatcggcgagatgaagccaacatgccgggctcgaaaaaagaggtcaaaaacgcccgcgaagagggggcgctctttgagtttaacgtccaaccggtgacgcttgagctggacgagaacgggcgggttaacggggttcgctttttgcgcaccgagctgggcgctccggacgccgggggaagacgccgtccgacgccgatccccggcagcgagtttgttatgccggcagatgcggtgatcatggcctttggcttccacccgcaccgcatgccctggctggaagcggcgggggtggcgctggacagccaggggcgtattaaagccggagtggagagccgttaccgttatcacaccagtcaggagaagatctttgccggcggcgatgccgtgcgcggcgcagaccttgtagtgacggcgatggcggaaggccgtcacgcggcgcaggggatcctggactatctggcgcggaaaacgacgccgcttcactgacgacaaacccggctccgcagcgtagtatgagggcgtccttttacgctgtggggtcggtatgtcactcaatattcacgtcattaaagataaaatcctctctgagaactggttcgtactacgcaacatgacctatgagctgacgcgggcggacggcagcgtcgtgcgccacaagcgcgaggtctacgatcgcggcaatggcgccaccgtgctgctgtataaccgccataagcagacggtggtcctggtgcgtcagttccgtgtcgccacctgggtcaatggcaatcatgacggcatgctgattgaaacctgcgccgggctgctggacaacgacgagccggaagcctgcattcgtaaagaggcggtggaagagaccggctacgaagtgggcgaggtgagaaagctgtttgagctgtttatgtcgccagggggcgtcaccgaggtagtgcatttctttatcgccgagtacagcgacgcgcagcgaaccaccagcggcggcggggtggatgatgaagccatcgaggtgctggagctgccttttagccaggcgctgcagatggtcgctgacggggagatccgcgacggtaaggcggtcattctgctgcaatatctgcaaacctccggcctgatgtcggggaactctgacaaatccgattgagtaacccgctgccgttgtccaggataggcgccgtggtcgggtttatctggggtcgggcggttcatgctttttcgcgtcatctttttcctttttctggcggtgctgccttgctcgcaggcatggtcggcaccgacgcagcagcgcttcaacgactggctggtcacctgtaacaaccaaaatttctgcgtcacccgtaacgtggggctgcatcatggcctggtgatgaccctcagccgcagcgctggggcagtcactgacgccagtctgcgtatcgagctgggcggcaccggcaatccagtggcgacgctcgcgccgatagcgccgcgcctgctgctggatggtaaaccgctgcccctgaccgacaagcgctggcacattgaagataagctcattaaaaccgccgacagcgtgacgatcgatgcgtttctccagcaggttcaggagggtaaagcgctctcgctggccaatggcctgcagaccatctccctgcaggggttgaaagcggctctgttttttatcgacgatcggcaaaagcgggtaggtagcgaaacggcctgggtcggcaaaggggaagagccgccgctcagcgtaccgccggcgccggcgctgcgcgcggtggcgagcgcggaaacggcgcagtcgccgctggggcgtgaggagctcaacgatctgatggactacggtaatgagcggatgaccaacagccactgctccctcgatcccttccgccgtgaaattcgcgttactgcgctgacggatgacaaagtgctgctgatgaccagctgcgaatccggcgcctacaacaccgtctggctggcctggctggtctcccgccagcgcccctatgtcgcccgtcaggtgcggctaacgttgccattccagccgccgggcgaggcgccgcgtgagattgagctgatcaacgccagctatgatgaccgccgccatgagctggtgaccctggataaaggccgcggggccggcgattgcgggatccaaacccgctggcgttttgacggccagcggttcagcctctcccgctacgcgcagcagccgacgtgcgacaactggcaggggccagatgcctggcccacgctgtggatcacccgttaagcacctgttcggcggtggcgacgatatggtcgaccgtaaagccaaagaacgggaacaactgctctgccggggcggattcgccatagccggtcatgccgacgatcttgccttttaagccgacatatttataccagtagtccgctatcccggcttcgaccgccacccgggcgctgacgtccgacggcagcaccgattcgcgccaggcctcatcctgggcgtcaaacacatcagtggaagggagcgagacgacccgcacatttacccctttggccaacagtttttccgcggccaggacggtgatctccacttccgagccggtggcgatgaggatcaggtcgggttttccgccggcatccttaagcacgtagccaccccgggcgatatcctgcacctgttccggggtacgcggcatctgcgccaggttttgtcgcgacaggatcagcgccgtcggcccgccctgtcgcgcgatagccgcctgccaggcgacggcggtctccacctggtcgcaggggcgccaggtgctgaagttgggcgtcagccgcagactggccagctgttccaccgcctggtgcgtcggcccgtcttccccaagaccgatcgagtcatgggtatagaccatgatctgccgggccttcatcagggccgccatgcgcgcggcgttgcgggcgtactccacaaacatcaggaaggtcgaggtataaggaataaagcccccgtgcagggcaatgccgttggccaccgcggtcatgccaaactcgcgcaccccgtagtggatataattgcccgcaggatcttctttaatcgatgtcgatccagaccagatggtcaggttactcggcgcaagatccgcagaaccgcccagcagttccgggaggtgcgggccgtaggcgttcagcgcgttttgcgaagccttgcggctggcgattttcgccggctcggcctgcagtttcgccacgtagtcgcgggcgatcgcggcaaagtcttccggcagggcgccattcatacgtcgggtcagctcagcggccagctccgggaactgctgctggtaggcggtgaatttctcgttccaggcgtgctccgctttttccccgcgcggacgcgcatcccagcccgcgtagatctctttcgggatctcgaacggaggatatttccagccaagctgctggcgggccagcgctacctctttttcgcccagcgccgccccgtgagactcctctgagccggctttgttgggcgaaccgaagccgatgatggtccggcagataatcagtgacggtttatctttcaccgcctgcgcttccgttatcgcctgtttgatagcctgcggatcgtggccgtcgatatcgcctatgacgtgccagtgataggcgcggaagcgttccgccgtatcatcggaaaaccagccttcggttttgccgtcgatggagatgccgttgtgatcgtaaaaaccgatcagcttgcccagtccgagcgtgccggccagcgaacaggcctcatgggagatcccctccatcaaacagccatcgcccatgaacacccaggtgtgatggtcaatgatctcatggccggggcgattaaactgcgccgccagcgtccgttcggcgatggccatcccaacggcgttcgccagcccctggcccagcgggccggtggtggtttccaccccaggggtatagccatgctccgggtggccgggcgttttagagtgcagctgacggaactgcttgagttctgacagcggcagatcgtagccggtcaggtgcagcagactgtagagcagcatcgacgcgtggccgttggacaagataaagcggtcgcggtccacccagtcagggttctgcggattgtgcttgagaaaatcgttccacagcacttcggcaatatcagccatccccatcggcgcaccgggatggccggagttggctttctgcacggcgtccatactcagggcgcggatggcgttggcaagctctcttcgggacatatttttctccgtgagactaaagtgacagtttggcggcaagcagatcttccagtttgcgctgatcgacggcgaacaggcggatcccctccgctagcttttcgaccgccatcggatcctgattatgttcccagcggaactccgcttcactgagcggcaccggacgcggcaggatctggctggcagggatcagtttgcgcaccaccggggtatcgctggcctgcagctcttttaataaaggcggggcgatggtcaaccggtcgcaaccgaccagcgccaggatctgctcggtgcggcggaagctggcgcccatcacgatggtgttgtatttatgctgtttgaaatagtcatagatattgcgcaccgatttcacccccggatcttcctccaccacgtaaggctccagcggtttgcgcgcctgataccagtcataaatacgcccaacgaacggggagatgagataaaccccggcctcggcgcaggcccgggcctgggcgaaggaaaacagcagcgtcaggttgcagtggatcccctctttctcaagcacctccgcggcgcggatcccctcccaggtggatgccagcttgatcaggatccgcgatttatcaatgcccatctcctgatacagcgccaccaggtggcgagccttctcgatacttttctcgcggttgaaggagagccgggcgtccacctcggtggagacccgcccgggaatgcttttgaggatctccgcgccaaaattgaccgccagcttatcgcaggcgtgagccacctgcgcttcgcggccgccaccctgttttttggcccaggcgatagcgtcgtcgatgaggccgctataggacgccaggccggcggccttcagcagcagagaggggttggtggtggcgtcttccggatggtagtggcggatggattcgatgtctccgctgtcggcgaccaccgtggtgaactgcttgatgctgtctaactgattcatggataagtcctcctggaacaaggtgttacatgagtgcttgccggtatacggtataaacattgatgaggtacataaccaaaaagcatagcagacagggctattattggcggcgaatccgggtaacataaccgctataaattgataacaacaaaatcataacgatggccagagtttggcggtgttcaaagtttatcgccccgccaggagggatactgtctgccactgaaaggtgaacgacaggatggtcatcacgcttttcccctacgaacgatacgtgaaagaaaggaatagaaaatggatgagcagttaaaacagagcgccctcgacttccacgaatttccggttcccggaaaaatccaggtctcgccgaccaaacctctcgccacccagcgcgatctggcgctggcctactcgccgggcgtcgcagccccctgcctggaaatcgaaaaagatccgctggccgcctacaaatacactgcccgtggcaacctggtggcggtcgtctccaacggcaccgcggtgctggggctcggcaacatcggcgcgctggccggtaagccggtaatggagggcaaaggcgtcctgtttaagaaatttgccggtatcgatgtgtttgatatcgaagtcgatgagctggatccggacaaattcattaacgtcgtcgccgccctcgaaccaaccttcggcggtatcaacctggaagatattaaagcgccggagtgtttctacatcgagcagcagctgcgcgagcggatgaatatcccggtcttccatgacgatcagcacggcacggcgatcatcagcaccgcggcgatcctcaacggtctgcgcgtcgtcgagaagaatctgtccgacgtgcggatggtggtctccggcgcgggcgcggcggcgatcgcctgtatgaatctgctggtggcgctggggatgcaaaagcacaacatcgtggtctgcgattcgaaaggcgttatctataaagaccgtgagccgaacatggcggaaaccaaagccgcctatgcggtggaagacgatggcaaacgcaccctcgatgacgtgatcgacggcgccgacattttcctcggctgctctggcccgaaagtgctgactcaggagatggtgaagaagatggcgcgggcgccgctgatcctcgccctggccaacccggagccggaaattctgccgccgctggcgaagcaggtccgcgatgacgccatcatctgtaccggccgctccgactaccctaaccaggtcaacaacgtactttgcttcccgttcatcttccgcggcgcgctggacgtcggcgcgacggcgatcaacgaagagatgaagctggcggcggtgcatgcgattgccgagctggcccatgccgagcagagcgaagtggtggcctccgcctacggcgatcaggatttaagctttggtccggactacatcattccgaaaccattcgacccgcggctgatcgtcaaaatcgcccccgcggtggcgaaggcggcgatggattccggtgtggcgacgcgcccgatcgccgattttgacgcctatatcgagaagctgagcgagttcgtctataaaaccaacctgtttatgaagcctatcttctctcaggcgcgcaaagagccgaagcgcgtggtgctggcggaaggggaggagactcgggtgctgcacgccacccaggagctggtgtctctgggactggccaaaccgattctggtggggcgcccgagcgtgattgaaatgcgcatccagaagctgggcctgcagatcaaggccggcgttgactttgagatcgtcaataatgaatccgacccgcggtttaaagagtactggagcgagtactaccagctgatgaagcgccgcggcattacccaggagcaggcgcagcgggcggtgattagcaacaccacggtgattggcgccatcatggtgcatcgcggtgaagcggatgcgatgatctgcgggactattggcgagtaccacgatcactaccgcgtggtgcagccgctgtttggctatcgcgacggcgtcagcaccgccggggcgatgaatgcgctgctgctgccgagcggcaacacctttatcgccgatacctatgtcaatcacgatccgtcgccggaagagctggcggagatcaccctgatggcggcggaaagcgtgcgacgctttggtattgaaccgcgcgtggcgttgctgtcgcactccaactttggctctgccgactgtccgtcagccagcaaaatgcgtaaaaccctggagctggtgaaggcccgcgccccggagctgatgatcgatggcgaaatgcatggcgacgccgcgctggtggaaagcatccgcaacgatcgcatgccggacagcccgctgaagggggcggccaatattctggtgatgccgaatatggaagccgcccggatcagctataacctgctgcgcgtctccagttcggaaggggtgaccgtcgggccggtgctgatgggggtggcgaagccggtgcatatcctgacgccgatcgcctccgtacgtcggatcgttaatatggtggcgctggcggttgttgaagcgcaaaccgaaccgctgtaattttctatttcccccgttaacgcgcggatccgtttccgcgcgcaatatcaggcaggccggtgagtaaaaaacgctgagcctgcctttttaattccaccgcaatattattttctctcctgagtgatccacttcaccttttaaccccacttgccgaaatttgttatttgccgcgctgaaatgtcgtcaccatgaggacagatttcagggggcaatcagtcatggataaagaacgcattattcaggaattcgtaccaggcaaacaggtcacgctggcgcatctgattgcccacccgggagcggagctggcgaaaaagatcggcgtacccgaatccggcgcgatcggcattatgacgctgacgccgggagaaacagcgatgatcgccggcgatctggcgatgaaggccgccgacgtgcacatcggttttctcgaccggtttagcggcgcgctggtgatctacggctcggtcggcgcggtggaggaggcgcttctgcagaccatcggcggattaggccgcttattaaattataccttgtgcgaattaacgaaaagttaattgagagcgaccatgaagcgtattgcgattgtcggcgccgtcggtgcaggaaaaaccacgttatttaatgccctgcaggggaattattccctcgccagaaaaacgcaggcgctggaatttaacgatcgtggcgacatcgatacacccggggaatatttcagccatccgcgctggtatcacgccttaattaccaccttgcaggatgtggacaccctgatttatgtccatgcggccaatgataccgaaagtcgcctgccacccgggttgctggatattggcagccgaaagcaccttatcgtggcgatcagcaaaacggatctgccggatgccaacgtcgccgcggtgcggcagctgctggacgggatggggtttcaggcgccggttttcgccctcaacggttgcgatccgcaaagcgtcgcgccgctggaaaattacttgagtgagctcagccaaaaggaggaagggccaggtgaagaaactcattaccgctaacgatattcgtgccgcccacgcgcgcggcgaacaggcgatgtcagtagttctgcgcgccagcattatcaccccggaagcgcgcgaagtcgccgagctgctgggattcactatcaccgaagacgatggcgccgcgccggcggcgacagcggcggacagcgacaaaacggaaagccagcggatccgggaaaccatcctggcgcagctgccggaaggccagtttaccgaaagcctggtggcgcagctgatggaaaaggtgatgaaggagaagcagtccctggagcaggaggcgatgcagccgggatttgaggcagtgaccggcaaaggcggcatcaaagtgatcgacggcagcagcgtgaagtttggccgcttcgacggcgcccagccgcactgcgtcggcttaacggacctggtgactgaccaggatggcagcagcatggcggccggatttatgcagtgggagaacgccttcttcccgtggacgctgaactacgacgaaatcgatatggtgctggagggcgagctgcatgtgcgccatcagggggaaacgctggtcgccaaagcgggggacgtcatgttcatcccgaaaggctccagcatcgaattcggtaccccgtcgacggtgcgcttcctgtacgtcgcctggccggcaaactggcaatcgctatgaacgatttcattaccgaagcgtggctcagagcgaatcatacgctcagcgaaggcggtgaaatccatcttcctgccgatgcccgcctgacgccctcggcgagggaactgctggaaagtcggcatctgcgggtcaaatttctcgaccgccaggggcgcctgtttgtcgaggatgacgaacagacgccacagccggtgcatgtcctgaccagcagcgaccatccgccccaggcctgctgcgagctttgtcagcagccggtgggcaaaaagccggacaccttaactcatctgacggccgataccctggtggcgaaaaacgatccgcggctggccttccgcgcggtgctggacagcaccatcgccctgacggtgtggctgcaaattgaactggcggagccctggcagccgtggctgacggacatccgttcgcggctgggcaacatcatgcgcgccgatgcgctggaggaaccgctggcggcgcagtcgatagccggattcagcgaggcgcagctgcatcgtctgtcccatcagccgctgcgttacctgggtcacgatcacctggtgccggaggcccgccatgggcgcgatgtcgcgctgcttaatttgctgcgcggcaaagtgcgcgaggcggaggtgaccgcggcgcaggtgtttattacgccgcaatttgcggtccagcgcgccgatattatgcaagcgctcaaccgcctttccagcgcggtctacgtgatgatgatcctgggcgtgacggacgcgccgccggcgctcagccaactgcagcagctgggaggtgaagatgatcattgaccagtgtcgcaaactggcgctgcgtgcccccgccagggtggtgttcccggatgcgctggacgtccgcgtgttgaaggcggcgcattatctgcagcagcagggcctggcgcatccgatcctcgtcgccagccccttcgcgctgcggcagttcgcccttggcgaacgtctgccgctgaccggggtgcaggtcatcgatccgcacagcaacctggcgatgcgcgaggcgtttgccgccgcctggcaggcgcgcgccggcgataaagcgcccgctgacgcggtcgacaagctggccgacccgctgatgttcgccgcggcgatggtcagcgccgggcaggccgaggtgtgtatcgccggaaatctctcgtcaaccgccagcgtgctgcgcgctggtctgcgccttatcggcctgcagccgggatgtaaaacgctctcttcgctgtttctgatgctgccgcagtatgccggacagccgctggggtttgccgactgcagcgtggtgccgcagccgaccgcggcgcagctggcggatatcgcgattgccagcgccgagacctggcaagcgatcgctggcgaagcgccgcgggtggcaatgctgtccttctcgacatacggcagcgcccggcatccctgtgtggctaacgtccagcaggccacggagatcgtgcgtcagcgggcgccgcagctgatggtcgatggcgagctgcagtttgacgccgcctttgtaccggacgtcgctgcgcacaaagcgcccggcagcccgctgcagggccgggccaatgtgctggtcttcccgtcgctggaggcgggcaacatcggctacaaaatcgcccagcggctgggcggatatcgcgccatcgggccgctgatccagggcctggccgccccgcttcacgacctctcgcgaggctgtagcgtagaggaaattatcgaactggcgctggtggcgtcggtaccgcgccagacggacgcaagccggatccccgactcgtccacgctggttgaatgaatggtccccttcaggaccccttatgagaggaaaacacaatggaagcattaggaatgattgaaacccggggcctggttgcactgattgaggcctccgacgccatggtcaaagcggcccgcgtcaagctggtgggagtgaaacagatcggcgggggcctggtgaccgccatggtgcgcggcgatgtcgcggcgtgcaaagccgcgacggatgccggggcggcggcggctcagcgtatcggtgagctggtctctgtacatgtcatcccgcgcccgcatggcgatctggaagaggtcttcccgattagcttcaagggcgacagcaacatctaacgggggagggggtgccggaaaattctggccggataagacgccagcgcgtcgctatccggccatgaaaaggcatgaatgccggatggcgttgcgcttttccggcctgcacatcacacgcggagacggacatgaagctggctgtggtaaccggatatgtggtctgcaccgtacgccatgaaggtctggcccacgacaaactgctgatggtggagatgctcaatgcccgcggcgagcccgacgggcaatgtgcggtcgccatcgacagcatcggcgcgggatgcggagagtgggtactgctggtcagcggcagctcggcgcgacaggcgcacgcacacggcgcctctccggtcgatctgtgcgtgattggtatcgtggatgaggctgcggccgatggtcaggtgctcttccataagtagggtgaaaaatcatgaatcaacaggacattgaacaggtagtgaaagcggtactgctgaaaatgaaagacagcagccagcctgccggcaccgttcatgatatgggcgtttttgcctcactggatgacgctgtcgcggcggcaacggtggcccagcagggattaaagcgggtggcgatgcgtcagcaggtgattcaggccatgcgtgaggcgggtgaaaagtatgcccgtgaactggcggagcttgcggtgacggagaccggcatgggacgcgttgaagataagtttgccaaaaacgtggcgcaggcgcgcggcacgccgggcgtggagtgtctgactccgcaggtgctcaccggcgataacggcctgacgctgattgaaaatgcgccctggggcgtggtggcctcggtgacgccgtccaccaatccggcggcgacggtgatcaacaacgccattagcctgatagccgccggcaacagcgtggtcttcgccccccatccggcggcgaaaaaggtctcgcaaagggcaattaccctgcttaaccaggcggtagtggccgccggcggcccggccaacctgctggtgaccgtggcgaacccggatatcgacaccgcccagcggctgtttaagtaccctggcatcggcctgctggtggtgaccggcggcgaagcggtggtcgaggcggcgcgcaaacataccaacaaacgcctgatcgccgccggggctggcaacccgccggtggtggtggatgagactgccgatctaccgcgcgccgcgcaggcgatcgtcaaaggcgcctcttttgataacaacattatctgcgccgacgagaaggtgctgatcgtggtcgatagcgttgccgacgaactgatgcgcctgatggaaggccagcaggcggtgaaactcacggcggcgcaggccgaacagctccagccgctgctgctgaaaaatattgacgagcgcggcaaaggcacggtcagccgcgactgggtcggtcgcgacgcgggcaaaatcgccgcggcgattggtctgcaggtgccggcgcaaacccgcctgctgtttgtggaaacgcccgccagccatccgtttgctgttactgaactgatgatgccggtgctgccggtggtgcgggtggcgaacgttgaagaggccatcgccctggcggtgcaactggaaggcggctgccaccacaccgcggcgatgcactcgcgcaacatcgacaacatgaaccagatggcgaatgccatcgacaccagcatcttcgtcaaaaatggaccgtgcatcgccgggcttgggctgggcggcgagggctggaccaccatgaccatcaccaccccaaccggggaaggggtgaccagcgcgcggaccttcgttcgtctgcgccgctgcgtgctggtggatgcgtttcgaatcgtataagggatgaacatggcgcacgacgaacaacgctggctttcgccgagactacaaaaagccgctgccctgtgtaaccaggcgcccgccgccagcgagtcgccgctgtggctgggcatcgatttgggcacctgcgacgtggtgtcgatggtggttgaccgtgacggccagccggttgcggtatgccttgactgggccgacgtggtgcgcgacggcatcgtctgggatttctttggcgccgtcaccctcgtgcgccgacatcttgcgactctcgagcaggagctgggctgccgcttcacccatgcggcgacctcgtttccgcccggcaccgatccgcgcatttcgatcaatgtcctggagtccgccgggctggagatcagtcatgtgctggatgagcctaccgcggtggccgatctgctgcagctcgataacgccggggtggtggatatcggcggcggcaccaccgggatcgccatcgttaaacagggcagggtgacgtattcggcggatgaagccaccggcggccaccatatctccctgactctggccgggaatcgcagcatcgggcttgaggaggcggagcagtacaagcgcagccacgccggggagatctggccggtggttaagccggtgtacgagaagatggccgaaattgtcgcccgacatattgccggacaagggattgtcgatttgtggctggcaggcggcgcctgtatgcagccgggtgtgcatgagctgtttcgtcagcgcttcccggcattaccggtgcatttgccgcagcacagcctgtttatgaccccgctggcaatcgccaacagcgggagggaaaaagcggaggggatgtatgcaagctgaactgcagacggcgctgttccatgcctttgatacgctgaatcttcagcaaatgaaaagcttcaacgttccgccggtgacgctgcacggcgtcggcgcgctggcggcctgcggtccgcaagcgcagtcccggggccttaggcatctgtttgtcatggttgacagttttctccatcaggcgggaatgaccgccgggctggagcgtagcctggcgatgaaagggattgctatgactctctggccctgtcccgccggcgaaccctgcgtcaccgatgtctgcgccgccgtcgcccagctgcgggacgcgcgctgcgacggcgtggtggcctttggtggtggatcggtactggatgcggcgaaggcggtggcgctgctggtcgccaatcctgagcagacgctgggggagatgacggagcacagcgagttgcgcccacgtctgccgctgatcgcggtgccgaccaccgctggcaccgggtctgaaaccaccaatgtgacggtgattatcgatgcggtgagtggacgcaaacaggtgctggcgcatgcctcgctgatgccggatgtggcgatcctcgacgccgcgctgaccgaaggcgtcccgccgcatatcacggcaatgaccgggattgatgcgctgacccacgccgtcgaggcctacagcgcccgccacgccacgccgtttaccgacagtctggcgatgggggcgatagccatgatcggcgaggcgctgccgaaagcggtgggctgcggtcaggatctggcggcgcgggagaacatgctgctggcttcctgcatggcggggatggcgttttccagcgccgggctggggctatgccatgccatggcgcatcagccgggggcggcgctgcatattccgcacggtctggccaacgccatgctgctgccaacggtgatggagtttaaccgcatggtgcgccgggcgcgcttcagccagatcggccgggcgttaaccggcaagaaaaccgatgaccgcgaggctatcgccgccgtgcgcgagctgatcgccgaggtcggtctgacgatgcggctgacggaggctggcgcgacgtccgcgcactacgccgcctgggcgcaagcggcgcaggaggacatctgtttgcgcaccaatccacgcaccgccagccgggagcagattatcgagctgtacgcggcggcgcgataaatgccgattttcccggaggcgtgtggctgtggctttcccggctcgtgctgcgcttagccgggctacaggatcacagccgtctgctatgccgtagcccgggtaaggcgttcacgccgcggcccgggaaagtcgcctgagtgcggctaatgtcccggtattcacagtatctacaaatcataaatgacagggagtaagggctatgggaattaacgaaatcatcatgtacatcatgatgttctttatgctgattgccgccgtggacaggatcctgtcgcagttcggcggctcggcgcgctttctcggcaaactggggaaaagcattgagggatccggcggtcagtttgaagaagggtttatggcgatgggcgcgctgggcctggcgatggtcgggatgaccgccctggcgccagtgctggctcatctgcttggtccggtgattattccgctgtatgagatgctcggcgccaacccgtcgatgttcgccggcacgctgctggcgtgcgacatgggcggtttcttcctcgctaaagaactcgcgggcggcgacgtggcggcctggatgtactcaggcctgatcctcggctctatgatggggccgaccattgtgttctccattccggtggcgctcggcattatcgaaccaaccgatcgccgctggctggcgctcggcgtgctggcgggcattgtcaccattcccatcggctgtatcgccggcggtctggtggcgatgtattccggggtggagatcaacggccagccggtagagtttaccttcgcgctgatcctgatgaatatgatcccggtgatcatcgtcgccgtgctggtggcgctggggctgaagtttattccggaaaaaatgatcaacggcttccagatcttcgccaaattcctcgtggcgctgatcaccatcggcctggcggcggcggtgatcaagttcctgctcggctgggagctgatccccgggctcgatccgatctttatggcgcctggcgaccagcccggcgaagtgatgcgcgccatcgaagtcattggctctatctcctgcgtgctgctcggcgcttatccgatggtgctcctgctgacccgctggtttgaaaagccgctgatgcgcgttggtaatctgctaaaaatcaacaatatggctgccggcggcatggtcgctaccctggcgaacaatattccgatgttcggcatgatgaagcagatggatacccgcggaaaagtgatcaactgcgccttctcggtgtcagcggcgttcgccctcggcgaccatctcggttttgcggcggccaacatgaacgccatgatctttccgatgattgtcggcaagctggtcggcggcgttaccgcgattggcgtggcgatgctgctggtgccaaaagatgaaaacgtaccggcgcctgccaacaacgaagcggaggcgcactcgtgaacacgcgccagctgttgagcgtcggtattgatatcggcaccaccaccacgcaggtgatcttctcgcgcctcgagctggtgaaccgcgcggcggtttcccaggtgccgcgttatgaattcatcaaacgcgacattagctggcaaagcccggtcttctttacgccggttgataagcagggagaactgaaagaggccgagcttgaggcgctgattctggctcagtaccgggccgcagggatcgctccacaagcggtggattccggggcgatcatcatcaccggcgaaagcgcgaaaacccgcaatgcccgcccggcggtgatggcgctctcgcagtcgctgggcgattttgtcgtcgccagcgccgggccgcatctggagtcggtcattgccggacacggcgccggggcgcagaccctgtcccggcagcggatgtgccgggtgctcaatatcgatattggcggcggtacctcgaactatgccctgtttgacgccggaaacgtcagcgccaccgcctgcctcaacgtcggcggccgcctgctggaaaccgacgctcaggggcgcgtggtccacgcgcacccgccggggcagcggattgtcgatgcgctgtttggcgccggcactaacgccctggcgctgaccgccgggcagctggcgcaggtggcgcgccggatggcggcgctgatcgtcgaggtgatcgagggcaccctctcaccgctggcgcaggggctgatgcaaaccgaagtactgcctgcgggtattcagccggaggtgattaccctttccggcggagtgggggagtgctaccgccatcagcccgccgatcctttctgtttttccgatatcgggccgctgctggccacggccctgcatgagcatccgcgcctgcgtgagatgaacgtgcagtttccgacgcaaaccgtgcgcgccacggtgattggcgccggggcgcatacgctgtccctgtccgggagcaccatctggctggagggggttccattgccgctgcgcaatttgccggtggctatcccgcaggatgccgccgatctgccgaacgcctggctccaggcgctgacgcagctcgatctggctcccgaggcggacgcttacgtgctggcgcttcccgcttcacttccggtgcgctacgccaccttactgaccgtaattgacgccctgctggcgtttgtcgcccgctttcccaatccccgtccgctgctgctggtggccgagcaggattttggcaaagcgctgggcatgctgctgcggccacagcttccacaccttccgctggcggtcatcgatgaggtgagcatccgggcgggagactatatcgacattggtacgcctctttttggcggatcggttgtgccggtgacggtgaaatcactcgcatttccttcctgagggaacgacttatgaaactaaagaccacattgttcggcaatgtttatcagtttaaggatgtaaaagaggtgctggcgaaagccaacgaactgcgttcgggggatgtgctggcgggggtagcggcggagagttcgcagcagcgcgtggccgccaagcaggtgctctccgatatgacggtggccgatatccgtaataacccggtgatcccgtatgaggaggactgcgttacgcgcctgatccaggatgacgtgaacgaaaccgcctatcagcggattaaacactggaccatcagcgacctgcgggaatacgtgctcaacgacgaggtcatcagcgacgatatcgcctttgtccgcaaagggctgacctccgaggtggtggctgcggtggccaagatctgctccaacgccgatctgatctacggcggtaaaaaaatgccggtgatcaaaaaagccaataccaccatcggtctgccggggacctttagctgccgcctgcagccgaacgatacccgcgacgacgtgcagagtattgccgcacaaatctatgaagggctctccttcggcgcgggcgacgcggtgattggcgtcaacccggtcactgacgacgtggagaacctgagccgggtgctggatacggtgtacggggtgatcgacaagtttaacatcccgacccagggctgcgtgctggcgcacgtcaccacccagattgaagccatccgccgcggcgcgccgggggggcttatcttccagagcatctgcggcagtgaaaaagggcttaaagagttcggcgtcgagctggcgatgctcgatgaagcgcgggcggtgggggcggagtttaaccgcatcgccggggagaactgtctttactttgaaaccgggcagggctcggcgctttccgctggcgctaacttcggcgccgaccaggtgaccatggaagcgcgtaactatggcctggcgcggcactacgatccgttcctcgtcaacaccgtggtgggctttatcgggccggagtacctctataacgaccggcaaatcattcgcgccggactggaagaccactttatgggcaagctgagcggcatctcaatgggctgcgactgctgctataccaaccatgccgatgccgaccagaacctcaacgaaaacctgatgatcctgctggcgaccgcaggctgcaactacatcatgggcatgccgctcggcgacgacatcatgctcaactaccagaccaccgccttccacgataccgcgaccgtgcgccagctgctgggcctgcggccgtcgccggagtttgaacgctggctggaaacgatgggcattatggcaaatggtcgcctgaccaaacgggcgggcgatccgtcactgttcttctgatgacgcggggatgacacatcatggatcaaaaacagattgaagacattgtacgcagcgtaatggcgtcaatgggacaaccacagtcgcagccgcaggcccccgcagcgtcgacgccggcctgccatgtcgcctgcgccagcgaagcggtggtggaaagctgcgcgctggacctgggctcagcggaagcgaaagcctggattggggtacaacatccgcaccgcgccgaagtactgaccgaactaaaacgcagtaccgcggcgcgcgtttgcaccggccgcgccggcccgcgtccgcgcactcaggcgctgctgcgcttcctggccgatcactcgcgctcgaaagacacggtgctcaaagaggtgccggaagcgtgggtgaaagcgcaggggctgctggaagtgcgttccgagattagcgataagaacctctacctcacgcgtccggatatgggccgtcgcctcagtccggaagcgattgatgcgctgaaggcgcagtgcgtgatggatccggatgtgcaggtggtggtctccgatggcctgtcgacggatgccatcaccgccaactacgaagagatcctgccgccgctgcttgccggcctgaaacaggcgggtctgaaggtcgggacgccgttcttcgtgcgctatggccgcgtcaagattgaagatcagatcggcgagatcctcggcgcgaaggtggtgatcctgctggttggcgagcgcccggggctcggccagtcggagagcctctcctgctacgcggtgtactccccgcgggtggcgaccaccgtcgaggccgaccgaacctgtatctccaatatccaccagggcggcaccccgccggtagaagccgccgcggtgatcgtggatttagccaaacgcatgctggagcagaaagcctccggcatcaacatgagccgttaaggaggcatcatgccagcattagatttgattcgaccctcggtcaccgcgatgcgcgtgattgcctcggtgaatgacggtttcgcgcgcgagcttaaattaccgtcgcatatacgtagcctcggactcatcacggcagattctgacgatgtgacgtatattgccgccgacgaagcgacaaagcaggcgatggtggaggtggtctatggccgctccctctacgccggtgcggcccatggtccgtcgcctaccgccggcgaagtactgatcatgcttggcggcccgaacccggcggaagttcgcgccgggctggatgccatgatggcgcatattgaaggtggggcggcattccagtgggctaacgacgcgcaagataccgcctttctggcgcacgtggtgtcgcgtaccggctcttatctttcatcggccgctggcatcgcgttgggcgatccgatcgcttatctggtggcgccgccgctggaggcgacgtttggtatcgatgcggcgatgaagtcggccgacgttcagctggtgacctacgtcccgccgccatcggaaaccaactattcggccgcctttttgacgggaagccaggccgcctgtaaagccgcctgcaatgcctttaccgatgccgttctcgatattgcccgtcatcctgtacagcgtgcgtaatggagggagcgatgatcaatgcgctgggattgctcgaagtggagggcatggtcgcggctgtagacgctgcggatgccatgcttaaggcggccaatgtgcgcctgctcagtcatgaagtgctcgacccgggcaggttaacgctggtggtggagggcgacctggcggcctgccgcgccgcgctggatgccggggccgccgctgcccggcggaccggctgcgtgatcagccgtcgggaaattggccgcccggaagaggatacccagcggctgatcggcggttttcagccaccgccgccagcgaccatgccgcctgctgacccggcttcatcggaagccttactgacgctgctggcttcagttcgtcaaggcatgacggccggcgaggtcgccgcgcattttgcctggccgctggataaggcccgccaggcgctggagcagctcttttccgcagggtcgctacgaaaacgcagtagccgctatcgtctcaaaaatccataacctgtcggaggtgccgggagcggcttgcccccggctttaacgattatgaaaaagcgtcgttctgcaaatttgcaccatctctgttgcgaggcgttgccggaagacatcaggctgacgcctcaggttgaaattgacaatattcatcaacgacacacaaccgatgtgtatgagcacgccctgaccattaccgcctggcaacagatctacgatcagctgcatccggggcagtttcgcggcgagtttaccgaaatcctgctcgatgagatccaggtcttccgcgaatataccgggctggcgctgcgccagtcctgcctggtctggccgaactccttctggtttggcattccggcgacccggggagaacaggggtttatcggctcgcagtgtctgggccgggcagaaatcgccacccgtcccggcggtacggagttcgagctcagcacgccggatgattacaccattctcggggtagtgatttcgcaggaggtgattgcgcgtcacgccagtttcctgcaccacccggaacgggtgctacatatgctacgcaaccagtcagcgctggcggtccgcgagccgcataaggccgcgctgtgggggtttgtccagcaggcgctggccacctttagcgagcatccggatacccttcatcagccggccgtgcgtaaagtcctgcgggataatctgttgctggcgatgggcacgatgctggaagaagcgcagccgatggtaagtgcagagagcgtcagccaccagagctaccgccgcctgctggcgcaggcgcgcgaatatgtgctggaaaacagcgcggagccgttaaccgttctcgatctgtgccagcagctgtacgtcagccgtcgcaccttgcaaaacgccttccatgcgatactggggattggtcctaacgcctggctcaaacggatccgcctgaacgccgtgcgtcgggagctgataagcccctggtcagagcgcgagacggtcaaggaggcggccatgcagtggggattctggcatttggggcagttcgccaccgactatcagcagctgtttgctgagaaaccgtcgatgacgctgcaccatcgcctgcgccagtgggtgtgagggaagagactccgctaccgggtggccagccgccatccggccgttacagccagtcgcgcacctgaataaactcgctcagcgccgcctcggggctgccgggctcgggctgataatcatattcccagcgcaccagcggcggcatcgacatcagaatcgactccgtacgcccgccggtctgcaggccgaacagggtgccgcggtcccagaccagattgaactcgacatagcggccgcgacggtagagttgaaagtggcgctcgcgttcgccgtacggcgtggctttccggcgttcgacgataggtaaataggcgtcagcatagccgttcccgaccgcctgcataaaggcgaagcagtggtcaaaatccggggtgttcaggtcgtcaaagaacaggccgccgatgccgcgctgctcctggcggtgcttgagatagaagtaatcatcgcaccattttttatagcgcggatagacttcctcgccgaacggcagacacagatcgcgggcggtacgatgccagtggacggcatcctcttcaaagccgtagtaaggggttaaatcaaagccgccgccgaaccaccacaccgggtcggcgccaggcttttcggcaataaagaaccgcacgttggcatggctggtgggcacgtaggggttcagcggatgaaccaccagcgagacgcccatggcttcaaaactgcgtccggccagctccgggcggtgcgcggtggcggaggcaggcatggcgtcgccatggacgtgggaaaagttgacccccgcctgctcgaacacccggccttcgcgcagcacccggctgcgtccgccgccaccgccttcccgctgccaggcatcttcaataaacggcgcgccatccacggcgctcagctgctgactgaggttgtcctggagctggagcagaaaagtttttacctgcgcggcatcgggtttcattaacgtctcttcgaatgggctttctggttatcgaaccagtggaaatagctgataatgccgttggcaatcgcggtggcgattttctgccggaaggcggtggtgccgagcagtttctcctcgttcgggttggtgataaacgaggtttccaccagcacggacggtatggatggtgacttcagcaccacgaacgccgcctgctcggtattgcggctgtgcagcttatgtaccggcttgatctttttcaggatatgcgagcccagcgtcaggctgtttttgatggtgtcggtctgcaccagatcgaacagtacctgctgcagcagatggtctttatccgtcgctttcttaccggcgacctcatcggcgcggttttcgcgatcggagaggtatttcgccatggcgctactggcgccgcggtttgacagggcgaacaccgaggcgccggcggcgctcgggttggtaaaaccatcggcgtggattgacataaacagatcggcgccgtgctgatgggcgatctccacgcggtcgtacagcgggataaaggtatcgccggtgcgggtcaggcgggcgtcgatgccgttgctgcgcaaaatgctgcgcacgttcttagcgatcgccaacaccacatgcttctctttcgagccgttatggccgatagcgccggtatcgatgccgccgtggcccggatctaacattacaatccggcgacccccggcctttttggcggcgggtttgctatgtccatttgacgttttcagtggctgttcttttgcgctgacctgtgaggcgacgccgctcagcgtcatcgcagccagcccggctttcagcacctgacggcgcgaagcaagtatttttaagggtttaaaagtgctcattcggcctgaattgtaaacaagtgatgtccaatgttatatcgtatcgcgtttgccgttacgaccattcaaaataagaattgttttacttttcatttcaatacatgacaaagtcatattatgccattttttgtcgctgatttcgcctgatattggctatcagttatattcgcgccataatcactgtttttaaccgtcaatggtggggaataccatggagattcgcgtttttcgccagcaggatttcgaagaggttgtgacgctgtgggagcgctgcgatctgttgcgcccgtggaacgatccggagatggatattgagcgcaagctgaatcacgacgtcagcctgtttctggtggcggaagtgaatggcgaagtggtcggcacagtgatgggcggatatgacggtcatcgcggatcggcctattatctcggcgtccatccggaatatcgcggccggggtatcgcgaacgcgctgctcaaccgtctggagaaaaagctgattgcccgcggctgcccgaaaatcaacattatggtccgtgaagacaacgacgtggtgcagggaatgtacgagcggttgggctatgagtacgccgatgtcctgaccctgggcaagcgcctgatcgaagatgaagaatactgagtttatccccgccgattttgatgcccatggccgtctgcgcctgcctttgcttttctggtgcgtgctgttgttgcaggcccgcacgtgggtgctgtttttgatagccggcgcatcgcgccagcagggcgacgcgattcttaatctgttctatcccgatcacgagcgcttctggcttggtttactgccaggcgtgccggcggtgctggcctttctgcttagcggctatcgtcagcgcctgccgcgcctgtggcgggcgatgcgctggctgctggtgctatcgcaagtgctgctgttgctgtggcagccgatgctatggctgagcggcgaatctccctcctcgttgaccattgcgctgctggtcgcggatggctatgccctgtggtggctgttaaccagccgtcgcctgggcgcctgttttcaccagaccaccttttaatggcactttttgccgatcgtgaactccaacatgcgttgaatgactcagaaaggattgagatatgaaatcgctacgtgtaatgctctgtgcgcttccgctggcgctgaccggctgctccacgatgagcgcagtcaactggtcggcggcctatccgtggaactggtttggcgcttccaccgaggtgaccgagcagggagtgggtaaactgacggcctccacgccgctcaatgaacaggcgattagcgatgcgctgggcagcgactaccgtttacgcagcggaatgaagaccgataagggcaatatcgtccactactttgaagcgctgaaaaacaacagcgtggcgctgaccatcaatggcgacaacggtgctatcagccggattgacgtgcgtgatgcggatatcaaaaccgccagcggcgtgaaaatcggcacaccgtttagcgacctgtacagcaaagccttcggcaactgccagaaaggcagccatgacaacggggcggtcgtcgagtgtcaggccgaggggagccagcatatcagctatgccttcactggccactggagcggtccggacgagctgatgccctccgacgatacgctgaaaaactggaaggtcagcaagattatctggcgtcgctaaattgatctgaagagacacgacagctctgaaaaacggttacaatggcgcgttagcaacgcgacagcgttgtggttgcatcatttcaggaggagcgatgtctcaggttcagagcggcattttgccggaacattgccgcgcggcgatttggattgaagccaatctcaaaggggacgttaacgccctgcgcgaagcgagcaaaatttttgtcgataacgtggccaccttccaggctaaattccccgacgccaaactcggtgcggtggtggcgttcggcaataacgtctggcgtcagctgagcggcggcgaaggggcggatgagttaaaagatttcccggtctatggcaaagggctggcgccgtccacccagtatgacctgctgattcatattttatccgcccgtcatgaagttaacttctcggtggcgcaggccgcgctggccgcctttggcgacgctatcgacgtgaaagaagagatccacggcttccgctgggtggaagagcgtgacctcagcggcttcgtcgatggcaccgaaaacccggcgggggaagaaacccgccgcgaagtggcggtcattaaagacggcgtggatgcgggcggcagctacgtgttcgtccagcgctgggagcataatctcaaacagctgaaccgcatgagcgtgccggatcaggagatgatgatcggccgtactaaagacgctaacgaagagatcgatggcgatgaacgtccggtcacgtcgcacctgagccgcgtggacttaaaagaagatggcaaagggctgaaaatcgtccgtcagagcctgccgtacggcaccgccagcggcacccatggcctctatttctgcgcctactgcgcgcgcctgtataacatcgagcagcagctgctgagcatgtttggcgataccgacggtaaacgcgacgcgatgctgcgcttcaccaaaccggtgaccggcgggtattacttcgcgccgtcgctggagcgtatccaggcgctgtaatttttcctctcacccgtcccctctccccaaaggggagaggggacggtaaggtgcggctatgggatctgcgtgcggattcttttactccctctccctcagtcagaggggaggggtgagggcattggcggctcaggtgcttcaagtatcgcctccatcaccgcatcttcatgctcttcaaactcattattccagaagcgtaaaactcgccatccctcgctctgttgccagcgggtgcggcgtcatcgtgttggccgccgtccagttcaatcgccagccgtattgcgcagcaggcgaaatcgagaatatagggggcaacggggcgctggcggcgaaacgtatcgctagcaaaacggcggttgcccagtcagtaccctggtcgacgttctgcgggcgttaagctacgtctgagctgacgagcaaatatctgtgtgtttttcatataaacacagtgcacgcctggctgccgtttgtcacaatgacccgtctaatctgcgagccgctttcagctaagctttgccagttgcttattcccttttcgacttccaaatcgccaaacggtatataaaaccgttactcctttcgtacccgttataaatatgatgatcatcagaaaatgttcaacgttgataagggtgcgcaatggccgttaaatcactgaaaaaaggatatctggcgctggcggcttccatgctgctggtggcgcagacgcaggcgacggagctgctgaacagctcctatgatgtctcccgcgagctgtttgccgcccttaacccgccttttgagcagcagtgggcgaaagacaatggcggggacaagctgaccatcaagcagtcgcatgccggttcatccaagcaggcgctggctattttgcagggcctgaaggcggacgtggtcacctacaaccaggtgacggacgtgcagatcctgcatgacaaaggcaacctgatcccggccgactggcaaagccgtctgccgaacaacagctcaccgttctattcgacgatgggtttcctggtgcgtaaaggcaatccgaaaaacattcatgactggaacgacctggttcgctctgacgttaagctgatcttcccgaatccgaaaacctcgggtaacgcccgatacacctacctggcggcatggggcgcggcggataaagctgatggcggcgataaagctaaaaccgaacagtttatgactcagtttctcaagaacgtcgaagtctttgacaccggcgggcgcggagcgaccaccaccttcgccgagcgcggcctcggcgatgtgctgattagcttcgaatcggaagtgaacaatattcgcaagcagtatgaggcgcagggatttgaagtggttatcccgaaaaccaacattctggcggagttcccggtagcctgggtcgataaaaacgtcaaagccaatggcacggaaaaggcggcgaaagcctacctgaactggctctatacgccacaggcgcaaactatcattaccgactactactatcgggtaaacaacccgaaagtgatggatgctctgaaggataaattcccgcagaccgagctgttccgcgtggaagataagtttggctcctggcctgaggtgatgaaaacccacttcgccagcggcggcgaactggacaaactgctggcggcggggcgtaagtaatgtttgctgtgtcgtccaagcgcgtgctgccgggttttaccctgagccttggcaccagcctgctgtttgtctgtctgattttgttattaccgctcagcgcgctggtgatgcagctggcgcagatgagttgggcgcagtactgggatgtgatcaccaacccgcaggtggtggctgcctataaggtgacgctgctgtcggcgtttgtggcctcgatttttaacggcgtctttggtctgctgatggcctggatcctgacccgctatcgttttccgggccgcacgctgctggatgccttaatggacctgccatttgcgctgccgacggcggtagccggtctgaccctggcctcgctgttttcggtgaacggtatttacggggaatggctggcgaagttcgatattaaagtcacctatacctggctcggcatcgccgtggcgatggccttcaccagcatcccgtttgtggtacgcaccgtgcagccggtgctggaagagttggggcccgagtatgaggaagcggcggaaacgctgggcgccacgcgctggcagagtttccgcaaggtggtgctgccggagctgtcgccggcgctgctggcgggcattgctctgtcgtttacccgcagcctcggcgaattcggcgcggtgatttttatcgccggcaacatcgcgtggaagacggaagtaacgtcgctgatgatctttattcgtctgcaggagtttgactatccggcggcgagcgccatcgcctcggtgatcctggccgcctcactgctgctgctgttttccatcaataccctgcagagtcgctttggtcgacgcgtggtaggtcactaatggcggaagttactcaattgaaacgctacgacgcgccccgtatcaactggggaaaatggtttctgattggcgtcgggatgctggtctccgccttcatccttgtggtgccgatgctctacatctttatccaggccttcagcaaaggattgatgccggtgctggaaaacctggcgaacccggacatgctgcatgccatctggctgacggtgatgattgcgttgattaccgtaccggtaaacctggtgttcggtaccttgctggcctggctggtgacacgttttacctttccggggcgccagctgctgctgacgttgctggatatcccgttcgccgtctcgccggtggttgccggtctggtgtatctgctgttttacggctctaacggtccgctgggcggctggcttgacgcgcataatctgcaaatcatgttcgcctggccgggcatggtgctggcgaccatctttgttacctgtccgtttgtggtgcgtgagctggtgccggtgatgatgagtcagggcagtcatgaagatgaggccgcggtgctgctgggcgcgtccggttggcagatgttccgccgggtgacgttgcccaatattcgctgggcgctgctgtacggcgtggtgctgaccaacgcccgcgccatcggcgaatttggcgcggtgtcggtggtttccggctcgatccgcggcgaaacgctgtcgctgccgctgcaaattgaactactggagcaggattacaacaccgtcggctcgtttaccgccgctgccctgctgacgttaatggctattctgaccctgtttttaaagagtatgttgcaatggcgtctggccaatcagaaagaacgcgcgcaacaggagggaaatcatgagcattgagattgccaatattaagaaatcgtttggtcgcacccaggtgctgaatgatatctcgttggatatcccttccggacaaatggttgcgctgctggggccctcgggctccggaaaaaccaccctgctgcgaattatcgccggtctggagcatcagaccagcggtcatatccgcttccacggtaccgacgtcagtcggatgcacgctcgcgaccgtaaagtgggcttcgttttccagcactatgcgctgttccgccatatgacggtgttcgataacatcgcctttggcctgaccgtgctgccgcgccgcgaacgccccaatgcggcggcgattaaagccaaggtgaccaaactgctggagatggtgcagctggcccatctggcggatcgctatccggcgcagctgtccgggggccagaagcagcgcgtggcgcttgcgcgcgccctggcggtggagccgcaaattttgctgctggatgaacctttcggtgcgctggatgcgcaggtgcgtaaagagctgcgccgctggctgcgtcagctgcatgaagagctgaaattcaccagcgtgttcgtcacccacgatcaggaagaggcgatggaagttgccgaccgggtggtggtcatgagccagggcaacatcgaacaggccgatgccccggagcgcgtatggcgtgagccgtctacccgtttcgtgctggagtttatgggggaagtgaaccgcctgcagggggtcatccgcggtggacagttccacgtcggcgcccaccgctggccgttaggctataccccggcataccaggggccagtggacctgttcctgcgcccgtgggaagtggacatcagccggcggaccagcctggattcgccgctgccggtgcaggtcctggaggccagtccgaaagggcactacacccaattagtcgtccagcctctggggtggtatgacgaaccgctgagcgtggtgttaacgggcgacgaggcgccgtcccgcggcgaacggctgttcgtcgggctgcaaaacgcgcgtttgtacaacggtaccgagcgtatcgagccgcgcggcgagcttgctctggcggagtcggcctgatagcttaaatccatgtgcttttgccgggtgaggctctgcttacccggtctggaattatcacgcgtctgccaggccgggtaagcgaagcgccgcccggctttcttattgagtaaaaatcgtgaatacactcgaacaaaccatcggcaataccccactggtcaaacttcagcgtctgggaccggacaacggcagcgaagtgtgggtcaaactcgaaggcaataatccggccggctcggtgaaagatcgcgccgcgctgtcgatgatcgtcgaagcggaaaagcgcggcgaaattcagcccggcgacgtgctgatcgaagcgaccagcggcaacaccggtattgcgctggcgatgatcgccgcgctgaaaggctaccggatgaagctgctgatgcccgacaacatgagccaggagcgtcgggccgcgatgcacgcttacggcgccgagcttatcctggtcagcaaagagcaagggatggagggtgcccgcgacctggctctggagatggcccagcgcggagaaggcaaactgctcgatcagtttaacaacccggataacccctacgcccactacaccaccaccgggccggaaatctggcagcagaccgcggggcgtatcacccactttgtctccagtatggggaccaccggcaccattaccggcgtgtcacgttttctgcgtgaacagagtaaaccggtgaccattgttggcctgcagccggaggaggggagcagtattcccgggatccgccgctggccggcagagtatatgccggggatctttaacgcttcgctggtggatacggtgctggatattcatcagcaggatgccgagaacaccatgcgtcagctggcggtgcgggaaggcattttctgcggcgtcagttcgggcggcgcggtagcgggcgcgttacgcatagcccgcgaaaatcctggcgcggtggtggtggcgatcgtctgcgatcgcggcgatcgttacctttccaccggcgtgttcggcgaagaacactttagccagggggcgggcatttaatcatcaagcaggtcggtgccgtaggagttatcgacggtgcacagccagcgttcgccctgcttctgaaagacataggtggcgcgtcgcgtgaccttggatatcccgtccgccgtcgggatatccagccgggtctccataatcaccagcgcattgccgccgccttcaataacctccattttcccctgagtcaccaccagtcggtgctggaaatagtcggcaatggcgataaagactttgcagatattctctttccctctgaccaccatgcccggtttgacgaccagcgcggcgtcttctgcgtaataactcatcagggtatcgtaatcttcctgcgagatagcgcgatcgcaggcttcaatgaccgctttcagtgccaggtcagggtgatgcatctctggtgctccttgttgtgagcgatttttccgcctcggcgatcagggcatgcaggaaagactagcctgttgtcgtttatttttcattaatttgtcggcagctgccatcactccccgatacgttcggtggactgcctgcgtcagggggcgtctaaggcctgcgcaatatcggccgccaggcgggaaatctcagcgtcactcagacggcccagcgacaggcgtagcccgtgggagggcgtacggatgccaaacacctctccctcccggaccagccagccggcgcgggccaggcgtaaggcgtagggctggctcgccgctggcagcggcagccagaaattgaggccatcccctggcgtagcatggctgtagccgtaccgggccagcgccgccgccagtttctcattctgctggcgatagtgacgacgggtctccgtcatcgaggcgataaacgcctcgtcggtcaggcaggccagcgtcaggtcctgcagcagatggctgacccactggctgccggcgttaagccgcaggcgcagcgccgctgaagtagcggcatcgctggcgataaaggccagccgcaggtctggtccgagggtttttgacatcgagcgcaccagcgcccagcgttgggtgcttgcaggaagaggggagtgccatggcgtggccgacagcagggcaaaatggtcatcaacaatcgccagtacctgcggatagcgggctagcacctcccgcagggcatgcgcccgggtttccgtcaggctacagccggtaggattatgcgcgcgcggggttaagatcaccgcccgtgcgccgttgcgtaacgcctcctccaggccgtcaggatccatcccttcggcatccaccgccaccgggcagggggtaaaaccggcgtaacgcaccatattgatgctgctgagaaaacagggatcttccaccacaacgccgtcgccggggagcagcagagcgcacagcaggcgctccagggcgtctatcgccccgctggcgagattcaccgcaaagggaacggctatctctctggcaaaccacgcctcggcccattggccaagccgcggctcgatgggcgcattgccatacaggcggggcgtgcgggcaatctgtcccagatagcggggtaaatcaggcagtctggccggatcaggattgccgctggagatatcgttcagcggggtcgttgggtcacctccctccagcgccggcagtgtgtcccgcgctttaatggctgtaccgttgcgtccctgactgacggccagcccggaggtcaccagccgtttataggcggcggcgacagtgttgcgattcactgcaagctggctggcgagttcacgtaccggcggcagaacctctccgggctgcaacccgccgctctgcaccagatggcggatgttatcgaagatttcgctggcggtttttccggctaacattattgacctatgacaaaatggaatttagcataggacgaatcataatcagtgcgtgacccgctgtccagcggggggagaaaagatgggccagcaggatgatatacaatcagtgctctttcacgacaaaagccgggcgtcggaagtggatatcgtcgccgtgcagtcgcaggtagtctatggcagcgtcggcaacagcatcgcggttccggcgattaaacagcatggtctgcgcgtgctggcggtgccgacggtgctgttcagcaatacgccccattatgagacgttctatggcggcattattccggaagagtggtttgtcgggtatctgcaggcgctggaggagcgcgacgcgctgcgcgaactgcgtgcggtcaccaccggctatatgggcagcgctgtgcaaatcgaacgcctggcgcagtggctgacgcgcgtacgggcccgccatcccgggttgtgcattctcgtggatccggtcatcggcgatgtcgacagtggcatctatgtcaaggctgagatcccggacgcctatcgtcagcacctgctgccgctggcgcaagggatcacccccaatctgttcgaactggagacgctgagcggccagcgctgtcgcgatcggcaggaggcggtcgccgcggcgcgaagcctgctgtcggacaccctcaaatgggtggtgatcaccagcgcgccgggagaggccgattcgacgatcaatgtgctggtggtgacggccgatgcagtggaagtggtggttcacccgcgggtggagacagacttaaaaggaaccggcgatctgttctgcgcggagctggtgagcgggttgctttccggactggcgctgggggcagcgacgcaggctgctgcccagcgcgtgctggaggtgatgaactggactgccgcccaggggtgtgacgaattgatcctaccgccgctggagcaaagcagatgaaaagctatcggttagtgatccgccagcagggacgcattgttggtcattttgatacgacaggtgaggcggcgctggaggatgcctgcgtggcgcggtcgctgttcggcctggccggtggatatcagtgcgaactgctggtcgctgacagcgagcggcgaattctggagagcaccccggagggattgcgcgtcttgtcccgcgagaagtgctatcgaccggtaacctgcgcggtataaaaaaatggcgcctttcggcgccatttttatgcagcaagcattacttcttgatgcggattaccggggtttcacccacggtcacgctaccggacagtttgatcagctctttgatctcgtccatgttggagataaccaccggcgtcagagtcgacttggctttctcttccagcagcggcagatcaaattcgataaccggatcgccgactttcacgcgctgaccttcttcagcgatacgcttgaagccttcgcctttcagttcaacggtatcaataccgaagtgaacgaacagctcgatgccgctatcagattcaatagagaacgcgtggttggtttcgaaaattttaccaatggtaccgtctaccggcgcgaccattttgttgccagtcggtttgatggcaatcccatcgcccacaattttttccgcaaaaaccacatccggcacgtcttcaatgttgacgatctcaccggagaggggagcaacaatctcaatagttccggtgtctttcttgtcatcagaaaccagagatttcaatttatcaaacaaacccatgatcttctcctaagcagtaatttgggccgcgcatctcgtggattagcagattgttttttcttcaatgaacttgttaaccagcgtcattaactcgtccgttgtcggttgagcaagagcctgctctgctaatactttcgcatcttcgaagttcgtattacgaataatcttcttgatgcgcgggatggaaatggcgctcatagagaattcgtccagccccatacccagcaacagaagtgtagcacgttcatcgcccgcaagctcaccgcacatgccagtccatttaccttcagcgtgagaagcatcaataacttgcttaatcagattcagtacagacggtgacatcggctggtaaagatgtgaaatcatatcattaccacggtcaactgccagagtatattgcgttaaatcattggtgccgatactaaagaaatcaacttctttggccagatgacgagcaatggtcgccgcagccggtgtttccaccatcacgccgatctcaatggattcgtcaaatgctttaccttcgtcacgcagttcctgtttgtagatttcgatctctttcttcagcgcacgcacttcttcaacagagatgatcatcgggaacataatgcgcagcttaccgaaagcggaggcacgcaggatggcgcgaacctggtcgcgcaggatctctttacgatccatcgcaatacgcacggcacgccagccgaggaacgggttctcttctttcgggaagttcatgtacggcagctctttgtcgccgccgatatccatggtacggacgataacggcctgagagccacaggcctcagccaccgctttataagccgcaaactgttcttcttcagttggcagcgcgtcacggtccatgaacaggaattcggtacgatacaggcctacgccttcggcgccgttgcgctcagcaccttcgacatcgcgaacggtaccaatgttggcgcagacttcaacctgatggccgtcgagggtaatcgccggcagatctttcagtttcgccagttcggctttttcttccgcaacctgagcctgcagactacgcagcgcttcaatttgctcgttagacgggttgatcagaacctggttgttcaccgcgtcgagaatcagatagtcgccgtttttcacctgcgccgtgatgctgccggtgcccacgatggccggcaattccagggaacgcgccatgatagaggtgtgggaggtacgaccgcccgcatcggtgatgaaacccagcacttttttcagattcagctgtgcggtttcagacggggtcagatcggcggcgacgaggatgacttcatcctgaatcgcactcagatcgatgattgccagaccaaggatgttgcgcagcaggcgcttaccgatatcacgtacgtcagccgcacgttctttcaggtattcatcatccagctcttccagggcagtggcctgaccgtcgataacttcattggctgccgcgtcggcagtcatgtgcttatctttaatcagggctatgatttcctgctcaagctcctcatcttccagcagcataatatgcccttcgaagatggcttctttttcttcaccgaaagtttcaccagctttggttttgatgacctccagctgggcggaggccttggcgcggccgctcaggaaacgttcgacttcctgatcaaccttatcggcagaaattttcttccggtcgatgacaatttcatcttccttcagcagcaatgctttgccgaaggcgatacccggggatgctaaaatgcctgaaatcataaccctaccttacttgtgactgatatgaaaaagaacccgtgaacttactcgagttcagccatcagtttaaccagatgctcaacagctttctgctcatcttcgccttcagcggagagggtcactacggtgccctgggtcaggcccagagtctgcagtttgaacaggcttttggcgctggcgcttttgccgttggaggttacagtgatctcagaagtgaagcctttagcttctttaacaaactgagcagcagggcgggtgtgcagaccgttcggagcggtaatggtaacttcttgctggaacattatatttccccaacttataggtttagtgttgtggacctaaagtctagtctaacgactcgactttagcctgtattgttagcgccggcgttacgtttccggccttggcgtcggcagcgcctggcgctgcgaagacctgcgggccattgacgtctagcacgtcattaaacattatgccgcgaaaggaagacttgaaccaaatcataaaatcgattcagctggcggaaatcctcttctgaataatttcgcgcatcaaaataaatgtgctggttaaataccagaccctacgaggtgaatcaatgccaggaggggtaaaactttgacgtgtgccacaaaaaagcacccgaaaaggtgcttttttacacattatttacaagctggcactactgttgcagctctttctcagtgaagagatcggcgaacagcgcggtgcttaaataacgctcacctgaggaaggcaggataaccacaatattcttattggtaaaggcctcatcttcctgcagcttcagcgcggcggcaacggcggccccggaagagatacccgccaggatgccttcttcttccatcaggcggcgcgccgtggagatagcttcctcgttggtaatgccgatcactttgtcgaccagcttcagatccaggttgccaggaatgaagccggcgccgataccctgaattttgtgcggacccggcttgagctcttcccccgccagcgcctgggcgatcaccggggaatcggtcggttcaacggcgacggtgatcagatcttttttacctttggtgtttttgatatagcggctgacgccggtcagcgttccgccggtacctacgccggagataaacacatccacctgaccatcggtatcttcccagatttccgggccggtagtcttctcgtggatttccgggttagccgggttgctgaactgctgcagcagcaggaattgttccgggttgctggcgacaatctcttccgctttctggatagcgcctttcatgcctttggcgccttcggtcagcaccaggttggcgcccagggctttcagcagcttacgacgctcgatgctcatggtttccggcatggttagcgtcagtttgtagccgcgggccgccgccacgtaggcgagggcgataccggtgttgccgctggtcggctcgaccagttccacgccaggtttcagaacgccgcgcttttcagcatcccagatcatattggcgccgatacggcattttacgctaaagctcgggttacgagattctacctttgccaggatacggccattaccgatgcggttcagtcgtaccagcggcgtatgaccgatagtcagggagttgtcttcaaaaatcttactcatggcccgtccttaactgtatgaaatttgggggtacggcatcagcatacccgcttaaagaatatgcggaagtaaggatttagcatatctatatgcggaagggaaataatgataagcaagaaggaataagcgcgatataagggagcggcctttgccgcccccaagtgaaggtgttaccgctatttccagctggcgtgtctatcgcgatagcaatcgacccacatggcggtggcgccgcagatagccaccggaaggatcaccaggtttaacaccgggatcattgtgaacaggctggtgagcgccccaaactgcatattcatcactttgcgactgcgcagcgcttcgcgcatggttttgaagggaaccttgtgattatcaaagggataatcacagtattgaatcgccagcatccatgcgctgaacaggaaccagagtaccggggctaccgtctggccaacgccgggaataaagtagagcagcaacagcacgatggcgcgcggcagataccaggccagcttctgccactcacgcttcataatccgcggaatatctttcatgatgccaaagacgccgacgtccggcggggtagcgccggtcaggcgcgcttccagctgttccgccagcaggccgctgaacggcgcggctatccagttggcgagcgtcgaaaagaagtagccaaacaccagcaggattgatagcactaccaccggccacagcaggtagtttagccactgcagccagtccggcacatggctcatcagcgaggggatccagctgccgagacgggtaaacagccaccagaaggcagcgcccatcagcagcacgttaaccagtaaaggcaggaagacataacgccgtatgcccggcagcccgatgagtttccagccctgcgaaaaataataaacgccgctgcgcggggtcggtgcggatgatgaaaccatagccaggcattgctccttttttaacatccggtgtgaatgctcgcttattttatcgggtcgtcagacaataaccagttaggaaatgttcgaaaaaacagcaaaaagcacgatttagttcatctttatgtggtgaaagcgaccgacgcacttgcacttgaggtaatcggcaaatactcttagtgagtaaatgtttgccgtggtggcaaggtgttagaacaacagagaatataatgatgcaggatttgcgtctgatattaatcattgttggcgcgatcgccataatcgctttactggtacatggtttctggaccagccgtaaagaacgttcttcgatgtttcgcgatcgcccactgaaacgtatgaagtcgcgcgacgatgagtcggaaaacgacgactttgatgataatgttgaaggcgtaggagaagtccgcgttcatccggtgactcacgccccgcacggcgcgcatggggagcatgaagcccctcgtcaggcgccgcagcaccagtaccagccgccttacgagcgccagatgcagcagcctgcgcgtcctgaagaaccggttcgccagccgccgcagccgccgcgccaggccccggttccaccgcagcaacagcctgcgccgcatgcggctccgcagactggctggcaacagccgcaacctgcgcagccgcccgtacaaccgcaacaccagccgcagcctgttgtgcagcagcctgtcgcgccgcaaccggtgacgccgaccgtcgctcagccgcagccagccgccccgcagcagcctgcgccacagcctgttgccgcgtcgcagcccgccgtcgcggaaccgcagccggtagagccgcagcagcccgccgcgccgcagccgaaagagcgcaaagagacggtcattgtgatgaacgtcgccgcgcatcatggcgcccagcttaacggtgaagtgctgatcaacagtatccagcaggccggctttaagtttggtgaaatgaatattttccaccgccacctaagtccggacggcagcggtccggtgttgttcagtctggccaacatggtgaaaccgggaaccttcaatccggacagcatggcggatatgatgacccctggggtgactatctttatgcaggtcccttcctacggcgatgaactgcagaacttcaagctgatgctgcagtctgcgcagtatatcgctgacgaagtgggcggcgtggtgcttgacgatcagcgtcgcatgatgacgccgcaaaaactgcgtgaataccaggatcgtattcgcgaagtgaaagacgcgaacgcctgacgttccgcgttaactcaatcctttctcaacccccgcctgtcgggggttttttatcattgatggtgtgatatggaaccaatcgaacaacaactgactgaactgcgaaccacgcttcgccatcatgaatatctgtaccacgttatggacgcgccggaagtgccggatgcggaatatgaccgcctgatgcgcaagctgcgcgagctggagagccagcacccggagctgattaccccggattcgccaacacagagggtgggggcggcgccactcaccgcctttagccagatccgccatgaagtgccgatgctgtcgctggataacgtgtttgacgaagagagctttctcgccttcaacaagcgggtacaggatcgcctgaaaagcacagatcatcttacctactgctgcgagcttaagctcgacggcctcgcggtgagcattctctacgaaaacggcgtgttggtgcaggcggcaacccgcggcgacggcaccaccggcgaagatattacctctaacgtgcgaactattcgcgccatccccctcaagctgcatggcgagaatattcctgcacgccttgaggtacgtggggaagtgttcctcccgcaggccgggtttgaaaaaatcaatgaggaagctcgtcgcaccggcgggaaagtgtttgctaacccgcgtaatgcggcagcgggttcgctgcgccagctcgatccgcgcatcactgcgaagcgaccgcttactttcttctgctacggcgtgggcgtgctggagggcggcgagctgccggccagccactcggctcggttgctgcagttcaaagcatgggggctgccggtgagcgatcgcgtcaccctgtgccatacccccgaggaagtgcttacttactatcgtaaagtcgaggaagagcgtccccacctgggctttgacattgatggcgtggtgatcaaagtcgattcgctggcgctgcaggaacagctgggtttcgtcgcccgcgcgccgcgctgggccgtggcctttaagttcccggcacaggagcagatgaccttcgtccgggacgtggagttccaggtgggccgcaccggggcgattacgccggtggcgcgtctggagccggtccatgttgccggcgtgttggtgagcaatgccaccctgcataatgccgatgaaattgaacgcttaggcttgaaaatcggcgacaaggtggtgattcgccgggcaggcgatgtgatcccgcaggtggttaacgtggtgctttccgagcgtccggcggatgcccgggatgtcgtcttcccgacccactgtcctgtatgtcagtcagacgttgaacgggtggaaggcgaggcggtagcccgctgtacgggcggcctgatctgcggcgcgcagcgcaaagagtcgctcaagcacttcgtctcccgtcgcgcgctcgacgttgacggcatgggcgacaagatcatcgaccagctggtggagaaagagtacgtccataccccggcggatctgttccggctgacggcggggaaactgaccgggctggatcggatggggccgaagtccgcgcaaaacgtagtcaacgccctcgagaaagccaaagagacgaccttcgcacgcttcctctacgccttaggtattcgcgaggtaggagaagcgacggcggcgggcctggcggcgcatttcggcactctcgaagccctggagcaggcttccattgaggagctacagaaagtccctgatgtcggcatcgtcgtcgctacccataccttcaacttctttgccgaagagagcaaccgcgatgtcattgcgcaactgctggcggagggggttcgctggcctgcgccggtggtggtgaaggcggaagagattgatagcccgtttgcaggcaaaaccgtggtccttaccggcagcctcagccagctgtcgcgcgatgacgccaaagcgcgtctggtggcgctgggggcgaaggtggcaggcagcgtgtcgaagaaaaccgacctggtgattgccggcgaagcggcggggtctaagctggcgaaagcgcaggagctgggcatcgaggtgattgacgaagccgaaatgatgcgtctgctgggagaataacgtggataaagcgcagctggtcgagatagccaataccgaaatgccgttcggtaaatacaagggacgtcgcttaatcgatgtcccggaagagtatttattgtggttcgcgcgtaaggatcaattccctgccgggcatcttggcgagctgatggcgttgaccctgctgattaaaactgaggggctgagcgatcaggtccagcccctgaagaaagcgcgttaggctttggccgcgttggccttttcctcagcgagacgcgcatcggtttgctgcttgtagcgccgcgccagcaccgcgcagaccatcagctggatttggtggaagatcatcaacggcagcaccatgatgccgaggatggaggtcgggaagagaatattggccatcggaatgccgttggccaggctctttttcgaaccgcagaagacgatggtaatctcatcggctttgttaaagccgcagcggcgggcgacaaagacgttgaccgcgatgacgatggccagcagcaccaggctgaccaccacgataaacagcaacgatcccagaccgactttatgccagatgccattcaccaccgcctcgctaaaggcggagtaaaccaccaacagaatcgaggtctggtcggtcttaccaatccacttcttatgcttcgccacccagtcgccaatccacggccgcgataagtgaccgagcacgaaaggcagcagcagctgcagcataattttaccgacctgctccagactgccgcctgcgccgtgaaggttcatcaggacccccaccagtagcggggaaacaaagatccccagcaggctggaggccgaggctgagcaaaccgcagccgcgacgttgcccccggccagcgaagtaaaggcgatagcggattgcacggtggccggcagaatgcacagatagataaagccgctgtagagcatcggatcgacattcaccggcgcccaccaggcaaacagaaccccgagtagcgggaagagaataaaggtgctgcacatcacccagagatgcaaacgccagtggctgccgccggcgataatcgcctcccgggagagtttagcgccatgcataaagaacagcagcgcgatggcggcggtggtcagatgttcaaagaaggggacgaaagcgccacgggccgggaagaatgaggccagcaggacaacggtgattagcgttgccgtaaacggatcgagaatacggaaaagtttcataaacgctcctgaaaagagatgcgctattgtgctttttttcatttgagaaataaaattgatttattgcatctattcatgaataaaaaagatgaattactctctgcgtcagttaaaagtatttgtcaccgtcgcccgggccagcagcttcagccgggcaggggagatgattggcttaagtcagtcggccgtcagccatagcgtcaaggagctggagcatcagaccggcgtccgtctgctcgaccgtactactcgcgaagtggtgctcaccgaggcgggtcagcagctggcgggcaggctggaacgtttgcttgatgagttgacgattaccctgcgtgacgccgggcgggtaggccagcagctgagcggcaccgtcaaggtcgccgccagtcagacgatttccgcccaccttattccgcagtgtattgctcacagcaatcgtcgttatcccgatatcgattttgtgctgcacgatcggccccagcagtgggtgctggagagtatccgccagggggaagtggattttggcatcgtgattgatccgggcccggcggcagaccttcagtgtgaagtggttctggcggaaccatttttgctgctctgccgggaggatcatccttttgccagcctgacagaagtgccgtggcaggcgctgcaggatgaaaggctaatcctgcaggattatgcgtccggcagccgcccgctgatcgatgcggccctcagcagactggctatccgggcgaacatcgtccaggagattggccacccggcaacgctgtttccgatggtagaatcgggaattggcatcagcgttctgccggcgctggcgctaccgttaccgcaggggagccatctgacggtgaaacggctgactccggtgatggagcggcagctgatgctggcatgcaggaaaaatcgctcgctgtcgaccgccgctcaggcgttatgggaaattgtgcgtgaagaaggggagaatttaaccgccgccagggttgaagatccgctatatcagcgctgacaggggggattgctgcggagggtctcgtggcagggccatgttccgcgcatagcaaaaaggcgcctttagggcgcctttttacattggtgggtcgtgcaggattcgaacctgcgaccaattgattaaaagtcaactgctctaccaactgagctaacgacccgaagtggtgggtgatgacgggatcgaaccgccgaccccctccttgtaagggaggtgctctcccagctgagctaatcacccacttcggtacttcacattttgacagaaaatccagctggcgagaaagtggtgggtgatgacgggatcgaaccgccgaccccctccttgtaagggaggtgctctcccagctgagctaatcacccacttctcaattttctgttctacacggcggagactacgttaagtagtggtgggtgatgacgggatcgaaccgccgaccccctccttgtaagggaggtgctctcccagctgagctaatcacccccgctgtgtggagtcgcattatagggagagttgaaaatgagtcaacgccttttctaaagaattcgttcgttcgtcgtaaaattaaacaaagcgatcgcgaaaccggcgccatagcatgatttataaacaaaaatggcaaaccgtgacgttccgatgggaacaacattgaggaatcagcccacggtgttagaatattgacccataatttccaccggacattgccggctatcggcatctttattaaacgtaaggccaattcatgaaaatcaaaactcgcttcgcgccaagcccaaccggctatctgcacgttggcggtgcgcgtactgctctctattcctggctttttgcccgtaaccacggcggtgagtttgtgctgcgtattgaagacaccgatctcgaacgctccaccccggaagcaattgaagccatcatggatggcatgaactggctgaatctgcaatgggacgaaggcccctatttccagaccaaacgtttcgatcgttataacaacgtaatcgatgagatgctggaagccggtaccgcttacaaatgctattgctcgaaagaacgtctggaagcgctgcgcgaagagcagatggcgaagggtgagaagccgcgttacgatggccgctgccgccatagccacgagcaccatgctgacgatgagccgtgcgtcgtgcgtttcgccaacccgcaggaaggttcggttatttttgacgatcagatccgcggacctatcgagttcagcaaccaggaactggacgatctgatcattcgccgtaccgatggttccccgacctataacttctgcgtggtggtagatgactgggatatggcgatcactcacgtgatccgcggcgaagatcatatcaacaacacgccgcgccagatcaacatcctcaaagcgctgaatgcgccggtgccggtttatgcgcacgtgtcgatgatcaacggcgatgacggtaaaaaactttccaagcgccacggcgcagtgagcgtgatgcagtatcgcgacgacggctacctgccggaagcgctactcaactatctggtgcgcctgggctggtctcatggcgatcaggagattttcactcgcgaagagatgattgagttcttttcgctgggcgcggtgagcaaatccgccagtgcctttaacaccgataaactgctgtggttaaaccatcactatatcaataccctgccggcggagtatgtggcaacgtatctgcagtggcatatcgagcaggaaaatatcgacactcgcaacggcccgcagctggctgagctggtgaaactgctgggcgagcgttgcaagacgctgaaagagatggcccagagctgccgctacttctatgaagagttctctgaattcgatgtcgacgccgcgaaaaaacatctgcgtccagtggcgcgtcagccgctggaagtggttcgcgataagctggcggcgattagcgactggacggcggaaaacgtccatcacgcgattcaggcaactgctgatgagcgggaggtggggatgggtaaagtcggtatgccgctgcgcgtggcggttaccggggcagggcaatctcctgcgctagacgttactgtccatgctatcggtaaatcccgtagcgtagatcgtatcaataaagcgctggcttttatcgctgaacgcgaaggccaggcgtcctgacggcgacgcagctgaaacaacggcaggttaccctgccgttttttttgcctgttattccggactggcgatgccgaggcgggcaagaaaaccgctaatcccttcccgggccagcagatcgcggagctgcagctgttctgccggagtcatcagctgtagggtttccgtgatttgccgccagatcgcgtctgcctcattgaccaggtatgcacctggcgattccgcgagatgattgtcggtaagcagatggcgtctggcagggatgttggtcagaaactcgcgtaccggttggtcgataaccaccagtcgcgctcgcccccctttaacgccgggtattgcttcggtgcgccattgtttctcgcgaacccagcgattgatcgtttgtctggccagccccaggcagtcggcaagctctgcgggcgtcattttatctttcagtttcatcatggtttaccgatcgcggatccctaaccgaagcagtaacccggtgatcccctcgcgcagcaacaaagacataagctgcttctgctcgctgggggtgagttctttactgagggtcagcagcagcgattccagatcgctatcatggggagaatagatgccgggcgtctccgccacgcgctgggcgctgcggataaactccctgacttgctcattgacatggaccaggcgcgctttgccgccctggacgccaggtcgcggagaggtttgccagccttctttccgcacccacttattgatagtttgccgactgtagccggttagatgggcaatttcttcaggtgtcattcgttccttgagcatactatttcctgagtaaatgtatgggaattagctgcccatgttatagcatccttttacgtgaaaaggtgacctgtttaacttctgactgcgataaggctcgcaatgtcagcaagttgcctgctttttcagcgattgaatcgggaaggataattttgccgttgacacctgagcgaggaattcatattatgccgcccgtcaacacgacacgctttacgttacggggctatagctcagctgggagagcgcttgcatggcatgcaagaggtcagcggttcgatcccgcttagctccaccaaattctgcacccagcggatttggttcgtaaagaagtcctgtggggctatagctcagctgggagagcgcttgcatggcatgcaagaggtcagcggttcgatcccgcttagctccaccaaaattcagaaccctcgcttccgcgggggtttttgtttttagcgggtttcatgtaaagcactttctggttacgtcagttaatctccagcaattaaaatcgaaagtaatttcagactttttcctgataattcgccttgcctgccctaaataagcaacataacatttcccccattaaacgtgatgaggtttctggagttttaattaacaataatgcttgataaaattaacattaatatcaaaaaaactctattggcctttatcatttgtttagtcgctattccgctggctcgttttatttcaccgcaaacgataattgacggcaaccttatttatattgcctggctgccaatcagcgtgatgttttctgttatttttatctttggccgctatgcaattgcgccattaattctcgcgtttgccatcaccaatagttttctcattaaattaacgctgccgcaggcgtttatcttacttttttgtcaactgttcgccgtgtttgtctcctgcgctattctgcgactgttggtggggaagcgctggcgctgcggtccaacggcaaagcatatgggggcgcggatcttctggggcggcttcttcgcgccggtgctcctgaaaatcaccatgtatctcgccggacaatattttgcgtttccattagctattaccagttactttggtagtatgccgttgatttatactgtaatagatatccaaagtttaatcagtgcggcattaatttttacgacgtttctttattatccaatgcggatgattatcagtccgcgctacgcccgacgtttctggcagcaggaatgtttaccgtggctggcaccgcaatatcgctcctttaccctatattggtttatcgcgttggcggtgatattaacgctattgtgtgcgccgtatcagtctgaatttattgccggttatttagttccggttatttttattgtctactttatcggtatcagtcgaataggccatgcgctattgcgtatttcatggtctgtctcggcctttttgctggtggtatataacaaaaactttctccagggggtgcaaagcgagtattcactctcctttgtgctgtcggttctgatctcctttactatctgtttgttttatatggccgacatctatgcccgcagcgaccgcaacaaacgccgctggcgtagccaggcggaagaggatccgctgaccggcttgcctaacctgcgcgcgctggagagccatttacagagctgtcctcagcaggctatctgcagcctgcgtattgataatctcgactttctcagtcggcattatggtctgatgatgggggtggactgtaaacggcagattattcgggcgctgcaaccgctgctgggagcggcggataaagtcttccaggtaccgggcagcgaactgatcctcgtgcttgatggaccggagccgtcgtcccgcttgaatcatatggtcgcggtcctcaaccacaaaaagttcagctggcacaatcagccgctggatttggagtttggcgcggcctggggccgcgatgacggccagggtgagggactttaccagatgctgggccagctaagctggctttccgaacaggcgggcagtgaacgtcgggtgctggcgctggacgaggagcaggatctggtggtggatcaaactaccgagcaggtgcgcctcctaatgcgcgtcaagcaagtgctcaaagatcgcgcgctgatgctctatgcgcaaccgattcagaatccggagggggagggttatcatgagatcctcacgcgcatgcgctgtggcgatagcgtcattatgcccgaccgattcattccgctgattgtgcagtttaacctcagccaacgttttgacatgctggtgctggagaccttgttcagtatgctccataagcatcccggccagcgattctcggtcaacctgctgcctgcaactctgatgcaaaagaacagcgcagggcagattatcgcgctgtttcaacgctatagcgtctcgccagaacttataactattgaggtgaccgaagagcaggccttctctaatgcggacaccagtcggcaaaatcttgaagcgttgcgcgcgtttggctgcgccatcgctattgatgactttggcaccggctatgcgaactatgaacgtctgaaacatctacaggccgatatcattaagattgacggctgctttgtccgcgacatcctcacggacccgctggacgccatcatggtgaaatcgattgtcgagatggcgcgggcgaaacagatgagcgtggtggcggaatatgtcgaaagcgaaccgcaaaaagcgcgcttgctggagctgggcgtgaattatctgcagggttatctgatcggtaaaccacagccgctgggtgaatgtcgggcaaaaaaaagccgggcattgcccggctcagatgactgacgtctgttacagaaccagcgccgcaatcgaggcggacagcacgctaaccagcgtggagccgtacaccagcttcagaccgaagcgagaaactacgttgccctgttcttcgttcagacctttgatcgccccggcaataataccgatagatgagaagttggcgaaggagaccaggaagatagagataatgccttccgcgcgcggggagagcgtcgaggcaattttctgcagatccatcatggcgacgaattcattggagaccagtttggtagccataatactgcccacctgcagcgcttcgcttgccggcacacccatcacccaggcgaccgggtagaagatatagccgaggataccctggaaggaaatgctatagccgaaccaaccggtcacggtggcgaacagggcattcagcgccgagatcagcgcgatgaagccgatcaacatcgccgccacgataatcgcgactttaaaacctgccagaatatactcgcccagcatctcgaagaagctctgaccttcgtgcagattcgacatctgcagattttcttcgctctcttccacgcggtaagggttaattaatgacagaacgataaaggtgctgaacatgttgagcaccagcgccgcaacgacatactttggctgcagcatggtcatgtaagcgcctacgatggacatggacacggtggacatcgccgtcgccgccatggtgtacatgcggttgcgcgacattttgccgagaatatctttatacgcgataaagttttccgactggccgaggatcaacgagctcacggcgttgaaggactccagcttgcccatgccgttaactttcgacaggacggtaccgatcgcgcgaatgacaatcggcaggatacgaatatgctgcaaaatgccgatcaaagccgaaatgaagactatagggcacaaaactttgaggaagaagaaggccaggcctttatcgttcatgccgccgaacacgaagtttgtcccttcgttggcaaacccgaggagtttttcaaacatctcggaaaatcctttcacaaaacccagaccaatatcggagttgaggaagaaccaggccagcaggacttcaatgacaagcagttgaacaacataacgaatacggatcttttggcggtcatggctgaccaacagggccagtatagccaccacaacgatcgcgaggacaaaatgcaagacgcggtccatagttgctccaaatatgaggcaggttaaatttccgtgcacattctatgcaacggctttaaagaaaacgagatcaattgcacactattgcaaggaactgtgaccaatggcaaaaatagtgatccaacatccacttttgttatgttacgtaaaggttttaaaagttgcattcttgtactactcttaatagcgggctggatctcgttttctgacgcccgtatttcatttccggccagctattgttcccttctatcacagcaatcattatctccattctaaatgaacttgataatcattcgcattttgatagcatgaaacatagcaaaggctatatttccagaggcagaagatgactagcagtcgcgttgagaatagcagtagtcgcgccgcgcgcaaggtgaagctcgccttaatgggcccggctttcgtcgctgccattggctatatcgatccgggtaatttcgccactaacattcaggccggcgccagctttggctaccagctgctgtgggtcgtggtgtgggctaacctgatggcgatgctgatccaggtgctttctgccaaactgggcattgccaccggcaaaaacctggccgagcagatccgcgaccattacccgcgtcctgttgtctggttttactgggtacaggcggaaattatcgctatggccaccgatctggctgaatttatcggcgccgcgattggctttaagctggtgctcggcgtgtcgcttctgcagggggcggtgctgaccggggtggcgacttttctgatcctgatgctgcagcggcgcggacaaaaaccactggagaaggtgatcggtggattgttgctgtttgtcgccgtggcctatgtcgtggagttgatcttttcccagcccgcgctggctcctctgacgaaagggctggtgatccccacgctgcccaacggggaggcggtattcctggccgccggggtactgggtgcgacaattatgccgcacgtcatttacttacactcatcgctgactcagcatctgcatggcggaacgcgaaaagaacgctataacgcgacccgctgggatgtggcgatcgccatgaccattgccggattcgtcaatctggcgatgatggcgaccgctgcggcggcattccactttaatggccataccggcgtcgccgatctcgatcaggcctacatgacgctggagccgctgctgagccacgcggcggcgaccatctttggcctcagcctgattgccgccggtttatcgtcgaccgtggtgggcactctggcaggtcaggtcgttatgcaggggtttatccgctttcatattccgctgtggtttcgccgggcgatcaccatgctgccgtcgtttgtcgtcattctgctggggctggatcctacgcgcatcctggtaatgagtcaggtgttgctcagctttggcattgcgcttgccctggtgccgctgctgatatttaccagcaatgcgaagctgatgggggacctggtgaatacccgttgggtgagaggcatcggctgggcgatagtcgctattgtggtgagcctgaacggctggttaatagtggggtcgctgctcggggtggattaattgattcctgatgctgaataaagtaaaggggagccgatgggctccccttttcgtttgttagtgatggccatgtccatgaccgtgaccgcgcccacccgggccgcgtccccagccgccgcggtggtcatcgcggtcgttccagccagcacgatagccgcgctcccaggctttatctctgcctttgtaccagcctttgtgccagccgttgtcatgacgatgccaacggttatcacgccattcatagtgacgacgccagtaatcacggtcgcgccagctgccaccgtcccagtagttaccgtaattgtcacgatcgcctatttgtaattttaccgacggcagcagggtgatttcaccagcgttagcgaccagtggccctgcggccagcagtactgctgccagaatcagtgacctgaacatactcttctccttcacgatcggggccgtaagcggcctgttaacctgatattacgggccggtaaagacccaccgcatcggacgaactccgaaagcgcaggaaagagcactttttgctaaagtaacatttgctttacagcgcaaggatggcgtcgatggccgcgccctcctcggtggtgaaatggcgattctgcagcatgccgacggcatcatccagttgcgcggttttgctggcgccgatcagcaccgaggtgactttctcttcgcgcaacacccaggccagcgccatctgcgacagcttctgcccacgcgcttccgcctgcctgttaagctgacgaattttttctaatcgggcaggagtcagttgttccggctgcagaaaacgactgctgctggcggcgcgcgagtcggccggaatgccgttgagatagcggtcggtaagttgcccgccggccagcggtgaaaacgctatgcttccaatcccttccgtctgcagaaaatccagcagtccttcttccacgccgcgttcgaacatcgagtagcgaggctggtggatgatgcagggggtgccgaggtcgttaaggatcttcaccgcctcccgcgcctgggccagaggatagttggagatcccgacatatagcgctttaccctgacgaaccagatgatcgagcgcacgcatcgtttccatcagcggcgtctgtggatcaggccggtgatggtaaaaaatatcgacgtattccagccccatgcgtttaaggctctggttaagactggctaccagatattttcgcgatccccagtcgccgtaagggccgtcccacatcgtgtaacctgctttagtggagatgattaactcatcgcgataaggcaggagcgactctttcaggatgcggccaaagttgctttccgccgagcccggcggcggcccatagttgttggccaaatcgaaatgggttataccgaggtcaaaagcgtgcaggagcatctgccggctggtttccactcgcgtttcatcgccaaagttatgccacaggccaagggaaatggccggtagttgcagaccgctgcggccgcagcgacggtactccatcgtttgatatcgcgtggtgcttgcctggtaaaccattcttcctccgccgacaaaacagggtgtgtatacgtttacactaaacaatgttctgcgtggagtacactgctttttctgcgtaattattgctttacactgccattatcacctcccatctggacaggcggatcgcttattcaatactcaaattacacctgcactaaaatgaggataatggatatgcaaccgacctacactattggggattatctgctggatcgccttgtcgactgcggtattgaccgcttgttcggcgtgccgggagattacaacttacagtttctcgatcgcgtcatcgcgcacagcgccttggggtgggtcggctgcgccaacgagctgaatgcggcatatgccgctgacggctatgcgcgcatcaaaggggccggtgcgctgctgaccacctacggcgtcggcgaattgagcgcgctgaacggcattgcgggtagctatgcggaacatattccggtattgcatattgtcggtgcgccctctaccggcgcccagcagcgcggcgaactgctgcaccataccctcggcgatggcgattttcgccatttcgcccgcatgagcgagcagatcacctgtagccaggcgctgctgaccgccggcaacgcctgccatgaaatcgaccgtgtgctgcgcgatatgttgacgcatcatcgccccggctatttgatgctgccagccgatgtcgccagagcggcagcgattgccccagcccagcgcttgctggtggagcccgctccggcggatgaaaaccagcttgccgggttctgcgaacatgccagccgcctgctgcggggcagccgacgcatttccctgctggcggacttcctggcgcaacgttatggcctgcagaagacgctccgggagtgggtggcgaaaacgcctgtcgcccatgcgacgatgctcatgggcaagggattgtttgatgagcagcagagcgggtttgtcggcacctacagcgggattgccagcgcgccgcagacccgggaggcgattgaaaacgccgacaccatcatctgcattggcacgcgcttcaccgacaccatcaccgcaggatttacccaacatctggcgcgggaaaagactattgagatccagcccttcgccgtcagggtgggcgatcactggttcagcggggtgccgatggataaggctttggccgcgctgatgacgctttccgccccgctggcggcggagtgggctacgcctcaggtcgtggcgccggaggctgaggagggcgctgaaggcgagttgacccagaaaaatttctgggcgacggtgcagggcgccctgcgtccgggggatattattctcgccgatcaggggacggccgcctttggtattgcggctctgaagctgccctctgaagcatcgctgatcgtccagccgctgtggggctcgattggttttactctcccggccgcctatggcgcacaaaccgcggcggcggagcggcgggtggtgctaattgtcggcgatggcgcggcccaactgaccattcaggagatgggctccatgctgcgtgataagcaaaagccgcttattctgctgctgaataacgaagggtataccgtggaacgggcgattcatggtccagagcagcgctacaatgacatcgctctgtgggactggcagcggctgccggaagccttcgcccctgacgttgcttcgcgctgccggcgggtcactcagacgtctgaactgcgggaggcgatgacggagagcatcacctccgataccctcaccctggtagaagtgatgctgccgaaaatggatatccccgatttcctgcgcgcggtgacgcaggcccttgaggagcgaaacagccgcgtttaatcggtatgccgtttggcaatcatcaacggtctcccggccagcagcagccaggccgggagcatcaccatacacaacagcggcagcaaagtcgtatccgggaccaccacggcggccataaacaggctcaaccagccgtcgcgagtgacgaccagcaccatgccgaggatcgcgcaggaaacggtgattgccgccggcaccgcgtcaacatgagcatgcagcatcagccccagcgctaccccgacgaacaccgccgggaaaattcgcccgccgcgaaagccgctggctgaggcaagaaccagggctgccagtttgaccagcgcgataagcagaaaatccgcggcggttagcgtctggctgaaggccagctgctgcatctcatccagccctttaaagagcgttaagggcccgcctatcgtccccacgatccccagcagcagcccgccgatgccgagggtcaggattggatttttcaaccgatgcatcagggcatgcagtcgcggcagacaccagacggccaccatgccgacggcgatagcgatcagggcgacgataatgccgctgagaatatcaacgaagcgcatctgaccatagtgcgggatcggcagcgaaaaatggggatggaaaaacagacccgtcgtcaacgcgccggcggcggcggcgaggaggggagcaaagaggcgatcccacagtggcgtatcgttgctgctattgagggtttgcgaaaaaatcagcgcggcggcaaccggggtaccgaagagggcgccgatggtgcctgaggccgcgaggatggtccagtccagcgagctgacgcgcggaaacagtcgggagccgacggcgacagccagcgcgatattcaccaccataatcggatgctccgggccgaggctgacgccgccggcgaggccgaggatcagcgcggccaggagtccgggcagcgcgccggtggcaatgggagcgccgattaacgactcggtcgctggatccggcccggcgtgcccggggctgtaacgaatgaccagacccaccgcgatccctgtcgccgtcagcatggcgatgatccacagcgggctgtcggcgctcacccccaactgcgcgggcagattgctccacagcacgcgctgcagcagcgcggcaaccttcatcgccacgatcaggatcaggctgcaggcgatacctatcaggatggccggcaccgacaggatcagcattgttctggcgcgaggatggagcatggaaatgtccttgtaaaagtgctggagcactactttgccttcgtcagcggagaccgtcgatgcaaatggtgctgaaacgataaagttaaggtgacatctgatatccggcgcgtcctttacaggctaccttgcatagattacaaactaaatgtgacctgtgtcgctaaacaaggggcgtctgcgcgttggacgttgttgttaagccgccatgaatttacagtgtgccaaaagatttattttgactttagcggagccgtaacggaatgacaaaatttgctttagtaggagatgtcggggggaccaacgcccgcctggcgctatgtgatctggcgagtggagagatctctcgtgcaaagacctattccgggctcgattaccccagtctggaggcagtggtgcgcgtctatctcgaggagcaccaggtaacggtcaacgaaggttgtattgccatcgcatgcccgattaccggcgactgggtggcgatgaccaaccatacctgggctttctctatcgccgaaatgaagcgcaacctcggctttgcccatctggagataattaacgattttaccgctgtttcaatggccattccgatgctgaaagctgagcaccttattcagtttggcggcagtgcgccggtagcgggcaaaccgatcgccgtttatggcgccgggaccgggctcggcgtggcgcatctggtccacgttgataagcgttgggtcagcctgccgggcgaaggcggtcatgttgattttgccccgaacagcgaagaagaagggatcattctggaagagctacgcgccgagctggggcatgtttccgcagaacgcgtgctctcaggtcccgggctggtcaacctgtatcgcgcgattgtcaaatcggacggccgactgccggagaacctgcagccgcgtgaggtgaccgagcgagcgctggcggacagctgcaccgactgtcgtcgggcgctgtcgctgttctgcgtcattatgggacgcttcggcggtaacctggcgctgaccctcgggacgtttggcggggtgtatatcgccggcggcatcgtgccgcgcttcctggagttctttaaagcctctggtttccgcggcggttttgaagacaaaggccgttttaaagcttatgttcaggatatcccggtttacctgattgtgcatgataacccaggcctgctgggctccggcgcgcatctgcgtcagacgctgggccaggtgctttaagcattcttctcccgggctaccgtcgtagcccggatggcggtgctttccgctctctacagattcatcagctggcgaaactctttcactttactgcgactgaccggaacctgaaactccaggtcacgcaggcgcagcacataggtgttgttgaaccacggctcaatttcccgaattttgctgagatttacgcaatacgagcggtggcagcggaagaaatgcgcggtgggcagtttgctgcagaattcagtaatgttcatcggcatgacgaatgactcccggcgggtatagacgaatgtcatcttttcatgcgcctcggcataataaatatcatgaatactggtgacgatgatccgctcatctttgatcagattgatggtgtcgttttcccgtggcgctgcgctggctaatcctgaagcagcgttattttgctgctgccaggcggtggtcagcttttgcagcatattgatgatgcgcgactcctggtaaggtttcaggatgtagtcaaaggcttccagctcaaaggcttccaccgcatgttctttccacgcggtgataaagacgataaaaggtttatgggcaaactggctgatgttttgcgccagcagaaccccgtcgagcgacggaatattgatatcgagaaagatggcgtcgaccttgttgtgctggagaaatttcagcacgtccaggccgtcgtcaaagctgccgacgatctccatctggctatgggtgttaataagccaggagagctcctgctgggccagaaactcatcctccacaatgataactttcatcttttctccgctcatgacaacagcgactccgtcagcgcctgcggcgtagagttattggggacataaaaggcgatttcggttcccggcgtcagattgcggatatgcaaaccctcgccgtagagaagtttcacccgatgatgcacattgagcaggccgattttgttacccggcatctcatcggcttccacgcgggcgaccacggcgggatcgataccgttgcccgtatcgcgaacgctgatgcgtacccgattgccgcactcgttaatgccgatcgtcaccacgcctttgcctttacagggttgaataccgtgaacgatggcattttccaccagcggctggataagcaggctcgggatcacgcagctgacgtcgtcgtcaatatcgtagatgaccgtcagcttgtcgccgaatcgcgcctgttcaatagcgatataatctttgatctgatacagctctcgtttgatatcaatctgctcatcgtcttttaattcgatgttatagcgcaggtagcgcgacagattaaaaatgagctggcgcgcggtgtccggattaaggcgaatcgaggaggagatcgcgttcagcgcattaaataaaaaatgcgggttaattttgctttgcagggcgcgcagctccgctttgttggccatctcccgcagctgttcggcgcgggagacttccagctgggtggagattatttgcgacaggccaatcgccatctcctgcagcgtcgaagtgatgcgatgggcgtggcagtaatagatttttagcgtgccggtcaccacccctttttcccacagcgggatcaccatcaaggagtggatctccggggtgcggtgggcttcgtcattgttttttatgatgattttcccataacgaatcgcctgccgggtggtggggctaatcatatcgtcgtggcgttgatagttggcttcaccgacgcccacgtaggccagcacgtgctcggtattggtgatcgccaccgcgtcggcggtaatgtcgcggcggataatctcgcaaacctggcgcagagaatcgctgttaacgtgtcgaaacagcggcagggttttgttggcgatatcgagcgccagtttcgcctgccgcgccgcgctggcctccttttccccttcaacgctctgcaccagcagcacgataaagccgatgcagacgctgccgaggatcatcgggataccaattttcgaaacaatatctacgccgagactcagggaaggcgcccagaccaccaccaggatcatggtcagagtttcacacatcatccccgccagaatgccgattttccaccgttgttcgcgggccactttacgattaatcaaccccgacagcaggccggcgacaatgctggtgataaagcagggcaccgcggtcacgccgtcgatatcaatcaaatagcggtgcacgccggcaatcgccccgacaatcgcgcccacccagggaccaaacaggatcccaccggacatcacggcgataatgcgcacgttcaccagggacccctcaaccgggacgccggaccaggtactaaatagcgcgaacagcgagaaaatggctgtcaccgccagcagctctttcggagtatgggccgacttatgcaacagttcgcggaacaggcgcaggcgaataaggaaaaagaggcaaataagcatcagggccgcacgatcatagaccgccagcatcatagtaaagatttcgtgcatgggtgcgccgcgtcagtggccagaaagggacatgataaaaaacctgacggcagaagaccagccgtggaaccataaagcggaaaagtcgcactttttaatggggattaattaaaaagcatcgcgatagcggcggtcttcgccattaacgataatattctgtgttaagaaagatatcagtgtgttaccacctttatacaacccgggattattccgccaatgaactgccgcatttagcgcagtcgatacccgttttatatgccagggaatattttttaacgggcctctcgacaacatgaattttttcaggttattttctaaacgagccgcaacagcggcagcgtcgctcggacggtccgggcgctaacgttaattagaggaacctatggctgaatccagtcctgaacgccgttttacgcgtatcgatcgtctccctccgtacgtttttaacattactgctgaactgaaaatggctgcgcgtcggcgcggcgaagatattatcgatttcagtatgggtaatcccgatggcgcgacaccgccgcatatcgtggaaaaactctgcaccgttgctcaacggcctgacacccatggttactctacctcgcgggggatcccgcgcctgcgtcgcgccatttcacgctggtatgaagaacgctataacgtcgatatcgatccggaatcggaagcgatcgtcaccattggttcgaaagaggggctggcgcacctgatgctggcgacgctggatcatggcgacaccgtactggtgccgaaccccagctatccgattcatatctatggtgcggtaatcgccggggcgcaggtgcgctcagtgccgctggtggaaggggtggatttctttaacgagctggaacgcgccatccgcgagagctatccgaagccgaagatgatgatccttggctttccctcaaatccgaccgcgcagtgcgtcgaactggatttctttgaaaaggttgtcgctctggcgaagcagtatgacattctggtcgtccacgatctggcctatgccgatatcgtgtatgacggctggaaagcgccctccatcatgcaggtgtccggcgcgcgggatgtcgccgtcgagttctttaccctgtcgaaaagctataacatggccggctggcgcattggctttatggtgggtaataagactttggtgaatgccctcgctcgtatcaaaagctatcatgactacgggacttttactccgctgcaggtggcggcgatagctgcgctggagggcgatcagcagtgcgtgcgcgatattgccgaacagtataagcgccgtcgcgatgtgctggtcaaagggcttcatgaggccggctggatggtggagtgtccgaaagcgtctatgtacgtgtgggcgaaaataccggaaccttacgccgccatggggtcgctggagtttgcgaaaaagctgcttaatgaagcgaaggtttgcgtctcgccggggattggctttggcgactatggtgatacccacgtccgcttcgcgctgatcgagaaccgggaccgtacgcgccaggcgatccgcggtatcaaggcgatgttccgcgcggatggtctgctggcctccgcgagctagcgctgcgggcagcacggcaaaataaaaacgggagcatgaaggctcccgttttttttgacaccgctgcagtctagatcatcagggcaaaagtaccggcccaaacgatgaccataaaagagaggcccataaaaaagtatttcacgactcatcactccacgcgcttgtgcgacgttcaaatgaattaattgttctgtttttcaaggactgtcgccagtgtaacttcaccctgcagcagcccgtaattctgtgcgtttagtgctccagatggcgctaatgtacgcctaaaaaatcagggaaacaagaggcatttttttattaatttttagttacttacgagtgtcgtgattcggcgacacattaatttcacagggtaataaatttagcgccagcgacgcgaaggaaacgggttttagcgatggggcgggcggagaaggccaacgagagcgcgcggcattatctttgccacgcgccgccgtcggttcagggcaggtctgaggcgcgctgtcgccactcggccgggtagtgtgccgggataaagcgcagcgtcagcgccatgagtagcaggacgcagatcgcatgccaggaccagtcaagcgtgtagttcccgctcaggctacgcagcaggcctgaaagccagggcgacagaccggcgatgataaatccgatcccctgcataaaggctaccagcctgccggccaccgccggttgtccggcgtgatccagcgccagcaccaggcacagaggaaacgcgccgcccaatcccacgccgcaggcaatggcccagagcgcagagaaatgctctggcagccagataaagccgcagaagccaatcagctgtagcgccagcgctagcagaagaagctggcgccgatcctcctggcgagccagcgccgggagcagcagcgcgccggcggtttgcccgacggtcagcagcgccagcagcgaaccgctgtactgggcgctgtcgcctagctggatgtagtaaggaggcagccaggcgatcaggctggcgtaaccggcattgatcagtccgaaatagagtcccagcgtccaggcgcggcgctggccaataatcgcgacccggggggaagcgctggtctgatgcggtgcgcgaggcaaatgccgacaaatcgccagccagctgagcagagccaggagcgcagggagcgcccaccaggctagcgcatcatgccaggccgcgctatgtgacgccagccatggggtgaacgcggcgcctaacccgccgccgcccatcagcgccgctgaccatagtcccatcaccagcggcgtccgtcggggaaagaggtgcttaattaccgccgggatggcggcctgaataatgccgatgccaattcctccggccagagcgctggtgagcagtaagccactattcggggcgatttcccgcagcagggcgcctaccgcgataatcagcaggctcagcgcaatactgcgcttttgaccgatatagcgatcgacccagccagcggccagcgccagcacccccatcgcgatcaccggcagcgcggtcaggagtgcggccagggtatagctcatgccgctggctgcgcggatgtccggcagcaaaggaccaatggaggtaagcagcggccgcatattgatcccagtcagtaccaggactgccagcgtcaggttctgtcgcagcgctggtgtcatgactgccgttccgcccagcgctgataaagttcagttccctccggctgcgggcgatgatggatcggcagcgtttgctggtccagcggctgctgcagctgctgataaatcgcggcggtcgagagctgaaaaggctccccgtcctgattgctattggcgaaaaacacttcccgcacgccggttaaatagagcgcgctcaggcacatagggcaaggttgtccgctggcatagatgacgcattcgcgcaacgccgcgcttccctgtctggcggcaagatcgcgaacggcgttcagttcggcatgcgccgttgggtcaccgctcagatgaaaggtattgacgctttcagcgacaatctcatcattccgcaccagcacggcgccgaaggggcgcccaccgtcagcaatgttttgttttgccagcactaatgcgcgctgaagataacgatcgtgagcggacatagtcactcctgcataaaacgatgttaaaggtgaaatatgttgagggtcgtgcgaagagggtacgtctcttgtttcataagttaaaagacttatttatgataatgcctattggaatttcttataggtgggccgatgcttctgcgccaactttcctactttatcgctgtggctgaacattgtggcttttcccgcgccgccgcggcgctgcatgtctcccagcctgcgctgtcacagcagatacgccagctggaagcgatgctggaggttcagcttttcgaccgctctggccgacgtattcgcctgaccgatgccggtgagatctggctggagtatgcgcgtcgcgcgttacgcgagcttgaggaaggtcggcgcgccttgcatgacgcagaagatctccagcacggtaaactccgcattgctatgacgccaactttcactacctatatgctgggcccgctgatggaggcgtactaccgacgctatcctggagtaaaagtgcttatccaggagatgaaccaggagcggatggaggcgatgctgctggaggatgaactggatgtggggattgcctttgacgacagccggtcacaggaaattgtggttcagccgctgctgacggaaacgcttgcgctggtggtgagccgtgcgcatccgctggcaggagagcgcgacttgcaactgcaggctctcgacgcccagccgctaattttactgagcagcgagtttgctacccgcgagcagattgatcgttattgccgccttcatcggctcgaaccagacgtgcggatggaggccaactccatcggggccgttctgtcggttattcgaagcacaacgttagcaacgctgctaccggcggcgatcgccggacagtttgatgatgtggtggcgattgagctaagacctgcgctgctgcagcgcacggcctgtttattgcagcggcagggcgcctggcagagcgccgcagcgcgcgaattcatcaccctggcccgagagaacgcgataacgattgagcaggaaaaccgccagtcccttgcctgaaggactacgttactcgccggcgaactgcgactcacggctggcttcgctgccgatatcgccttcatcgggctgggcattctctataagcatgccttcttccttaagcctttccagcacgtgatgaaagagctgagtcttgtctggctcagccatattctgcaacttctcattaaatacagtatgggactgaacaagataatggataaattccagcaatacctcactttgcggcaggacggttaattcctgctggatgtaacgggtttgatccagtagcggatttttcgtcacgtccataggccgggcgctaatactgtgggcgtatattttctcaatggcctggctggtgatatagatgcggttcaatgatatcgaggggcgttcgtcttcctctggaatgaaatgacaataaacaaatggtttatccggcagcatcatgctgaggcggttttcgaaaagaatatcatctggcgcctccagcagcgccattaggttccgacagtgtggatgccagagccctgaagcaaatacctttacgttgaactgggttaccgtatttccgcgcagggtttccatcgtcggaatatcgccttcaagtcgcagaatgctgcggatatgggagtgatgcgaccagactgtttctcctgcctcgactgaggtaaatggattaaacgcgctggttacctctttttcctgatgggagaggacggcgatttttaatattcccggcgttgggttaagcttaagacatagattgattgcgcctatatcatgccagtgaagaatgtcttccagttcgcagtttaataatttttgcgcccgcgccagagagcaatactccattggtggtaaattatttagcttccagatattccgttctgtaatattcataagaattgtatgtcgatgaaaaaataaatcgccatggtgagcaaaagtatcaatgacaatgatttattttttctgctgacttcctttacctgattaacaaaatccattcacattgagaataatatatcgataaattggctgtttttattgttttgctgccgcatatttactctttcccgttatcttatcatctcttattcgtagagaaaaatagtttgctgaatataagcgtttcttcctgtttagcagcaatatttaaggtgagtatgagcggagcacgaaaaaagggacggtcaatttggcaaactttgtggtcggcaggaagtatcaaacagacgcctgcggcgcctgtcgaagctacctgtagttattgcggcatagacaggaagcggtcacccggttgcgcgatggcataccaggccatcatttcggcagtgcctggctggccttcagcaggcgcccaggccatagtgtccatttcggcaagcggttgataagcaccttgcttaacttcaaataccatgccgccagcgtcgagtgagagcaccgtatgccaggtaccggcttccatttccagcgccgtgcaggtttcacccagcaccacccggcgggtaaccacgccgtggtcatcaaaattcagtaccacaaatcggcctttcagcggcagtaaaagttcgaaggtatgtctgtgccggtgggggcggatataggtgccgggttccatggcgatggccagacgctgtatcgggtcgcttagttcgggatgaaaattgcgatgggcacgcaggcgcggagcactggctgccgcttcgctctgctgctgcatatcgctgagggtgatctgtttcatatcaacgcctggctcctttgttgtccggagaagattacaccggggtagtggcttgtgactgaaaaagtcagaaggtattgtacgcagaaatgcgcgttgctgtcggtttattgtgtgcgtgattgacaaagacacgttcctttctggcaggactaaccatactgaaatcgttggctaattatgattacgagaagaatacgttctggctggcgtttaggtcatcgtggtgaatggcgggcaacgtttatatggtgtcccctgcatacatctaacctgatgtgcaggggattgaaatggatgatattttttacgtgtgaaaaatattttactcgttactttacccatcggagcgggacaagagcttttctctgaacttacaatggtcactatataaccaccttgctctgccgtggatgagtttggctttggggagatcgccggacttaatccggtcgtaaatgaaggtttttccaaagccagtatccgccatgatgaatttcagatcaacaaggctatctggttgcatctcatgtttcatcttccacctctcgttacagccaaatgcttatcacgtgcttcaacctcttcctggtagtcagcacaacgctggcatcccgccaccagttcccggcgccgctcgggtatctcttccccgcagtcgcggcagtgagtagccgaaactgccgcatgattgatgcgcatattctggatggtcatttccagccggcgctctgccagctcgttggcctgatcgatgatttctgcgctcatgctcattcctcacttttaagttcatcaggcaactcaacttcattacccaactgcgcgaatacgactgctcgacatacagcagcgcggggattgtctgcaaggagtccacgtcgcttacctggagacgctaactcgctcacgccaacccagtggtagacttttcctgtggcgggatctgccgactggtaacaactgatcgaaaagctctccattaactctccgcactggctccagtcggtagatggtgaaaacacatagcggctatggcgtttgcttttctcgccacatagctgatgcattccatttaaatagacctgagcatcttgcggcctggtaacttctccacctaacgcgatagctactgcaacatcaaggtgtagtcctgtaagactttctgtcttcactttcatgctgcaccgccttcaatgcgcttgaactcgataacccaaacccagggatcagcattccagttttcctgcccgtagatcgattgccacaggtaggcaaaagcatcggtagcgtcaggctctgggttggcgcatccacatggctcaggttctccgcaattaagacagccaccgtcaataatgccttctgctcgcgcatcctcttcgctaatagcgttcagccgctcaacgcgcacgtcggtgatttccagcagaatgcggctggcccagcgcggcatgtggatggatgggcgaagctttccggcgtcagaaacttttggaggggtttcgaatcctttccatccatcactgaaagtgcctgtaaactcgtagaaggtcggcgcccatggttttctgtatcctgttgccacagccatttcaccaacaccagttgggctaacatcgtctaacgatgccgggaaacgataagcctcacgcacccagatgcggtcgccgacgtccccgaacgggcaagcatctccaacaagcccaccccagccgcctttgccgttctgcatttcttcttcgacatgaagcattgttttgaacacgttgcttggccaccagtgtccaccccgggggcatggttctggttgaggtttcataatccgccgtgtctgcgtcttccggccgtcgaggatggcccgcaccatctccccgttaaaaatcattccgcgttctttcatgactcaaccgccttactcagcttctcgccgagagcaaagatgtagtcgcgtaactcttccagtgactgcgcttctgattgcagaatttcacgatggcaaagttctttcaccaggtgctcaaacttgctgtagtagccgagtcgagccagcgtttcctgaccggcgttcttaccatccttaatgatgcgtttctcgttcaggatgaggtcatgcgttgaccctgtgacgacgtatttatcaccgagttcgatgtgtaggtttttgctcatgattccactccataccgcccattcatgcggccaataacactgacaaatttcaccaggctgacacccatcggctttaccttctcgtagtgcttgcgaaggatgggggggcatacagcgttccacttcggtttaggctttacgctcatcgctttggttatctcttctgcgcagcgacgagcctgggcgcggagagcgttttctttttcttctggcgtcatgcagcctccagattcccgatccgctttaactcagccagcgatatggacgtgatgatgtgtcgcggggtgatgtacgggcgccaaataaacaggagcgagccttttgggttgctctggcgctttcctgtaacggatgcaggaacaaactgaacacggccacccgttatcagcctgagttcatcagctgattgcatggctgaaataaaccagccggtagaaatgtcagccggtagcaacatcactacggcctgagactgcgcccgggattgctcagcagccttttccacccacggcccaatatcggaatagggtgggttgcaccagatcgagccgcatgacgtccattcgctgttcagcgagtcatccagctcagtgagatagtgagcgcatagcgcattactctcagaggctgcagcatccagccagaagccaaactcgcggtcgagcgcgttgaaaatttcaatcggcgtttgccagtagtcacgttcattttttggagttttcgatccgccgaaatcagtcattgcgcacctcgtttcgtgtctgcctttctcatgcggcatggtcgtggttttttatgctggaaatctctttctccagctcttccaggaactttttcacttcggactgaatctcatttgccagtgcttcgtcgaagtgaatgcgctttttgaaataggcgaggtctggcggtagacgatcgtcgaaactaacgaaatcacaccatttgcgccctgtgcacatcatctgagcgtgcatctgcaacaggtactggcgttttggctcgccagtttttaaggtctcaagatgagtccaggtgttggggcacttaatttcgataagcccatcaccattaacaagcccatcaggacttgctgcgaatcctggtatagttgggtgatcgataagccccacctcagtgatttcggcatcgaactcattcagcgcatacatctcgcgtgctaccggctcgagttctgttccgcgtatcattgcggcgttggagaaaccttcttcaagcttcccggtgaggcgctggcaaatcagctcggccatgtagttctgtcggcttgctgcatagccagacttggttctggccatgacgtcagcaaggcggctggctgtgacttttccgcagcgagcggcaaaccattctggggtgcgttgttccatcatttatcctccggcgctgcggcatcgacaggttctgcgttgtcgactgcaaggctcatgtcatacatgcgacgcttctcaaccgcgccgataacctgtttctcttctgcgcttaacgccacccagaattcctggtacttaacagttccaaggcgtgcggcagactcgccttttgcgatcagttccgggcgacgaccatccgactcatgccctacatgaacctctgtcgtactcccttcaatgacacgctcggcttcgtcctgatcgaagatgccagcaaacccaaatgcgagacgcgcacactggatcagcgtcttgtgacgaagcatacgggtagggtgggactgccatggctgagtgttgcgtttgcactctcccatgtactcagtaacgatggtcgggtgtgtccggtctttccggtatatcttgcaggtacacgcgccttcttccttgtcgtaggcaaactccattccatcaaactgaggatgttcgttgatgattcgagcccagccgtcaacgccgactacaggaacaattccacctttatccgggaatgcataaatctcttttgtccacgggttcagtccgtactggttggcgacgatcagcagtgccgtgaactgctcatcagtgacattcccacccttaaatgctgtatttttcagcgtgttcatcaggtcagttccggcatccatgccgaggcgggaggcaagcttccctgccattgtagaaagtgctgtgctcatagaattccccttaaatttaaaacgggcagccggtgcggtgatcccagtcgtattccgcctgggcgtaagcaactgccgaaatgaaatcgttatatgcctctccggcggaatcgctgcggaggccttcgtatgggcttttgtccatcggcacagagaagcggaacaggcctgagggctctttcggcagggcgtcgataatttcctgcgcccgatcttcaatccacttttccttctcttctgacagcgtttgttcagcccacttacgctcttcgatcacgtcatatgcgcggtatgcgttcataagcacctcagtaactgataccggtatgaggaatgcggccgtctttaaccgcggcaagcacctcgatagcctgatcccgggtaaggctggtattggccatcagagccttaacaacctcggcacccacagccttgcggtgcttaacgtcggcttcgcggcgcgcctgctcatcggctttacgtttctcctcagccaggcgggcctgttcgcgcagctctgcctctcggcggatgcggtcagcttcttcctgtgctttgcggcgttccgcttcgatagcggcctgcttttcagcctcagctttctgctcggctgcaatgcgatctcgctctgcctgctcagcttgtgctttcaacacagcttcacgatgcgccgcttcttcacgttcacgctgtgcgcgctgctcaacttcgcgggctgctgcagctgctgccagtcgcttaatttcttcttcatgggcaatgcgctggcgctcagcctcagccgctttatctgcctgctcacgatcgaaagcgtcattcatcagcagagccatttcgtggtcagactcaatccgagctgccagctgccgatcgaagtcttcattcatggccagtgcttcgacgtgaagggcggtcatggcttcttcggccttaatgcgctcctgctcggcttcccattcggtcaacgggcgacgcacttcatctttcagcgcatcgagacgctcacggacaacgcggcggctttcatcgatttgctttggcagcgcctttaactcagcgaccagatctttacctgcgttgtcgatgtaggttttagagcgcgcgaccttgtgggccatggatgcgatggcgtcgcggccttttttggtggttacgtccggaaccaggctgcgagcctctttttcgatcgcttcaataagcgggtcgagctggtcgttattggtgaaaaccgccatcgcgttctttttctcaatgacgactaaatccattatttcgctcatggtttcccctccaaaaggttgttattaataacttcgttatttgcaaatttgccatggagtttcagccgataatcctttattgccgactcagcatctttaagtgacaaataactccctatttctttgtttttcccttttatggatatgctggcccggaatcttttccttctgccatcccagctaacaccctttactcctgttttgttatttttcccggctgcgctattccacatattttgctcagcggtggcctctcttaggttattgattttattgttttctctgttgccatcaatgtggtctatcatgttgactgggaatgttccatgcgtaactagccacgcgaggcgatgagcaaaataaaacttcccgtcaatttttatgagaatgtaaccttgtccatttttgcttcctgcgatacatccagacttagcctttccccggcggttaaccttccaagtaaataaccctgaatcaggcgaataatctaataactcatcaagtctttctttattcagcatgcgtgcctcccggcgcgatgaaagccgcctgatagttcagttaaattcttcgtttcgattaccggctgagaccttgtcccaacccgttcagataaacttcaaccagcaagtcggttgtgtaagtccgctcaatcccgcgatgcaggtacaggcggccgcgtttatttgctgatgctgtccaggtgctttcccgatgcttaacgagcatccctgggagaacggcgccgcggttaacggtctgtgtcccgtaatgatgactaaccattgaacacccccgtaacgtgcagaattttgataatcaacgctgtccatataacgccgcagatcagcaggcagtaaatcagtgaacgaatgccttgtttgctcattttccaccccagcactgaatgctaactacgaggactgcaaccaaaaacggaacgacctttaaccaaaaattacgccatgcaggcttgtcttcttcgcggatcatctcttcacctttgccttaaagccggccagctgagcgtttgacttacgtccggcgttgccggtgttgtttggatggcttaaatttacagataaaactgtattttcgtcaacagacaaaactgtattttttgtcattgattacatatctaactgtaatgaaaggtgatttattttgatggggcgaaaaaaaaaccggcatacgccggttctattctgagagggggagggggttagcgctttcttcgatagattctgtgttcaatcatcacgccgatgattgttagtggttgatgatcgctactgataatcgggtagtcatcattcaatggcacaagctcgaaatgctggcagcccaggtgatccgtgtaagtaggccgatattttttaaaggtcgcttgagccccaccgttcttggccacaacaaactctccgggggttggctcaacttcggggtctacaatgatcacatctccggccttgaagtctggctccatcgaatcgccttcgatgcgtaaagcaaaagtaaaatcagaaacttcgttgtctgtaaggatgtactcaaaactcccatcaaatgcctcaatgggatttttttctgcgagagcccctgcctggacatagcttatgagaggcaccttcttgctgctaacttcagcaataggcataaaggctccgccattcattagccagtcaggatcgcactttagcgccttagctatgccaataatgttacgcggttttctggtgtctcccttttcaatgctctgccatgactgctgagttattccggcattcaacgctgcctcggtctgcgttagaccgagctcaattctcttttgctttacgcgatctgcaaggctcataaatccctctcaatgtatgccttgatattcacagttaaaactgtaattgacaaacagaaataactgtcacaaaatacagataaaactgtaggaggtaacatggaaaccatttcgcaacgcctcaaaaaaaagcgcgaagagatgaatctgtctcaggcgcaattagcaaaaaaagttggcatgagacagcagtctctgcaggcaattgaggccgggacaaccaagcgcccacgttatttgttcgaactggcaactgcgctccattgcgaccctaagtggctgctttatggcgagatgccatctcaatctcaataagttgccgatttaatcggcctttcaaacaccaccagaggaagtatcacagatggagagttcaacgacacgcaacaaagtggaggctcagaggatagaaagctggttacacagccagatagctgaactggggaccacaactatagccaaagtggccggagtgaataagtcgacggtgagtcgctggcgggaaagtctgcttccgaacatgtcgctgctgctggccatcctgatttctaacaggccgggagagaaaggtgactttgaagcatgagtgggaacagaaaggcgaaagccgcagtgggcaaacactaacggctttctacgcgaattaactggatcaattcacaggagtaattatgcctaagagcaacagattttaccaggcacaaacacacaaaaatgttacccgcgatcgcttcattcgctcggttaacccggtggttggcatgaaaatgcgcgccatcctggaagagctgaaacggaaggaggaaggccgtgagtaacgttctccgcatatccgattttagagggtctcagaagcccatggaaaaacctcagccatcagggcaggggttggtattcctgcaccgtaaagtaagagagctgccgttctacaagaccgacagtgaagccgtccatctgtggatccatctcatcatggaggtgaattcagctgacgggatggtaaccacagagtttggtgagtatccagtttcccgcggtcaggtgatcaccgggcgacataccctgtcgaaagacacaggaatagcacctgaccgggtgaaatatcttctgaacaaattcgccaaaatgggcatggtcaccaccctggcaaacaagaaattcaccctcttaaccgtcaccaaatatgacgattatcagcagttttttgtgccaacagaatgccaacagagtgccaacgcaaacccagtaaccacgctgcgtacaagtgaggttgtgccaacagaatgccaacagagtgccacaaacaatatattaaataatatctcttctactgacgtagaagagagtgcatcagcatcgaaaaaatcagaaccgaaaaaaccgtctctcagctgtgagcaggttgttgaggtttaccaccaggttctgccagaagcacaaggcatcaggatccttactgacaagcgacgtaacctgatccgctcgttctggcagaaggccaacaaaatcacccgtcagcttgatggccacagctttaccctggccgactgggagtcttacctgagctacatcgccagtaactgccgctggatgcttgagaatcgccctgatcagcgcaccgggaaaacttggcgccgcaagtcgctggaatacttcctgaacgtcgacgtctacgccaaaacgcgcgagggagcctgtgatgacctctgatttcatgactcctccgcacagcattgaagcagagcagagcgtacttggcggacttctgctggatgacgacagcagcgaacgcactcagaaggttctgtctatcctcaagccggaatcgttctactcgcgtcagcaccaggtcattttcgcagaaatgcgccagatgtaccgcgaccataagcctgtcgatctgctgaccctgtttgatgctctcgatagcaaagggctgacggaaaccgttggtggctttgcatacctggctgaaatgtcgaagaacacgccaagcgcggcgaacatcgtggcctatgcaatgcgtgttcgtgagaccgctatggagcgctacggcatcgagaaaacaacgaaggcgatcgagttgctttatgcccgtaacggcatgacggcagaacagaagtttgacgcaattcagggattattcactgagataaccgagcacgtaaaaaccgggatacggacagggcttcgcacgttctatgacgctgttactgactggtcggcggaattcgacgaaaggctcaagccggatggtcgttcccgtgggttatctaccgggatccgctctctggatgagttgctcggtgtgaagcgcattgttcgcggcagcctgtttgttataggcgctcgcccgaagatgggtaaaaccacgctctatacccagatggggatcaactgcgccacggtagaaaatgagccggccctgatgttctcactggaaatgccggaagggcagatggtggagaaaatcactgcgcagaaggggcggatctctccaaacctgttttacccggatatgacgaaggaagactacggatatcgcggcgactggaacggcgatctgaagaaagctaccggcgttatgggcgcccttattgaaaccaacaatctcctgattgatgacacaccgggtatttcactggcgcatgtcgtggctgagtcacgtcgcatcaagcgtgaacgcggcaaggtcggaatgatcctcgttgactacctgacgctgatgactgccgataaggcagagcgaaatgacctggcttacgggctgatcaccaaaggcctcaagacgctggcgaaggagctggattgcgtcgtggttctcctgactcagcttaaccgtgagcttgagaagcgaaccaataagcgccccttgccgagtgactcccgcgacaccgggcagattgaacaggactgcgattactggctggccatataccgggagggcgcctacgacgagaacgcaaaccagagtgacacagagctcctcctgcgccttaaccggcatggtgagactggtgttgtctattgcgagcaacgtcacggggcgatttatgactgcgatcaggaggctgccagtcagcgccggcgcgagaaagaggaaaaaccaaccaagcggggtggattttgatgaaaaagaactcgggcaaacaagccgttattaacttcatcggccagcatccaggctgcagctttcaggatatccgccgcggtaccggccttgactcttcagtggtcaattcctccctgtggcagatgaaccgtgacggcgaggttaagcgagaaggggagtgcaggagctaccggtacacactgatcgacacgacagccgtaaccgaaagcgatccgtctgttcagtatcgccagcgtcctgacggagtaaacccaatgactaacctgtttaaccagtgcctggcgggagtaagaaaatgaaaaacgaaatcgaacagattgcacagcaaaacgatatgagcattgaattcgtaacctggttctttaacgagaagaaggtggggtgcggaaatgtctggttcatgatgatggctgcaatgtgggagggctggaaaggtcgtagcatcgaaatggataagctggctgcggagaatgtggcgctcaaatcggctgttgatcatacgattgaatggatagaaagcacgaacggcgacccttgcgatgtagtcattcttaaaggcatcagaacccccgccaccgatcgcatcgtagccgggattaaggctgatggggtggagatggtacttgatcttattggtcatacaaagggaatgctttacgcagatagcgtaaaggagatgctttctgacgtttcctccaagctgcgcgagggggccgacaaatgagcgtcgccacttatctcaataccggtttagccattcttggatgggcatacatcatggttaaaacaggccagtggattaccaaaaatgctctgaggcagtgggacaagcgtcgtaaggaatctcgccgccagaaagctgtgaatgagttttatgacgcctttgagcttaacagtctggaacctggctctaccattcgcctggccactaaaggcgacctgacaatcatgatgttccgcagcgagggggccaaatgattcacttccacggagggccaatcacgccagatacctgtgcgttgaaagcgtggaaggggcgccatgcgttcattagctttgcaaacgccgggcagttagcactggctagcgaggttactcagtcatttgctctggataacggcgcattcagtttctggacgaaaaaacgcgttgtggactggaacgagtattaccggttcgtcgagcgttgggctaatcacccgcggttctcattcgccattatcccggacgttatcggcggcagtagcgaggaaaacgatgcgctgatagcagagtggccacacggaaagtttattggggctccagtgtggcacatgaacgaaccagacgagcggtttattcagctctgcaatgagttcccccgcgtggcaatcggcagcatgggcgaatacgacgcaaagcggccgcgccgctgtgtggctcgcctgcgtgacttaatccggcatgttgtggatgagaacggctacccgatttgcaaactgcacggcctgcggatgcttaatgccgatattttccgccatataccgctgtcatcagctgatagcacaaacgtggcccgcaatatcggtatcgataaatcatggcagaaatcagcctatgcaccggccagcaaagaaacgagagccgctgtactcgttgagcgtatcgagtcaatgaacagcgccagtgcgctcaactataacgccgaacgcgaccgctttatgccgcaattggcctttgagatttagggagtcaaccatgactgatatcaccgaactggcgcagagcctgaaagcggcagcagagaaggctactccgggtgaatgggtttattttccgaaaaataccagcattgagtatgacgtaggcagtgatgaatctcagggctcaatcctctatgtcgatagtggtgatttcacccaagctcagacagacaggaatggagagttcatcgccctggctaaccctgcaaacatcctcgcgctggtagaggcgctggagaaggcgcaggccaaagcagatgtatatgacatgcttagggatgactacggtttgcgcgaaaaaggcgttggacttgcagacttcgttgactggcaggctaagtgcatcgcagagctggagtcccgcaccgtcaccgtgaagctgccgaagccacacgctcacttaatctggattcaggcaggtcatgcgccagatgattactgggatgatgtagctgtatctcatagcgagaaagaccgctgctgcgatgggtcagagcgctatccggtttatgcgcgctgggaaattgaagagatgctcgctgccgctggcatcaaggtggaggctgattgatgttcataatcgaaagccccgagcagcgcctgaagcgcgttctcaaagaaaacgccgttaaattcaccatcgacgaagacggcggcatccataccaactggcagcatcccgaagtacaggcaactatgcgcaggcactttgaggcgctcagcaaaattaaggtggaccggaaatgagcgaattttcacgagaaacactactcaacattatcgagactgaccatgtgcaatgcggtgaggcttcggcattggccagcatggcgctggccgcaatggacagcgagtcagggtgtttgcctctcgactacctgcaggggcacaaagacggtctggaatgggccgcccaactggcagaagccaatcaccctgaaacaggagactggctttacgatgaccctatcgagctggcaaaagctattcgcaaaggtccagataggtcgccagtgcagccggtagcggacagcgagctggatcgcaatcctgtgctggcgtatgccgacagttatcgtgatatggcgaaacaaggcgtcgagtcagtcccaatttggagcgtcattaccgacctcgagcgaaacatagcgccgctctatcgccacgcgcagcagccggtagtgccggaggaaaaaccaattccaaatacactgagcatgtacgccgtggatgcagtagcagccatcgctgaggtgaagggctggaacgcctgccgcgccgccatgcttgcagccgccccgcagtcacccggcagtgaacccgctaccgtgccgggtgaatggattccggtaagtgagcggatgccagaccgtgaagttgacgttcaggtttactgcccagataagaaggagcagatggttgcctaccttgagcgtaatgagctggatggctatttcaggttcgcaacgtggagaactggcgacggtatttattgccagcccacccactggatgcagctgccggctgggccgcaggaggcgaaaggtgagtgacgtaaaaagcaaaatcatgcaggtgttgatcgagggagtggatcaacaggagaaatgggcacacggccattatccctatcgcgtggctacctggaatattcgatgcgcgatggagcgcaaattccccggggtggagtggaaaaacgcagacctgcgaaaagcgctcatcgagctggcgaaggatgggctggtatccaaatgtccccacgagagtcgcattggtcaggctgtctggcgtctggaggtgaaaagtgaataaggccgaattgcttgagaagatatcggcgctcgctactgaatgccacacgctggcctgtgagcttgatattggtgatgagcgaaccgaaatgttcgaaatctacggcgtgctgcacaacctaggccgccgcgggtacgccagtcaggtagggcggcgcatgaatccgctgcttgattcctgcgatgacgacgaggatgaggaagatgacgacgactgatgcctaaacccaccgcagtaagcaaatccgcgacattataaagtattctggtagggtatactctgccaaggagggtaccctatgaaaaaatcagatgttttttccactatcagaaagacggtcgattgcgccccaaaaggagacagaacagttactgttcagcttcagattatcaaatattaccatcaccttactgacgtaactcctaaagaatttgttgaagaaattggacttaaaagttcattggttacactctttactgattctatgaagcttgccaggaaactgtctgaggtgggatttgataaggaaaaaatttaatgtcacagtggaacattgcagccaaaccgaaagacgagcaggacaaggtcaacgttgacctcgcagcgtccggcgtcgcttacaaagagcgcctgaacatgccagttgtcgccgaagtggtggccagagagcagccagagcatctgcgcgagtatttcatggagcgcgttcgctactaccgcgagcagagcatccagctaccccgagcatccgatccgcgctatctggaaatggctgagcagaacgccaaaaaatagcgattttctcgtatatgctcattttgcttttatccccgtgacgggcgataattacctcgtcagcctgagcaactgacgacttacttccggcgccaagtggggacacatggcgcacaaaaccgtacagcaatccctgtcaccgatggcgaaagccaccggcgattttctgcattcagcgtttgacctctccggaggtgaagcgtgaagcaacaattctgccttatcaacgacaacgttaagcgtaacgccgtcagtttcatccagtctctgcccgtcgaccaccgatcgccgctgattatcgaggcgcgcgaagaaagccgcaccgacaaacagaatcgcctcatgtggccacttttgaaagacctaagcgatcaggttatctggtacggcgaaaagctggagccggcagagtggaaagacctcatcaccgtgctggtcagccagacacaaaacccggagcgtgagcagaaatccgccccgggcatcaacggcggccgcgtctacttcggcgttcgtacctccaaatccagcaagcgctatatggtcgaggttatcgaggcgatttactggttcggcaccgagcacaatgtgaagttcagcgagaagtccagtagtcggattgcatgggcccaggaatggagggcttcgcatgcacagtctgctcgctaaggtcatggagcgcggcatcttccgcgtaccggcacgccgcaaacgcaaggtcgaagttaagccttccgacatcccgaccctgaaagactacaccgcccgcctggtcgataagaagtggcttcgcctgagagcaaggaggccacatgcgtaaacctgcacgtcgtaaatgcgcccactgccgcgaatggttccatcctgcccgggaagggcaggtggtatgcagttttgaatgcgccagcgcgatcggcaaaaaacagacagcaaaagcccgggaagtggcgaaggccagggcggtgaagcgccagcgcgaatccgagaaagaggggcgtcagcgccgtaaagcaagattggctgaactcagacctaacggttactacaaagcccaggctcagaaggcattcaacgcctacatccgcgctcgtgatgctggtttgccatgcatcagttgcggcgagaccaacccgcctgatctgcatggcggccagtgggactgcggccacttcaaaacggtcggcgcttaccctgagttgcgttttgaagagcgcaacgctcataagcagtgcaaatcgtgcaatgccgggtcggggaagtacacagccaaagaggcgacggttgctcagcaatatgaagttggcctggttgctcgttatggacaggagtatgtcgactggcttaacggaccccacgaaatgaccaactaccgccgggaagactttattcgtatccgcgatgagtaccgcgccaagctcaaagcactgaaacagcgggaggctgcatgagccgtgacgttatcgaacgcatccgcgaccgttggcaaaagctccgcctcttgcgtagccgcggcaccgtactggttgactacaaaatattacgcaatttcgtccgtatctataagcgcctgggagagacagcatgaaactggaattaaccaacgaacagcaccagtggatagatcagtggctccagctttggggcgcatggtgccagacagggaagatagacaaggcgatgataaatatgattgccaagttcatggccacggttgaaccgcaagcaccatcaaggcctgtatgcagcgatgatgatgggttgctgattgatgccgtaatccggcattacctgaaaaacgtagatgagaacgcatggaaggtaatttttgcctattacgtctgtaactcaagcgagataaggatcgcctcatggcagcatgctgtgagcaagcctcgcctgatgaagacgcgcgccggaaaccagtataagcacccaagcatttcaaccatccgccgggaagttaagcaggttatcaacgcggcactcttttgcctgtaccagccgctgcaaaatgcgtttaacgatcgcgaaagcgtgaggaaaattgcaaaaaatagtcataacgtgcttgcatttcaatgaacaaatgagcaatatatttagtgtaggttgccgtatttgcgtttgacctatcagaacaccgagcctcgcaatagtgcggggcttttttatgcctgcgatccggtcagggctcttgggtagagacgtgctgcacgacacgtcaaagcccttccgcgcagagccctgaaccagattgcatctgtcgtagtttggtaattacgtctggcttccaaccagaatatgcgggttcgatccccgccagatgctccaatccctctaccttgggaccattacggctaccgcgccgtcactttttacccttggtatttcttcccgccttgagcgggttttttattgagcatgcccagaccctcgggaatcatccccgacgtgctttgttgataaatcagcccgcagggtctgggcctcttttcccctttacgcacagcgccatccgtcatcaacggaggtgaggttatgacaaaaatgagcaccatttacagcagactttcatacggcaccgggaccgcactgacgggctgcggtgtctcagcaaaggcgtatgccggggcagttaaggcagaggtatggattttggccgacaaaatagcggggatgaccctgagtgactgggcaattattgtcggtatcgcctgcaccattaccacctgtggggtgaactggtactacaggcggaaagaacgcgaggatcggctcaatggctatgacaccaaaactgaggaatagcgttatcgctgccatcggcggtggcgccatagccattgcttctgcgctcatcaccggcccaactggtaacgatggtcttgaaggtgtgcgttatgacccctatcaggatgtggtaggcgtatggactgtctgttatggccacactggcaaagatatcatgctcggcaagaagtacaccgaggctgaatgccgtgcgctgctcagcaaagacctgaacaccgtcgcccgccagattaacccttacatccagaagcagatccccgagacaatgcgcggggcgctttactcattcgcgtataacgtcggcgctggcaacttccaaacctccacgctactgcgcaaaatcaaccagggcgaccagaaaggtgcatgtgatcagctgcgccgctggacttacgccaagggcaagcagtggaaaggcctggtaactcgtcgcgagattgagcgtgaagtttgtttgtgggggcagaaatgagccggttaaccgccattatgagcgccattgtgatctgcctgatagtcagtctcggatggttggctagccactaccacgataacgcgaccgaattcaaaaggcagcgggacaaagcaaccgagcaactcagcctggcgaaagacaccatcgctgacatgcagacccgccagcgagacgtcgcggcgctcgatgccaaatacacgaaggaattagccgatgaaaaagctaaaaatgatgctctgcagcgtaagcttgataatggtggtcgggtgctcgtcaaaggcaagtgtccagtgccagccgcaacccaaaccaccggcacccccagcatgggcgatgatgccaccgtcgaactctctgcagttgctggacgaaacgttctcggtatccggtccggaatcctcagcgaccaaacagccctgagagccctgcaggaatacatcaccacgcagtgtttgaaataaggcattcattgaatgcctgtgataatgtttccccatgtactaatcaagcgggaaaaaaatgaatcaggtcattctcattcttgaagggcaaaagcctcagtcaatcaatgtcgctgatggtattaaatcagtcaggcatcttctttctgatggacgtgaggtgtacatagatatcatgactgctatcgtcaggacttcacacggtgggcaagagtcataccttgttgcaacggatattgatgatatttctccgcgagaaatacagcgcgcggcggagttattgtttccccgtacttaattttgactcttcgaagccatcacaaaggccacccacgggtggctttcccatgtttagttctgcagacacaccgatccccggaatggaggttccgttcacgtggcaggctagtctggagttaaacgcgaagctttactctgcgctggggcagtgcaatctggataagacggggattagaaatatagaggagagccggtcaaaaagtagtgggccacgctcagaatgaatgcggtgaagagataggtgattgggtgatttattattttgctcggcaaactgattttcaacatttattctcctttttgattattgggctaagtctgatttctattgtgtaacttaatttcaccctgtggctgttcctactccggtaacattaaactcttacgcggtgatgtatctatactcgccactattaaatccgccgcacgttggacaaggtctctatagtgggccctaattccttctgaacagcctttgtctcttataggagataaatccattcacgccgctaggtgtaatgaaaacagtaatggcgctgccctgagagcagtgccgagcagataaaataaggaatggagtatgagcaaacccgactgggaggccatcgagacggcataccgggccggggtgatgtctctccgtgaaatcgcatcgcagcacggcatcagcgaaggcgctatccgtaagcgtgccaagcgtgacgactggtcgcgcgacctgaatgcgaagattcagcaaaaggctgacgacttggtacgcaagcgggaggtacgcaggacggtacgcaacgaaagcactttgaccgaacgcgtactgatagaggcgacagccgaggttattgcaacggtacgcatggagcaccggggagacatccggcgggctcgcgaactgaccaatacgctattcgatgaattggccggagagtgtggcaacgtggccgcgcttgaagacctgggcgagatgatgcgatcgcctgatgacaaaggcatggataagctcaacgatctctaccacaaaataatcagtcttccttcccgcgttaaatccatgaaagacctgagcgacagcctgaaaacgcttatcggcctcgaacgagaggcatacagcattgagaataaggctgaaacgaaagaggtcacgcataacgtcatgctggtaccaaccagcgataacgtggatgactgggaagcggcggcgcagaaacaacagggtgaggtgctcggtggatgaattacaaagctgtatggaagccactgcctggatcacagtctctggctctgagttgcccttgtaacgaaatacttttcgaaggtactcgcggacccggtaaaactgctgcgcagttggcccggttccggcgcaatgttggcgtgggctatggctcgttctggcgtggcgtcatcttcgataccgaatataagaaccttgccgacatcatcacgcagtcgaagcgtatgtttcgtctgttcaacgatggtgctcgatatctgtcatctgcgagcgaattgcgatgggtatggcccacaggcgaggagcttctcttccgcttcggcaaagaggcagacgactactgggattatcacgggcaggaattcccgttcattggctttaacgaactgacgaaacagcagtcccctgaattctacgaaatgatgttctcctgccgacgctcatcgttcaggccggaaaactacccgctggagaatggcaaattactgaggccaatcccgctggagacgttcagcacgaccaacccgtttggcatcgggcatacctgggtgaagaaacgcttcattgagccagcgccgcgcggaaccgtgcagcgagaccggcaaatggtgttcaaccctcagacagaacgagaagaggaaatcacgcttacccgcgtagctatccacggatcgtttaaagagaacccgtacctcgacccgcagtacatcgcgaccctgatggccatcaaagacccaaaccggcgcaaagcgtgggtagagggttcctgggatgtgactagtggcgggagatttgaccacctgtggaatgaagcgctgcacgtcattaagccattccgcatcccggatagttggaccgtcgatcgctctcatgactggggtgagtcaaagccgttctctaacctctggtgggctcagaccgatggaacagccgccgaactacctgatggtcgacagttctgcccgcctgccggttcccttatcctgataggtgaatggtacggatgcccgcctgacgagctcaacaagggcctgaatatttcatccactaacgttgcgaaaggcgtggcgtggattgacaagcggctggttggtgaagacgtcaacgaacctgaagagattcaaatcgacggtgtcacgcagggccaactgaacattgttcctggaatatgttcggaagttatcccgggcccggctgatagcgccattttcaacactggggacgatgagttatcgatcggccagaaaatggagaatcagggcgtcgaatggctggaggccaataagaagcctggctcgcgagtcaacggagcctcggtattcgctgacatgcttgaggctgtcgttgagggcaaaaagctggagtctggcatcccggagaagcctgccttttatgtgttcgagcattgccgaggctggattagccgcattccagtgctagttcgcgacagcaaaaacccagatgacgtagatacccagcaggaagaccacgattgggatgcaacccgttaccgcgtgctgcactctcctcgccgttcaggggcgatattcttcacataaggacaactcagtgagtaacgatacagaaatgcaagtcctcgctgggctgattgtgaatagcctcaacgaggtctcgcgatctcgacagctttatgcgactggtttcaatagatcaggtaataccaagcggcaccatctgtggtgtgaatttggctatcctgagcgtctcgactttgatcacttttacaacatgtatgagcgcaatggcgccgcattcggtgccgtccataaattgctcgatgcatgctggtctgataatcctgtaatagttgatggtgatgagacgaagaagtccaagaagtcgacgccttgggaaaagaaagtcaccaagctcatgaagaagtactgggctaaggtgaaggacgcggatagacgaaaccttgtcgggcactactcagccctcatcctccagtttgcagatagccgggaatggtctgaaccagtaaatcgcgaggttatgcgtaattcgcgtgagcgcggcttagtaaagatgattcctgcatgggaatcacaagtgaagccgggggaattagagcaggatcagaagtctcctaactacgccatgccgaagttttattatttccaggagcaacctgttggggataacggaaatattgtcgggccgatgcgttctatcaatatccacccagaacgaatcatcattttttgcgaaggttcggaagatgaatcttctttggctggcattcctttcttgcgtgcaggctataacgaccttcttgacatggcgaaaacctccggcggtagcgctgaggggttcctgaaaaatgccagcaggcagctcggcatcaacatgtcgaaagataccaagattgaaaaaatcatggaggatgccaagaaggctggatattcaggtctggcggaggcgctaaacgccgctatccagaagcttaactcgggaaccgattcggctttggttacccaggatggtgaggctaaagtcctttctgtcgccgctgccgatcccagccctacatggacagtgtcagcgaaccagttttcctcttcagttcagattcctttcaccatcctttttggtcagcaaacagggaggcttgcttctgatgaggacaaaaaagattttgccaaacgctgtaacgggaggagaaatggattccagacagaccgtgttaccgcggtcatcgagagactgtggactgtagaggttatcgatccgcctaagtcaggagaaataacgttaacctggtctgatctgctcgcgccaagtgagaaagagaagattgccaacatgaaggaaatggctgcagtcgcgaaggatacccagcaagcctacggcacacctgctgtcgatgagaatgaggtcagggaggcgggggagctcgaaccgcgcgaagaagtgaaaactccggacccaaaccaaaaggtaactaccgatgatcctctttccgatgaatccggagcaaaaggcgaaagtcgggacgccagtagtgccacgcagtaaggttgacccgacgcgatcggcgaagcaggtcagcgcaatgttccgggatatcgaggaccggtatctcggcatcaagcgcgctctgaaatcgctcttcgaccagcgcctgaccgggagagagcgagaggttaacagccacaactggcacttcctgtgccacgaccacggcgaagatgtgaggctctaccaggtcaatgccggcaagttcatctatgacatgtcagcgcaggagttggctgatctgctcgaagcggtacaggtaattctcgacgatttcctgctggaaggcggcgaacaaaacctctgggcgatggattacgtcgccgcagaggcgcagcgcggaacgctggaggccttcaacaacctgtcgcagcagtcgcaggtgtacgccagccagacaacgctacagcagcttttaagcagccccggttatctgaaccagatagcggcggccaggctgactacttttagcgactggaaggtcatcagcgacaccgcccgcggcgatctgaccaacatcattaccgatgcggtcgcgcgcggggtgaatcctcgcgagacggccagcgtcatcagcaagcgcctcgatgtatcgatgtcgaaggccaagaccattgctcagactgagcaggtcggcgcgctgcggcaggcgcaatggaacgagacggactgggctgctgaccggttaggtttgaataccggcttgctgtggctgtcggcactcaagccgaccacgcgcagctggcacgccagccgtcacggcaaggtctacaccaccgagcaggtgcgagacttctacgctgagaacggcaaccggtacaactgctattgcagccagattccagtgctgctcaacgacgacggcagcatttttaacgaaggtctcgcggagaaattgaagaaagagcgagagcagtggaaattggcagaggctgcatgatacaaggaggttttgcggaggtttttatggcaaaacctgatgagccgtatcgtaagttgattgttgagagctactacccagccagtacctctggtagaaaagggaaggttcatatcaggccaacacctggacaatgggcaagcccatcactggctgtcgaatgttccaaaaagttgtcagacttgaagttgtacccaataggtagtcagttcgaaattactgccaaactgaccgacagggaagagggcggtgaatacatttacagttcattccgatgggagtttaaacacattaaataggtcgccacggcggccttttttattgcctgaaatccaccaatgaggacccagcatgaaacgcaatcgcgttaacgtgctgaccgtcgtcaactccgcttcaaacatcaccactgaaaccatcgacggcaagccacatatcgtggttcgcggcatcacgcctgttgtggacgatatcgtgatgaaccggaagttgtacccggcagcagaaatcgaaaaggcctacaacacgcttgagcgtaacccgatgccgcttggccacccgaaggttgacggcaagcatgtgtctgctcgcgatgtccgggcggtgaatgaatatcacgtaggcgcatggctgcagaacgtcagccacgaaggtgggaaggtgacgggtgatatgtacgttaaccgccagtacgccgagtcaagcgagaagggcaagcgcctgattaatcgccttgatgagatgatctccggtaccaactcagaacccatccatatctctaccggactcctatattccggcattgccgctaatggtgagtcgaagggcaagaagtacaacgagatcgccaccaacatgatgtttgaccatgtggcggtgctgctcgatgagcctggcgccggaactccggaagaaggcgtgggcatcttcgtcaactcagaaggtcatgagcagcagatcgaagttgctcgccttgctgatggtatcgactgcacccgcgaaggtctgctcaacaagaccaaattcttcttcaccaacgcctccaacttctcttttgacgacatttcacgcgctatcagcgacaagttgcgtgagggtgacacagaagataagtggctatggccagaaacggtgtggccagacagcttcatctaccgcgatgaagccaagtatttcaaacagaagtacctcatcgatgacgacggcaaagccgtgtttgtcggcgaacctgtagaagtcgtgcgcaaacccattgagtacgagattaaaaccaacggagagaacgatccgatgaaagaactgattatcaatgcgctgcaagccgcgggtaagccgactgaaggcaagtccgatgccgaactgatggacgcttacaaccagctagcggcagagaaggcggcagccaagaaagatggcggcgacgaaatcgatcccgccaccggcaagcctaagaaaaaagagcaggccagcaacagcgaagaagcgccggcatggtttaagccatttgctgatgatttggcagccgttaagtcaggccttgccgtgaacgctgacaaagagaaaggcgaaaaacgcgctgccgtaaaagcgaaattcgggctggatgacctggcggtgaatgcgcttgacggcgccgcccttgatggcctgtttgctcagtgccagacctctaccggcctgaatggtgcattccgtccggtcaacaacaacgattctttcagcgaaatgccggagtaaaaaatggctaaagacgggaaacacgtaattcacgcgggcgggattttccccaacccgcaacttaatcgtgaaggttctgcggccgcagcgtttctgccgggtaccgttatctttttcagtgcagccaagcctacaccgtctgttgatggcgctgaagacgcaattctttacgttgctaactacgactatttgcgctgcaaaacggttgacgatgcctatgcgatcggtgactgggtggtaaacatccagccaacgccgggcgttttcctcaacgttcgcgctgccgctggtacctacaccaagggccagccggtttctgtggccaatggccaaattaaagcactggcagagggtgaaaccatctttgcctatgtcgaagaagacaagtccctgaccgccacagcaggcgatctggttcgcgtcgtgttcaagtaaggagagactgaatgtttgtattttccacccgacgcgcgactgagacgggcaacctcgaagcgaaccaggcgcagttcaatgagctgcaactggcgcgcaatatgagtgctcaggccgttgctgatttcgtatcccgcacccgctggcgcggtgatgcggcaaacactccggcgctggacgcgacgaacgctgtcgacgacatccgccgcctgtatcgcgcttatgatcagactgtgctggctgaattcgaaccgaatactgaattcactctgcttaacgatctgatcccgttgtcccgctctgtccgtcttgaagagtcagtgtacgagtacgctcgcaccggcggccgcggctgggcgcacacctctatgtccggacagattggtgcggcgctggatgcgcgcgcgtacaccttcgacggtacgatggttccgatccatgattctggattcaaattccagtggcgtgacccgattttcaacaaaggctccgctctggcttctctggccgacgctcagcgcggttctgttgatgatgttcgtcgtcagtacgtggattacgtcttcaatggcttccgtgattccgctggcaattatatcgcctttgatggcaagacctggaagggcgttaaagccgatgagcgcgtacaggttgtcgatctcagtgcttccggcctgaatatcgacttcaccagcgccagcgcaacggcggagcaaattcgcaacgctgccatcgcgctgcgtgacgtgatgaagctgaccaacctgcagtatgcgcagcagacctggtacgtttccgggcagatcatcactaacctggagcgctacttcagcgataactaccagtcagacaccattctgctggagctgttgaagctctccggtattgctgccatcaaagaagatgcgcaactgaccggtaaccagatcctgattgtcccgcttaccgccggcgttatcgctccgattgtaggtcaggccgtgggtaccgttgcggaccctcgtcagttctacaacagcgactacgtctggcgtacctggggggcgatgggcctgatggttaagaccgatatcaacaatcgcaaatcagttatctacgcgcacagctaaggggcatttatggcactggtaaaagtggctcgagacaacctactttccggtgccaatctccagaagctggaggttggcgcgcaggtttcggtaagcggtgatgtcgctaaacgttgggcggccgccggtctggttgaaatcattagtgatgaagatcaggtgctggaagtggctacgcctgttgatgatgctgcagagcaggcagagcaggcagagcagcaggatgaatctgccagcaaatcgaagaaggcgaaataatcatggctgacccaatcacagcggcagacgtgcaggcgttcctcggtgaattgggttactccatcccggccgctctgctcgatccgattctctgcgtggtgaacaagatcatcccgtgcctcgatggtgcgggatatgacgactgcacggcaaagctcatcctgatgtatgccgctgcgctcatggcgacgtcttctggtgcccggcgaataaaatcgcagggggcgccgtccggggcgtcgcgctcgttcgattacggtgacgatggcatcacctggctgcgcgactctctggcgaaactggataccagcggctgcaccagtgaacttccaatcagcgccggcaacagtgtgggcctgtttatggtggtcgggggctgctgatggcgtgggtttcagttcagcaaaggctgccgcggacgtttacccgggtgtgggtgatcaccgataccggcgagcaaacgacggcgtacttgaaaagcgacggagagtggttcatcaactgcgaccgcatacgcgccacaggcgccgttgtgctgcgatggagggatgactgatgtcggcaaccgcgaattggtcatacaccgcgacggcgacaatctggcggcgcatacgcgatgctgacggtagcgataccgacggcggaggtcagccgtacgggtgggaagcgccgatcgctatcctctgcgactaccagggcggactctctgcaaaaatcggtgaccttggccgggagctcgttgttaaaaacacgatatggaccgagtacgcaacggcgcgggagggagattacatcctgattggcgcgtcgactgatgcagcaccgccggatgaggccgatgagattcggcagatcgtccagttcgcagatacgttcgagcgactggcggacgatttcgcactgattacgggagtctgattatgggcgctaaagttcgcggcatccgccaggccaaggccaacctcgatcgcatcatcaaagacgtccaggggcgtaaagtcgtgcgagcaatccagtctgcgatgcttatcggcagcgcgcaggccgcgctttacaccccgatcgatacgtcgacgctcatcaacagccagttcagagaaatcatggctaacggtaccagggtaaccgggcgcgtcggttactccgccaactatgcggtgtatgttcacgacccggcagtgaaacagaacttcacgcgagcaacggcccgcaaggagttcttaacgaagggcttcgaggatacccgcagccagattgacgcggtggtgaagaaggagctttcgctatgacccctccgatgtatatgcgcctcaaagacctctttgtggctgaggggcttaccgcggggtttaaggtccagtggcggcaatggcgcgacactgggaaagatactgatcagttcatcgtgttcaggccttccggcggtaccgatatcacctttgacctcggcggcgactggtatgttatggttgatgtgatctcctcgaaggccaatcccgatgctgctgacgccgcggtaaacgccatggtcgagtacatcagcgcgcaatccggcgccgatgattgcgttggcgcgctgcggcttgtcggcaatgtaccggcgccgatccccaccgaagagggccggttagtaacccggctgctcgtctcctgcacatacggcgaataatcgccagaatcacccatcaggctgccatatggcggccttttttaattgagaggcatacatgcaaggctgcgctaatgacaccggcaagctgattggtaaggtagccgtgctccgcatggcttttggctgtgctgatacggttcctgcgctttccgaatggaagcgcctcggcgccatgaccaccaagggcttcgactattccatgaataccgtcacctctgaggctgacgatacgaaaggtctggttgagaacctggtcaacaatatggacttcaccatctcaggagaaggtgagttccgtaagaaagacaagacgacggaagttggcgctattgccatctcgaaatatattttcgatgaagtgcaggccggccgacagccgacagtctgggtccgcttcgacttcactggtgaagacgctggcacttatatcatgggctacttcaacaccacttcctggtctggtgatttcggcacctctgatatttccaccttctccggagagtggaaagtagctgatgcagacacggtggtatttgaggtagctccgccggcgctggctttcaccaccaacctgccgacgaccaagagcgtgacggccggatcggctctgactatgtctgtagcggttgagggtggcacttcgccttacacctacgtctggaagaaagacggcacggttgtcagcgggcaaacaacggcgaccttcaacaaggccagcgctgcttctggtgatgccggggtttatacctgtgaagtcaccgattcttccgcgacaccagtcaagatcacgtctgcatcctgcacggtcactatcagttaaccaccaggccatttcgtgaatagtacaaagggcgttctgcgcccttgatactgtttatggagcgactatgacccctattaaagaattaggcgaatgcgttataggattcggtgaccgggaattctttttccggccgtcgttccgcaacatggcgcgcatcggagagcccgatgagattgttcaggcgttctatgacctgtgcaatgacgaggcgacgccattcgcgcagcgcgcagctgaggcctatatccgcgatgagtacagccgccttcctgattgcatcctgcggtttatgcaaagcgggctcctgtcacgcaaggcaatcatggcagcgcatacgatactgacagcttgctgtgacgatgatatcggcgatctggttggatggatgaagccggggaaatcacgcaagcgtggcttcgtctggcgaccaggtagcatgccgccggaatgtatggtcatcgtcgcgcaaaacctgatgatgcacggcatcatcggcaaagcgaaggtgcgcaagctgcagcgttacgaaacgaacgagacaaccgcagaattccgcgcagccgactacatcatggcggcccgcaaccatttcggcataagccgggaagaggctgagaacctcacgatgaccgaatttgcattactactaaacgccaaatacccgaaccagaaagggtttacccgagaggagtttgacacagtgatggaagaagatgatcgccggtggcaggcgatgatgcagcaggaacaagccagcaaaaccaaataaaccagcctcggcacagcccggggcttttttatacccaaatttcaccgcgcatctcacgcgcacttcacacagaacctttcaggatgacccttgaggataccggctggctgtcggtgcctttctgtgggccggattcctgtgagacaaggttcatcactaaaaggtaataccgatatgtctaatatcatccccatgaattacgatgaccgttcattcccttttacggcagattgctggttcaacgccacagttgctgcaaagcatcacggcaagcttccaaaggactggctaaagaccgagacgacgaaaatttatatcgccgaactggcggaggagcttggtattgctggctccggaataaaagaggatttttctccccttttagtcagggtggagaaagggcgaaacggcggtacctggcttcatccggagttagcggtggagttcgcccgctggttgtcagtcaaattcgcccgcgcctgtgaccgacacattaaaaatctgctgctgagtaaaaacttccaactcaccgaagatcagattgtcggcctgatggtctgccagcaaccaacgtcgtgggagaagcgctttaaagacccgttctaccaggctctgtcgaaaatgtccggtcttccttacttcggtcatgtcggcggttgtccggcgctgttcggccagatcaccgctcgttgggtatacggtgtcgcgcttcctgattatgtctatcaggcggcaaaacaggcggcgggcgacagcaaagagaagattcaccagcaccttaagcctgatgcgctggagaaggtcgagcagcaactggtcgccgttaccaacatcgccagttgcagcattgaccagaaggacttcgaggcccgttgcatggctgcatttcccgttaaggggcaaatgaagttgctgtatgcggcggcgtgaccatgaataaccgaatcgttgagtgcgcctccagagcggggcgcgacttctcggagttcatgaagggcgagaagaacatgatggacgcgctgcgatcggctgaagagttcaccgagcagttacgcattcatggctgcgttaatcaccacttcgtcaacttcatgatgatgaaggcgatcatgaaggtcttcgacgatatgcagcgcgaggagcagcgagaagaacgccgacgaaagcgtgcagcagccaagagtaaatagcccactcaggtgggcttaatccttgctgatgcgaattttttgaattagctcaatgatgtttttaaggtcttctggcttgaatccggatgcgcttatcttcaggtcatctagctcaattttgagatttttatgcttgtttcggtggatcaggttgcaaattgcatatcctatagctccccataaagctttagagttaactatctcaattatgatgtcctgagcggagttaaccgtaaaataatgcgtagtaatgcactcatcaaccggataggagtaggcaatgtcaccttgttcaagaatgctgataaaatcagcttccatttctgacggtatctcgattttcaaaggtgggttaggcgtggtcattgaagcgaactccctttcgtcaaaaataaaaatgtgctgctgttttttgcgcgccgccattggagcgctcagcgcaaaaggcgtggctgtcgtgttttatgatatcgatgtcgatagagcgacaaaggatatggaaagactgcgctaactattatccttgctgtagatacccttgccccattagctatgtctgccatgaagaaaaatccaggcatgtacgataatgggcaattctttgcccctggacatcatggttacaggcaatacgcgacgatcctcaagaagcagaaggacacagccggcctggatgctctccttaaaaagaaaaaggcggaaggatgggcagactaaagatgtttggtttgctacgattgccgcatcatttactgatggggatagggatatggtaagtcgtttttatatgttcattttagctgctatttttttgctaactggttgtgataacaaaccggatgccccgtttggattcaaatgggggcaaactatccaacagacaatagatcaaaaacttgcaggcacaaaagtcaataacacagggtttgtcggttttataagtgctgacaccgcaccaaaacctgcatcttttgaaggtcgatattttcttggttttatggggggactcgggttaacaagcgtctcattctcaactcctgtagatgctaatgggtacttttttaaccaaggaaggaaagtttacggtgatatgtctcagaagcttgagcaaaaatatggtagcccagttgaaattaaagaaaaggtaagccgtgatggggcagatttctatgaatgcataaaagatgagtcgtgcggcacatggcaaagaaagtatcagaaagatggcatgacaatcaccttaaacgttgaaccttcaccaggacggttaatggatgcaatgtcaaaagggtatgtaagtgtgcggtatgagtttgtgtcaaaagaagaactggataaagaagtaaagagatataaagataaaaaagaatccaacaatttctgattcatggttctaacaaagacctcgcttcggcggggttttttattgcccggagatagcaaatggctgagaacgctggcggcatttattacgatattgaaatggacgtgcagggcttgcttgtagcgcaacagcgcgttaatcaacgcctcgatctgatggaacgtggtttcgatagcactacgcgcgccgtgaataacactgagcgctctatgtccagcctgtcaggcgtagccgttgctttggccgctgctctttctgcgaagcaaatttccgaatatgcagatgcctgggcaactgtaaataacaagctggctaactcactgcggcctaacgagcaacttgctgatgtaacagagcgcgtattcaacattactcagcaaactcgcagtagtttagatgcaacggcatccctctacgcaagactggaaagggcaaccaggcagtacgggaccagcgcagatgatctggcgaagttaaccacaatcataaaccaagggtttgttgtatcaggggcaacggcgcaagaggccgagaacgcgattattcagttgtcgcagggccttgcttctggagctttgcgcggcgaggaattcaactctgtaaacgaacagggtaaccgtcttattgtcgctctcgctgactccatgggagttagcatcggcgaaatgcggaacatggctgcgcagggcaagttaacaaccgacgtggttgttaatgggcttctatcccaaggagcagtgatcgggaaagagttcgccaatacaacgacgacgatcagccaggcgctgcaggttgctggtaacaacgtaactaaattctttggcgaaaactctaccgtaaaaactggcgccgctatttttaatgatgcagttgtgactgcaagtgaaaacatagacgttctgggcgctgcattaactgcagcagcagcaattatgggaagccgctatgtcggcgcattgacaatgtctgctgcctctcagatccagtctgctttggcggcccagcgtcaggccactgccaatgcccaggccgctcagtctgcgttaatagctgctacgtcagtgaagagaaaggcggttgcagacaaagaggcggctttgtcctcccttgccttagcgcaggcagaatataatgtggccaagggtagcgcagctgaaatgcttgcgctggatgcattaattgcagctaaatcaagagcaagtgcagcatcattgtctttggcgcaggcagaaactgcacaagccgcggcatctgcacgagcagcaactgcagcaagtgctgcctcggtaggtataggccttgctcgtggagcgctttctttgattggtggtcctggtggcgcagccatgctggcagcatcagccattttctacttctggcagaaagctcaacaagccagagaggaggcgctccgctttgccgatagtctggacaaagtaaacgcctcaatgaaggcgatgaataatacccagctcaggggcaccatcgccgatgctaacgagtctattagagcgcagaaagatgaaatttccgatctgcaagcagaggttgactctttaagttctagatatcgtaatttcaccccagaagctcaagctgtagctgaatcattgggccaaggtgctgattttgcccgtcagcaggctgaggtttctgaccagttagccaagaaatcaagggatcttgccaacgctcaagataagttggcgcaaactcaggaaactgcagctgaagccaacagaacattaacaaacaacatgctcacttcaatgggtgtgcatgatgggctgatccaaaagggttggtcacttgagcaggtgcagagcgcggttgcgaaggctttcggcaacactgctgatgaaataaaccgagcaaatcaggctggacaaaacttcaaccccaaagcgctgcaggtttctcctcctaccgctgatggcgacaaagtaattcttaacctcgaagagcagaacgagttactgaaaattcaggatgaacgccaaagagcagtgacaaaagccaggatgcaggcggcgaaggttactgacaacccaaaccagatatcaaaagctggcgatctggctggagaaaactacgaccttcagaaagcagaagaagcccgtcatgaggctcagaggaagggagagcagcaagataagcgttcagcatcagctgcagaatcagtagcgcaaaaactggacaagttgcgtgccgtacagaacctatctactgagtcagttgagaagcgccgcattcaggaggctggattgcgcgccgaacagtcactagggagtggggcaactcaaaagcaacttgaagaggcgagggcgttaggagaagcaaacgagcgagcggctatatccatccagaagcgcaaagaggctgagcagggacagaagtacgccaagcaggagatagcttccgcgcaaactactgttgatccttcaactggacaggcagttgatccactggcacagattaatttgcaggagcaacaaaaacttgacgccctagctaagtaccaggaaattgataagcaaaacaccaaactgtacgaggacgctaaaactgcaatcatgcagcaggcctcttaccaacgtcaggccatccttctgcaggagcaacagacctatcagcagaatgtcagttcgcttttaggagaatcgtcgaattttgctggctccctggcggatgcgataggtcaagcagcagggaagtcgagtgcggcatatcaagcgcttttcgctattagtaaagggtttgcgattgcacaggcgtccttgaatcttcagaccgctatcagtaatgccatggctatcccgtggcccgccaatattcctgctatagcgcaagcattgtctgctggcacgcagatagttagcgccataagcggaataaactatagtggcggacgtaagaatggtggctcggtatcacctggtaatgtttaccctgtaggcgaaggaaaccttccggaactcatgcagaccagcaaaggccttttcatgataccgggtgatggtgggaaggtattcagcaacaaggatgtgacaagcggatcgccgcgtatcaagaaggcatcgacgggtagtgaataccaaagccagagtaacggcgacagcggttcagctggacctcagtcaacgaggccaatagagatcaatatccaattctacgaccagaccactggcgggcaacattcatttgcagcccaagcagtgcaagaaggtaatgtggtgacggttgatgcgttcttaaaggatcttgaccgtggtggaccgatgacatctggtatgatggataggttcggactttccatgaaagccagtgggtccttctaattatgagataaaaggaaatgccatgtcttctttcatttgcttttctacggatgaattcgcggttgtagcgacggatactcttggtgtggatgccgaagggaatccctttatccttaccaataaagcgacatatctaccaactataaaaacgattatatgcggcacaggaatgggtggatttcattcccgctgggcggaatttgtaaacagccgcatgattttattagacgtggataatcttgattaccatgctccatccacactaaaggatatgtgggaggagtataagaaggaatacaacgtaggtgatgagtgcacggtcaccatctatcatgttggaatatctcagtcatcgggaagaataaagagatttgcctaccgatcttcagaatgcttcaggtcagaggaaataactcatggttggttttacaaaccagagtgctcagtccctgacggggaagacatcttgggaattatcaaggcaatgatgtttgaacaaagggcaatacaggatgcaatgccaagtgctgaaagagtttatattggcgggcaagttaacgtcataatccttgagaaagatagcgttaggctcatgactatagccgacttccctgacttttcatcggtgatcaacaagttgttttaacttgtaactgcgcttactaaaccaaacccgctccggcgggttttttaatgcccggaggaaacgtggcaacagttcaataccctccgttcctgccgcttccccagcgcgccgatcagaacatgacgcaggatacagcctggcagacgacgcagacggcagtcggtccattgataatcacgccgatcactacggacctgaaagcaacctggacgctgcagtggatattcacgcttgcccaggccgagcggtttaagtcgtggctgcgctcgccgacatactgtgaccgcgggcgcgcctggttccagatgccgatcgacctgggtgatacgcagggcgttcagcagcagacgctgcatttcgtcgatatgccggtgcagaccagcaaaaacggcaacattgtcacctggaccgcaacggtcatcagtaacggtatcgaggacattaccgaggactacgacgactggattgttgaggcccagcctggctatggatactggctggattacctgatcaccgaagttatgccgagggccgactgatgccgacattgagagagtggaaggagcggcggccggcaagcgacatcaaacagacggtggagttttatcaccctgcgtttggttattaccgggtggtcaataacctgtttcgcccggcgacgttcggcggaaatgccttcgagcctgcgcggttcagcgtgaccgagccggcgcaggacggaacggcggtcatatccatgaccataacgtttgtcgccgcgacggagcatgtccggcagacactgaaaagctggcgcggggcggcgcgtatgacgccgattaagtgcctgtatcagcagtggaacgcgatcggtgatgcatcatccctgaaagactggacgctgtatgttaacgacatttccgccgatgccagcaacgtcactgtgaccgccggaaagactaacccgctgactctggccaactccatcatttacaccacgaaagactatcccgggctaatcaccgtatgagacagagcgactttatcgggcttgttaacggcaagccctgggctaaccgcgcctgcagttttgagcagatggactgctggggcctggtggttctctattaccggcatgtgctcggcctggaactgcatcacgttgccggctacgaatcgggtgcggatttcatcacctgctacgaacaggagcgcgcccactggcggcgtgtgtcggtggcggccaccggatgcatcgccgttttttaccgcggcgaagtgccggcgcatatcggtgtgatgatcagcccggttaagtgcctgcatgcccgcggcgaattcggtttcgtgcgctgcgacagtccgctggcattactgaaggtttacagcaaagtggagtacatggtgcatggtgcgatatgagttacagaggctgcctggcgctccgctgcagcggggaacggtagatgccggcaccacactggtgagcctgctggattctctgcagctgcaccgcgatgttatcgtgaaactgaatggccgagcgctgccagacgattacgatatcagtcggccactgcgatccggtgatactgtggctgtgttcgaccagccagaaggcggggtgggaaagctcatcaccacgatattgcgtccggtcacgaaaatcctctccggcgcgctgaaggtgttcggactgtcaaataagcctagtgcgtcggtatcggtggcgacaggcgaatcccccaacaacgacttaaccggccagacgaaccgcgcgcgactctacaaggggcgcccgaatatttacggccagtgccgcgtctttcctgacctgattcaggaagcactgttcgagttcgtcgacaacaacaaacagcttactgaatggtttgaggtcggttacggccggtacaccatatcgtcgatccgatactcggaatcgaatctcggcagcctggcgggagcaagttctgcgatttataacccgggagacgtgatcggcacgattgaagtcgggtatcagttcgatgacgtcgataacgagactgtgccaggcctgaatgaaagccaggacttcccggcccagacagcgaccacgacggtgccgacatcggtggcgatcgagagtaatcagctaaaggctgtcgtgctgtcgaacgatgacaactttgcctacttcgctgcgctggcagtgccgcatcccgtgtcattcgtcatcaatgccacctggtacgatggcggcacaagcgtcacgcggaatgtcaccggcgccgggaatattatctcctctgagagctttattggcgacgacacgctgtcgtacacgacgttttatatcggcgaactgtcgggtgaaattacatcgctgccgggcaatgcggttatcaactcgactctgttcacgctgaatgaccagacaccccttgttatcggtccgtcagtgtcgccaatcgtctcgacgcaggtctgggtgcatgtgcttgttcagctcggcgcgacggccggcacaacgcaatatcggatcaagttctggcaggtcgatgacgacaacaatcaggtgccgggcacatccgagcagcatgattatttcttcgataacgacttccaggtgacgacccggtatttccgcacaacgcacaagttcgtcccggctgtcggggcggggcgctatgcggtgaccatcgagcgcctcgataacagcaatgacgccaacgtcgtgacgctgatggcgatccacgcggttaacgtacgggaaaacgtcgtttatccggaggacacaattgcccgcatcacgattaaggggccgaacgacagcaactcaaaccgcgagcagaagtacaacatgctggcgcagcggcataccatcagctacgaccggacaaccggcgcggttgattacacgctgcggccaagtcgttcgtttgctgacgctatcctgcatgagtgggttgtcgtaggtaagcaggacatagccagtattgacgtcgccgctctgtatgccattgccgattcgctgcctgatgaggcgcttgggtatttcgattacaccttctcggatgagaaacagccgcttggtgagcgcatagcgacgatcgccaatgtagcccgcgttgatggcaataatatcggcgatgtgctgacgttctggcgtgatgagaaagtgacaaatcccgatgcggtttttgcgcgctcaaacatgttctgggacgagtacaaagtcgcctggcaaatgtctcttccgggcggttacgacggcgtggcgctggactacgtagacccgctgacgaacaaaaaggcgtacatctacctgcagatagacagcagcggaatcactgaggttgaggacgccacggttaatgcgatgcagatcagcctggacggctgccgaaacgccactcaggcgatagaccgggcctggcttgaggcgagaaaaattctctactcacgtctgaccatgacggtgaaggtgctggagtcgactcaggttgtgcgcggtacggttgtgcagtgtcctgacatgtacgacaacacccagcaaacaggctatatcaccgggcgatccggtgacgtgttttcgacctcagagcgcctcgacttctcactcggtgagatgtgggtggtgatgaccgacagtctcgggaattaccgtgggcgctggcgggcatatcctgttgacgataatccaaaggcttttgagtccgcggccgatgctttcgacctcaatatttacgaccgggttatagtccagaatgccagccggtatttcatcgcaacaaacacagaacttaactccaccatctggcgcgtagaaagcgccaaaccaaacggcgacgatactcagacgctttcgctatctgagtattcagacattatttacccgtaacaaccaaccttcgcgcacaccatcagattcacttctgagggcttcgtgcgccttttatagggcgacatgcacaatggcagaagtaccgttaccaactcccacagataacgctgttccgagcacggatatccgggatgcagtttatgccggcgccatgctggataaggttgtcaccagtaccgacctgacatacaccgatcgcctcgggggtgagcattacaccgtagacggaattaaggcggaaggagataaggttgtcgaggaaacgcggcagaacttgatccctctcagccggcagtacatgacgctggcggcggcgcaggcggatattgcgaacatccccgaagggagcacaacctattatcgcagtcctgatgatagtgcactggctattgaagttataaataatggcgggacgctggagccaaccggaaggaaaatgccttcgtatgatatggtaattcaggctgtgctcgctgaattcatggaaagatcatccattattttcgaaggtgaaaattcatccctcttgtcattatgtgattattttggttatgaggtcggaaaagtaaccgaaaatagttttgagaccagaaaggttaagatagttcagatggactcaggaccaggattcatgctggttgatgattttggtaatgcggtagatgttttgtcagaaagatttactttggttgccggaaataacgagctgacagattcagagtcgcttctttccttccctgacgaattcggtaacgagctgattcttgtagacagcaaaggaaggcaaagggtaggtgataatcttatttttgatgcaccagactgggcgcaatgtacaaccgaccaatttggatttgtaatatttgggtataaattagatggcacatttgtgggaaaggataatggcggaagtggtggcgagccagttccgtcaattcttgaaaccggctctgtcgatcactggctttttggttatcctgacacatctatggtgggaagggttcacggaagaatcctctcacctcagtcaacgccagaatttaataaaaactatgtatctctgtcagcatggggaggggctttagttacagatattcctgatgcaggggaatatacagtttgtgcagtagttagaattcctgttcaatctccgcaaagtgattgcgtggtagtatatggcacccaaaatgggtattcgcctcgtgacgatgacgatacctatactggaaaccagatctctctcttttctgacagagacgaccgtcgctgggttcgttcaaaaacatccggatacagagccacttccagacgctacccattcgatcagactccggtagataaatggctatttatctcgcatgtagtaaaactaacaggttctggtcaccgctatcaggttattagtattagcggcgagtattatcaggtgctaagagaggctgatactgacagacttatattgtctggcaggaatattgccattggtaatgcgtactgtgatgtatctatgtttaaaactaaaggtcttgatgtagctgagtttatttatttcgattctgcattatcaatgcaggatgttaataccgtttatcttaattctcgtcagcgcatggctgaaagagcaatcaacttacagtaaggggatattcatgggcgttgcaattatggcagcaggtacggacgcagcagcatattctaataattatattccaccggtagccagccctctggtatggggaaaccttgagagttctgcgatccctgagtcaagacgtagcaaaaactgggggagtgctggcggtaatttttcattgtcaggtaacgctgcattttcatctgtaggcgtgtcagcagcagccggagtagacagccgtttgactttaggcacattttcacctgatgcttataccatgatcggtttggtcgatgttggtgttagcgctggtattatgcgccatcgggatatccgccttactaccagtgcagataaaaaactcgggcgctcaatgactgcagggagcgtcgtgtcagatatagtgttgccggcaagcggcgcatttgttgtgtttttacaaggcgatttaactggacatgtttttggcatggcgacgcgaaactcggtaaccgcggcgactgccagcactgccgttaatacaggcacctcatccacattccttggtggaagtaatgccagcagtgcatttgcagcgtggtcagggtatggcgtagcgttatatccacgcaaattaagcaatacagagatcatgctggttgctgagcgccttcttaaaagagctgcgtatctgggggtaacggtgaatggctgatctgtcgatctctgtaatctctgatcaggcctctgaaagcaatcaggcggggtggtggcaccccgtcgatagttttcagggccttgaatactatgggctgtgcaaagaatttggcacggctggttatcatcaggtcgaaattgtaaggcgtgatgcggatggtaccctgacaagaggtttgtgtaaaaacactgatggtaccgtggcgtcatatgttaatgatgttgggcataatcagccctctgtagtcgtggatggcgctggctacattcatgtatttacatcaatgcatactaatttgttgcgctacttcagaagctccctcccgggcgatgtaagcaccatggttgatgcaacaagggatttccctgatgttgaatggacatgtacttatcccatcgttggcagggcacctgatggtaatgtttttgcaatgttacgcgcatcagatagaagtctgacaggagaaattaagcgcgcatcatttctttatcagtatgatattacgagcaggctgtggagtcgctttgcacatgttgcagagcaggaccagagggcggtttatcctgacgacatgcatgttaattcagctggagtccatttaatctacgaatgggcaaaatatgaagcgtcagcggtccgtcatgttggagagtacggagttataggcaatgatgggcttatgcgaaatgtgtctggaactgtttttgacatgccagtaacgcagggtcagcttgcttataaacctctttatccaggagaagacccaaatatcagtaatgcactgattatagggattcagtcagcgaagtttgctttctctggtgaatctttgtcccacataaccttcaggtttagagaaataaacgatcctacaggaactgcatttacaaatttcagggtaaaaaattctatatggaatggaactgcatggatcgaagaagaactcgcgtatgttccccctgaaatcggcaatacgtctgctgctctggcggcgacggttcaaggagtcaaaaaacgggtttacttttcggtggaatatacttcttcagggagtactgtcgctgtcatcgtccttgctgaaaatgcaggtacaggatgggtatattcaatacttggtgactccgcgcctacacttctgcgtttggggtcagcaccaggggtaggtggggatgtgatttacgtatcatcaccttacagcggaaaggtaagtcgctattttgttccatcagactacacgccatcaacttcttacacaaacttcaacgaccttcttgctgcgcttacttgatatctgctccatgtattaataggtcaatcctgcattgatccaattgagggcgaggccctggacgatgttactgtcgccggcgtcgtgacgttcacaatctgcgatgttcgttctgataattcgattatttaactggggtatatatggcactgaagctattagccaacaataacgcaaagagtgtactcgctgcgggtattagcgcgtccgctaccgttattaccgttgggacaggaacgggggctttatttccatcgccggtatcaggagaaagttatttcaaattaacgataaccgacgcagccacgaaaacaatttccgaaatcatgcacgtcacgtctgtttctggtgatgtaatgacggtaattcgtggtcaggaggggaccactccgcgagtatggtcaacaaacgatattgcggcaaatatgatgactgcggggtctttactttcctgtctgcaagtatcaaataatttctctgaaattgcagatgaaggaagtgaagctgtaaagcaggcgctattaaatctcgggtcgtcagatggcacgattaatggtcgccttattggctttccgcgcgtcgttacgagctccggatcatttacaaaaactcctggtgtaacaaaatggaagattagaattttgggaggcggcggtggtagctctgctgcaccggctaccggttctggtcaagtttcgataagcaatggcggcggtgctggtgcatacgcagaggggatgtatgatgtatccgcattaacctcagtaatgattactattggtcagggcggcaaaggtggtactgcatcatccatttatggggaggacggagggactagctccgtcggagcgctgatttccgctccaggaggcaaagcgggcctccctgcggggccggctaatcctccatttcagccagtagcgaacacaaactcaaacagccctaccggctggaatattgtcgggataagcggtccgggatcggaatgtgcatcagccatttcaactgaatatgcaatcgcctcgcgcggggcaaatagccaacttggcgtagggggatcaattcctgccataaataatccagcgaacaatggcggtggatatggcggcggggcatctggatgttccaatggcccttcaatgcctgtgaatcctggtgcagatggtcagaatgggatcgttataatcgaggaatacgcctgacatcgtgctggatagctgctcgcagattttggcatctcaggagatggcgcggatggcatcctgatcctggaagaattcgcgtaatggcttactcgcctgcgcgaccatcgatgtaatcagcccaccactgcatcatctccctgcgcttatccagatactgagcatggttgtaaattccacggattgaaccgctggcagtgtgcgcgagttgtttttcaatcgcgtcagctggccacccatgctcattcattattgtgctgaactgatggcggaatccatgcccgctcgccagcccctcatagccaatctgtcggataactaataatacggcattctcgctgatgggctttttcttatcattccgcccggcgaacacaaaagaggaaacagggcttgtgatcggtttgagagtattcaggagatttattacctgatctgacatcggaaccacatgaacgcggcgccccttcattacttcttcgtcgatggttatcatcctgttttcaaagtcgacgttttcccattgcatagaacggagctcttttgtgcgcagcgctgtatattgcaaaacctgtgtggcaattttcgaaataatacttccggaaaagccagatagcgcgttattgaatgctggtatctgatctgcaggaaggaaagggtagtttttctttctatatcccttcatggcatcagcaaggtcaggcgccggattatatttggcccggcctgtaacaatcgcatacctgaatacctcgccacatcttcttctggctttatttgccctctccattgccccgcgctcttcaaacctccggatcacctccagtatttgcatcggctcaatgtcctgtatttccagatatccgatcattggcagaatatcgtcacggaacatgcgagaaagttcatccgcatatccttctgaccaaacctgccgcttgtggtcgtaccattcatgataaatagctgaaaatgaattgtccttcacagacaactttttggccttaaccggatcgaccccgacagaaacatccttccttgcagtccacgctttatccctggcttcctgcaatgacatgagagggtatttgcccacagtcagcaccttctctttgccgtcgatcttatagcgcagctgccacacctttttgccagaaaccggaacgtacaggtacaggccattgctgtcgagcattcggtagggtttgtctttaggcttggctgcctctatctgcttaacagtgagcatgggtaaaattccggtgggtaaagttgttttactcgttttttacccgccaaaaggcgcggttgtcaacggtctgaggcgaactactgcgaacagagatttcatgagaggcttgatactggcgggattcggcggactatgacgaattgctgcgaactcaaaacaagtgtcccctgcaggaatcgaacctgcaactagcccttaggaggggctcgttatatccatttaactaaggggacaaggcggcacgagtatagcgttttttgcccgcctgagtaagagccataccgtctgactgcttaaaccctcgccactcagggcgctttttttatgcccggtcggcctttttccctttctccgccgcctgggcgcgggcttccgcttttcgcttgctgctcatatcgttacggatctgcgcatggctcagcagtgcgaagatgaaggtcccgccacagatatttcccgccagggtcggcagggcgaacggccagataaagtcgctccagggcagatttccattaaacaccagataaaggatctcgaccgagcccaccacaatatgggtggtatccgccagggcgataagccaggtcatgagaataatcaccacgattttggcggcgccggcgacaggaaacatccagaccatggtggcgaccagccagccggaaataatcgcattggcgaacatctctgtcggactgtttttcattacgtcttcggcgatgctgacaaaggcctgacgggttggctcatcaaaaataggcatataattgaaggcccatgcggccaccgcggtaccgatgagattgcccgccagcaccaccgaccatagccgcatcagcaaaccgacgttaccgagggtgggattatgcatcactggcagaacggcggtgaccgtattttcagtgaacagctgctggcgggccataattacgataataaagccgaaggtgtagccgaggttttccagcaaaaaaccgcccgggatcccctccagtttgacgtgaaaaattcccttcgccagcagggaggcccccatcgacaggccggccgcaatcgctgaccatagcagggccagcgcatcgcgctccatctctttttccccttcctggcgaatatgttcatggatcgccatcgcccgcgagggaaggcgatcttcatttacttcgatctcttcaccacgctgattttcctcactttccacttctctttcgtcatcctctgcctttaatttgttattgtctagttcatccatttcgtggccctcgctatcaatctgtatagttatagcgtagcggctttccctgccgtctggctgggcatactctgaaatcgcaaaaatggtaacgtcagatttttgtcgctccggtagaataggagccccgcgatttcgttattcccaggctaagatcaaatcaacaacttgggtgatatagacatcgttcaacgtgctgttacaatcgctcacatctttacgggcggaagcgttgtctttccgtcatggatggcaactcgcgatagccataaaaaccagggagacatctatgaattatcgcctgtcggcgcttgcgcttggcgccacattgctggtgggatgtgccagttccagctctggcgatcggccgcaggggcgctcagacccgttagaagggtttaaccgcacgatgtttaatttcaactttaacgtggttgatccttacgtgcttcgccccgtcgcggtggcatggcgcgactacgtcccacagccggcgcgcaacgggttaagcaattttaccagtaacctggaagagccggcagtgatggtgaactacttcctgcagggcgacccctataaaggtatggtgcattttacccgcttcttcctgaacaccattctcggtatgggtgggcttatcgatgtggccgggatggcgaatccgcagctacagcgggttgagccacatcgtttcggcagtacgcttgggcattatggcgttggctatggcccgtatgttcagttgccgttctatggaagctttaccctgcgcgacgaaggcggcgatatggccgatggcttgtatccggtgctctcctggctgacctggccgatgtcgatcggtaaatgggcggtggaagggattgagacacgtgctcagctgctggattccgacggcctgctgcgccagtcttccgacccttacattctgatgcgtgaagcctacttccagcgtcatgactttatcgccaacggcggtaagctgaccccggcggacaacccgaatgctcaggctattcaggatgagctgaaggatatcgattcacagtgatcggcgaatgataaaaaaagggtgaacataatgttcacccttttttgtggcgcgctgcttatcagaagcggtagttgaagttagcgccgtacagccaggcggttccttcggaacggaaggtatacgggccttccttaatttcaacatgctgcccgtgcatgtatgaaacgccgacgtcaaccgaggcatctttattgaacgcgtaggtggtacccgcgctcagccacaggcgatcctggtccggaatagagatagagcggttattagccggcaccgggctgtcatcgaaggcgataccggtacggaaggtccagttatcgtcataataataggtggtccccagcgcaagacgataggcgtccttgaagccttcctctttatagaacagcgtctggccgttgctgccggtggctttcagctcctggaactgactccagctggtgtaggtcaggctatagtggaccgcccactgcggcgccacgcggttatagccggacagctcccacatttccggcaggttaagggttagcgaaccattggtcgtctggccgctggtgcccgccggcaggccgaagttgccgaggatctggttataggccgccggcaggctgctgcggtagttaccgtcgaagtcgatcttgacctcagaacggtaggttaaaccgtagcggttattcttatccagctcatagaggatcccggcgttccagccgaagccccacgcgttgccattaagatgggcgatctgcgtgtcggccgggatcttcgctacctggcccgccagcgccggcggcagcgcgccagagcctgcgacaatctgccccagatcgcctgcatagcgctcgatcttcgccttggcgtagaccgcgtcaaagcctaagccgaagctccagttgctgtcgaggcggtaggcgccgctcaggttgaagttcgcggtggtcaggtcggttttaccgcccatgctgccggccgcataatcatcgttatactctgttgccagaccatagttagaggtgatagacgccccccaaccaaattggtcgttaatcggcgcgacaaagtggaagttgggcacccacgccgtcggggcgatattgtctgctttcaggctcttgccggtgggagaggtgcccgaaacattaacgcccgggtcgacaaacacggcgcccgccgacatggtcgggcggtcaaacatcataattaatgccgggttacgactggcattaccagcatcgtcagcgatcgccccttcaccggaataggcacgacccagccccgatgcagagaattcgttgagctggaagcctgctgaccaggcctgggtggaaacaagtgcgacagccactgcaagggcagattgggtaaagcgggttttctggctcatgcccataacctcattgagttatttttttttaaactatgttacatgccgtaacagaagcgcgggagtgtagggtctgcggtacaaccaagaaatcagaccagtgcgctgagtataggtctgaccagatgatttgttgcaagtatgtttatgaagtttttcaattgtgataacagaaacgcgatccagctggcaaaaatctcggagagagcaagggggacagaaggggatttttgttttagatcatttttaagtgtgatttctgtcacttaacgccggcagagcgattctcggctggaggcttaccggggacagggcgtaaaatagacacataatttttctggcaccgaaggtgcatctccagaggaaatctacgatgagtaaatgtagcgctgatgaaaccccggtttgctgctgtatggatgttggcacgattgttgacaacaccgactgcaccgcctcctacagccgcgtattcgccaaccgcgctgaagccgagcaaacgctcgccgcgttaagcgaaaaagcccgcaatgtcgaatctgagccgtgccaaattaacccaaccttcactgacgttgacggcggtgtgcagctggatatcgattttgttttcagctgcgaagcagaatccctgatcttccagctgggcttacgttaatccttccccctcgacgcccctgataaggggcgtttccttttcttttcactgtgttttggctcgcaattttgcgcttctccgattggcttaatgtaaaaaattagttaagaatgttatcaggtcagaccacttggttgtcttggttaacaggggagtgttatgagtcaggcattaccgcttatcacccgtcagggcgatcgcattgccattgtcacggggctacgcacgccatttgctcgtcaggctacggcttttcatggcgttccggccattgatttaggaaaaatggtggttggcgagatgctggcgcgcagcgacattcctgccgaagtcatcgagcaactggtctttggccaggtggtgcagatgccggaagcgccgaacatcgcccgggaaattgtgctgggtaccggcatgagcgtacataccgacgcctatagcgtcagccgcgcctgcgccaccagtttccaggccgtggcgaacgtcgctgaaagcctgatggccggcaccatccgcgccggtattgccggcggcgccgactcctcctctgtcctgcccattggggtcagtaaaacgctggcccgcacgctagtggatgccaataaggcacgcacgctgagccaaaagctgaagctgttttcccgtctgcggccacgcgacctgctgccggtccccccggcggtggctgaatattcaaccggattgcggatgggcgataccgccgagcagatggcgaaaagctgggggatctcccgcgagcaacaggatgccctggcgcatcgttcgcaccagctggcagcgaaagcctgggaagagggtaaactgtccgcagaggtgatgaccgcctatgctccccctttccgcgaaccgctcgagcaggacaacaatattcgtaaaaattcaacgctcgcagattatcagaagttacgcccggcctttgaccgcaaacatggcaccgtcaccgccgccaacagtacgccgctgacggacggcgcggcagcggtgatcctgatgaccgagtcgcgggctaaagagctggggctgaggccgctgggctatctgcgcagctacgcctttaccgccatcgacgtctggcaggatatgctgctggggcccgcgtggtccacgccgctggcgctggagcgcgctggcctgacgctggcggatctcacgcttatcgatatgcacgaagctttcgccgcgcagacgctggccaatctccagtgtctggcaagcgaccgctttgcccgcgaggtgctgggccgctcgcaggccaccggtgaggtagatgaaagcaagtttaacgtcctcggcggctctatcgcctacggtcaccccttcgccgccaccggcgcgcggatgatcacccagacgctgcatgagctgcggcgacggggcgggggatttggtttggtgacggcctgcgcggcaggtggtctgggtgcggcgatgatcgtggaggctgaataatggatactgtttccgcttttaagcttgaggtccgtgcggacaaaatcgcggtgatcaccattgatgccccgggtgaaaaaatgaataccctgaaagccgaatttggcagtcaggtacggggattgatacgccagttacgtgacgataagtcagtgcgcggcgtagtatttatctccgccaaagcggataactttatcgccggcgctgatatcaacatgattgcccgctgccgcagcgcgcaggaggcggaagcgctggcgcgccagggacagcagattatggctgagatccatggcctgtcgatcccggtgattgccgctatccacggcgcctgccttggcggcggtctggagctggcgctggcctgtcatggccgtatctgtagcgatgacgaaaaaacccgactcggcttgccggaggtacagcttggcctgctgccggggtccggcgggacgcagcgtttaccgcggctgatcggggtcagcaccgcgctggatatgatgctcaccggcaagcagctgcggccgcggcaggcgctgaaggccggtctggtggacgaggtggtgccgcaggcgattttactgcaggcggcggtggagttggcgctgaagggacgaccgaccagccgggaggtgcctgttcgtgaacgcgtactggcagggcccctggggcgccatctgttattccagtttgtcggtaaacaaacgcagcgcaaaacgcagggaaattacccggcggtgaagcgaatcttgcaggtcgtcgagaatggtctggcccatggctgcagcagcggatacgctgaagaggcgcgcgcatttggcgaactggcgatgagcccgcagtcgcaggcgctgcgatcgatcttctttgccagtaccgatctgaaaaaagaccctggcgccgaggcgggccccggttcgctgagaagcgttgcagtactgggcggtggcttaatgggcggggggatcgcctatgtgaccgcctgtaagggcgggctgccggtgcggattaaagatatccagccgcgtggcatcaaccacgccttaaagtacagctgggatctgctgaataaacaggttcgccagcgtcgattacgcccagtggagcgcgatcgtcagatggcgctgatctccggcactaccgactatcagggctttgctcatcgcgatgtggtgatcgaggcggtatttgaagacctggctctcaaacagcggatggtcagcgaagtggaacaatacggcgggccgcagaccatctttgcgtcgaatacctcatcgttgccaatcggcgatattgccgctcacgccagccgccctgggcaggtaatcggcctgcattttttcagtccggtggaaaaaatgccgctggttgaggtgatcccacacaagggaaccgacccgcagactatcgccaccgtggtgcagctggctaaacggcaggggaaaacgccgattgttgtcgcagataaagcggggttctatgtgaaccgtatcctcgcgccgtatatcaatgaagcgatgcgcctgctggtggaaggcgaaccaattgaagtcattgataacgcgttggttaaattcggtttcccggtggggccgattcaactgctggatgaggtgggtatcgataccggcaccaaaattatccccgtgctggagagcgcgtttggagaacgttttagcccgcctgcaaacatcattgacgcgattttgaaggacgatcgcaaaggcagaaaaaataatcgtggtttctatctttatgagacaaaagggcgtaaaagcaaaaaacggcccgacccggcagtctatccgctgctcggcatcggccgcccgcagtcgcggctttccgcgcagcaggtggcggagcgctgtgtgatgatgatgcttaacgaagcggcgcgctgctttgatgagcagattatccggagcgcgcgcgatggcgatatcggcgccgtctttggtatagggtttccgccatttcttggcggcccgttccggtatatggatactatcggcgcgggtgaagttgccgcgatcctgcagcgcctggccgcccagttcggcccacgttttacaccctgtgacactttattacgcatggccgaacaggggaccaccttttggccagcggatgaacggctgacctaagttgtggtcaaagaaggtaaatccggctgcggacgacgctgttgattggctgttttgtaaacaatgattgactatacttacgccattgaggtaaaaaacagcgtttcattcgtggaatggatcaggcacaatgcccggccaccgggtcacctgcgtattgtcttcgcaggccaaactacggtgcttctggttaacaaaagcggtgcaatatgcaagtttttattatgcgtcacggcgacgctgccctcgatgcagccagtgactcggttcgtccattaaccgtatgcggttgtgatgagtctcgtcagatggcaacctggctgaaaggtcaaaaagtggatattgagcgcgttcttgtcagtccctatctgcgtgcggaacagacgctggatattgttggggagtgcatgaacctgccgaaacatgtcgacgtgatgccggagctcacgccgtgcggtgatgtgggaatggtgagcgcctatctgcaggcgctggcgaatgaaggcgtggcgacggcgctggttgtctcccacctgccgctggtggggtatctggtctcagagctgtgtccgggggaaacgcccccgatgttcaccacctcggctatcgcctgcgtgacgctggatgccgacggcaaaggtgagttcctctggcaaaaaagcccctgcaacctcaagatggccaacgccatctgacggccccccggagcccgccgttacggcagctccggcggttgccactcctcgacctcaatcaatatcagcagtgcggcgtcaccgccgtactcttttggtgcctggtgaaacgccataatatgcggatgttgcgccagccacagcggggtttgctgtttgaggatgtgtttcccgtgcccgtgcatcacgcaggcgcaaaacacatgctcgcggcggcaggcggcaattagcgcgcccagttcctgtttggcctgctgctgggtaagcccatgcagatcgaggaacagctcaggcgaataatctccacggcgcagctttttcagctcgaaatggctgacgtcggggcggacatatttcgtcgagccttcggtattcagtagcggttgaaactcatcggaaaaatagtggctgttatcgacctgttcctgcagcaaacgcttaggagcaacctcggtaattttcttgcgctgcgggcggtgaacaatagtgtcctgtttgatcttccgcgtgccggtcatcagctgacggaacagcgcctgatcctcctcgctaagcgatgtcttctttttcattgtccgctctcattcatactttgcgctagtttacccgactcaatatcccttcgggcaaggaaaacctgttttttcccccgccccttatcgcaagaatgctgatttatcgccgtcttcatggcacactagccgccgaatttatagcagagtgtgccctggaggatgtcgtggataaaatttttgttgatgaggcagtcaatgagctgcataccattcaggacatgctgcgctgggcggtaagccgtttcagcgctgctaatatctggtacggtcacgggactgataacccgtgggacgaggcggtacagctggtgctgccttcactgtatctgccgctggatatcccggaagacatgcgcactgcgcgcctgacctccagcgagaaacaccgcattgtagagcgggtgattcgccgcgtgaacgagcgtattcccgtcgcctatctgaccaacaaagcgtggttctgcggccatgagttttacgttgatgagcgggtgctggtgccgcgctccccgattggcgaactgatcaataaccagtttgccggactgattaaccataagccgcagcacatccttgatatgtgcaccggtagcggctgcatcgccatcgcctgcgcctatgccttcccggaggcggaagtcgatgcggtagatatctccccggacgcgctggccgtcgccgagcacaacgttgagtcccacggcctgatccatcacgtgacgccgatccgttccgacctgttccgcgatctgccgaagctgcagtacgatctgatcgtcaccaatccgccgtatgtcgatgaagaggacatggccgatctgccggaagagtatgagcatgagccggtgctggggctggcctccggaagcgacggcctgaagctaacgcgccgtatactcggcaacgcgccggattatctcagcgacgacgggattctgatttgtgaagtcggtaacagcatggtacatctgatggagcagtatccggacgtgccgtttacctggcttgagtttgataacggcggcgacggggtctttatgctgaccaaacagcagctgattgacgcccgtgcgcacttcggtatttataaagactaaaaaaacaacacgccaacataacgaaaaagattggagccgtgatggcaggaaatacaattggacaactctttcgcgtcactaccttcggcgaatcgcacggtctggcgctgggctgcatcgttgacggcgtgccgccgggcatcccgctgaccgaagccgacctgcagcacgacctcgatcgtcgtcgcccgggtacctcgcgttacaccacgcagcgtcgcgagccggatcaggtcaaaatcctctccggcgtcttcgaaggcgttaccaccgggaccagtatcggtctgctgattgagaacaccgatcagcgttcgcaggattacggcgcgatcaaagatctgttccgtccgggccacgccgattacacctacgagcaaaagtatggtctgcgcgactatcgcggcggcggtcgttcttctgcgcgcgaaaccgcgatgcgcgtagcggccggggcgattgccaaaaaataccttgccgcgaagttcggcatcgtcattcgcggctgcctgacgcagatgggcgatattccgctggccatcaaagactgggaacaggttgagcagaaccccttcttctgtccggacccggataaaatcgacgccctggatgaactgatgcgcggcctgaaaaaagagggcgactccattggtgcgcaagtgacggtagtggctgacggcgtaccgccaggcctcggtgagccggtcttcgaccgcctggatgccgatatcgcccacgcgctgatgagcatcaacgccgtgaaaggggtggaaattggcgacggcttcgaggtggtgaagctgcgcggcagcgaaaaccgcgatgaaatcaccaaagccgggttccagagcaaccacgccggcggcattcttggcggcatcagcagcggccagcagatcgttgccaacatcgcgctgaagcctacctccagtattaccgttcccggtcatacgattaatcgctttggcgaagaagtggagatgatcaccaaagggcgtcacgatccgtgcgtcggcatccgcgccgtaccgatcgctgaggcgatgctggcgatcgttctgatggatcactttatgcgtcagcgcgcgcagaatggcgacgtgacgacgacaattccacgctggtaaccatgaaaaacaccgttatcgcactgcttgcgctgttggccagcgccggtagcctggccgccacgccatggcagaaaataacccaaccgatcggcggcagcgcccagtcaatcggcgcgttttccaatggctgtatcgttggcgccgaggcgctccccctgagtgcccccggctatcaggtgatgcgtaccgatcagcgtcgctacttcggtcatccggatctggttcagtttattcagcgcctgagtaatcaggtgcacaataaaggtatgggaaccgtgctgattggcgacatggggatgccggcgggcgggcgctttaacggcgggcacgccagccaccagacgggcctcgatgtcgatatcttccttcagctgccgcaaacgcgctggacatcgtcccagctgttgaagccgcaggcgctggacctggtcgccagcgatggcaagcatgtggtgccgtcgctatggagcccgcaaatcagccagcttatcaagctggcggcggaagatagcgaagttacccgcatcttcgtcaacccggcgattaaacagcagctgtgcctggacgcgggcagcgaccgccagtggctgcgtaaagtccgtccctggttccagcatcgcgctcatatgcacgtccgactgcgttgcccggcgggaagtctggagtgcgaggatcaggcgccgccgccgcccggcgatggctgcggagcggagctgcagagctggttcgaaccacctaaacccgggtctaccccccctgtgaagaagacgccgccgccgctgccgccttcctgccaggcgctactggatgagcatgtgctgtaatggatagttttatcgagttgtttgccgtatcgccgctggtgctggtggtactcttctttgtcgccatcctggccggttttattgactcactggcgggaggcgggggcttattgactgtccctgcgctgatggcggccggcatgccgccagcccaggcgctggcgaccaataagctgcaggcctgcggcgggtcgctatcggcgaccctctattttgtccgccgcaaggtggttaatctggccgatcagaagctgaatattctgatgacctttatcggctcaaccgccggagcgctgctggtacagcacgtgcaatccgatattcttaagcagatcctgccgttgctggtgattggcatcggcctttatttcctgctgatgccgaaactgggcgaagccgaccggcagcgtcggctttacggtctgccgtttgcgctggtcgccggcggtagcgtagggttttacgatggctttttcggccccggcgccggttcgttttacgccctggcttttgtcactctggccgggtttaaccttgccaagtcgacggcccatgccaagctgctgaacgccacctcaaacgtcggcggcctgctgctgtttatcatcggtggaaaggttatctgggccaccggctttgtgatgatggccggccagtttattggcgcccgtgccgggtcccggctggtgctcagtaaagggcagtcgctgatccggccgatgatcgttatcgtctcggcggtgatgagcgcgaaacttctttatgacagccacggggctgagattttgcagtggttgggaattcattaatgcaacagcaacaccattatcagcagctgatagaccttttcgacagctgctttgccgaagaatttaatacccgcctgattaaaggcgacgatgagccgatctaccttccggctgacgatgaaacgccctatcaccgtatcgtgtttgcgcacggattttttgccagcgccctgcacgagatctctcactggtgtgtcgccggcaaggcgcgtcgcgaacaagtagattttggctactggtactgcccggacggccgcgatgcgatgacccaaagccagtttgaggatgtcgaggtgaaaccgcaggcctttgagtggctgttctgcgtggcggcgggatttccgtttaacgtcagctgtgacaatctggaaggggacgttgagcccgatcgcatcgccttccagcgccgggtgcatgctcgggtgatgactttacttgaacaagggatccccgaacgtccggcgcgctttattcgcgcgttacaacactattatcaaacgccgccattgacggcgaaacactttccgtggccggaagacctgcactaaggccgcacattacatgacaagaggtaagatgatgatcgcggagtttgaatcacgcattctggcgctgattgacaacatggtagaccacgccagtgatgatgaactgtttgccggcggttatctgcgcggccacctgacgctggcggtggctgagctggaaggtgagggcgagcattctgctgacgcggtacacagcagagttagccagagcctggagaaagccatcagcgctggcgaactgtcgccgccggaccaaattctggtgcaggggatgtggcataacctgtatcaacaggcgaaaaatcaggcctgagccatgttgtagcccgggtcaggcgtcagccgtacccgggaaattgcctgccctcatggttttatttcaccgcttttcccttcagcagttttctcacccacagccgattcggattcagcgccgccagggtgtcgctatccagcggcagcggttccgcgctcatttgcgccgccagcagctcagcgcttaacggcgcggtgcaaagtccgcgcgacccgagcgcgccaagcataaacaggttacgacagaccggcgcgctatcggcgatatccggttgttcgtggaggctggcgtattgcgtcaatgttgccgcgtagtccggcacgttgccgaccatcggtagatgatcgcgggtggcgcagcgcacgccgcagcgagcgtcgttggcgctgatatccacgtcctgtggccactccgcgcccgggaagcagtcgatcagccgttgccggttgtgctgctgatcttcttcgctgaaggtggtgtcggttttcccgcggtggtagctggcgccaatgcagtgctgctgattttgcggattctgtggcgtcaggtagccgtcgtagcacagcacctggcgcagggcggcaagccgcggggtggtgggaatatggctgacctggccgccaaccgggtagaccggcagttgggcggtttgcgcaaaaccagtgatgcggtggccgttcgccagaaccaccgcctgatgatagcgctgctgattgagcagccagccatcgccctccgcgctgagcgtttcgacgggataaccatagtgcacgtgcagtccgcgtgtggccgccagcgccagcagctcggcggtgagctgctgcgggcacagccagccgccggccggataggtgatgccgccgcagccggtatcgacgccggtcagcccggcaacctgttccgccgtcaccgcgcaggcgatgtccgggggtaaattcagcgccagcatctgggcgattttatgcgcgcttttctcatcccagccgagctgggtaacaccgcaccattggtgatcgaacatcaccggcagcgcgtcatacattcggcgggcgaaggtaaaggcggccggaaaaaagcgtgccagcgccggatcgtgctgacttaacagcggatacagcgcgccctggcgattgccggaggcgccctgcgctggagcctcatcggcgcagtaaagggtcacctgccagccgcggcgcagcagcgccagggagagcagggcgctggcgatcccgccgccgatgatggccgcctcgcgggcatcgctgctactgcgagcgaaccaggggacgcgcgcaggaaagctcagcgtttgcgccatctcgccggtcagcatctcccgcttgcggccgaagcctttgcttttacgcatggtaaagccggcctcctgcaggccacggcggacaaaaccggcggaggtaaaggtggccagcgtcccgccgggtcgcgccaggcgcgccatggcgctgaacagatcctgagtccacatgtcgggatttttcgccggggcaaagccgtcaagaaaccaggcgtccacctgctggttcagcgaatcatccagctccctggtcagctcattgatatcgccaaaccacagatcgagcgtcacccgcccgccgtcgagcagcagacgatggcacccgccgaaggccgacggccattgcgcctgcagctgctgcgcccacggagccagctctggccagcgctggtgcgccaggcggagatcctcagccttcagcggatatttttcaaaactgatgaaatgtaacctttgcaaggtaacgtccgggttatcacgaacaaaaacgtcaaacgcctgccagagggtgaggaaattgagcccggtgccgaagccgctctccgcgacgatcatcagcgggcgagggtggctggggaagcgctccggcaggcgatttccgccgagaaaaacgtagcgagtctcttccagaccgttgtcattggaaaagtaaacatcgtcgaaatctcgggaaacaggtgtaccctcagcgttgaattccaggttggcgggttgtatggcgttttgtttcacgtaagttactcgaatcacaaggcgtagcacgatcttaacgatgtgtgcctgagggcgcaaatttatacacaaaatgtctgatcggacttgttcggcgtacaagtgtacgctattgtgcgacacgaaacttaaaatagtgcgacttacagaggtatttaatgaaacgtgcagtgattactggcttgggcatcgtttccagcatcggtaataaccagcaggaagtcctggcatctctgcgtgaaggacgttcagggatcactttctctcaggagcttaaagattcagggatgcgcagccacgtatggggcaacgtcaaactggataccactggcctcattgaccgcaaagtagtgcgctttatgagcgacgcctccatctatgcttacctgtccatggaacaggctgttgccgacgcaggtctggcgcctgaagcatatcagaataacccgcgtgtcggcctgatcgcaggctccggcggcggttccccgaaattccaggtcttcggcgccgatgccatgcgtagcccgcgtggtctgaaagccgtgggcccgtatgtggtcaccaaagcgatggcttccggcgtttccgcctgcctcgctacgccgttcaaaattcacggcgttaactactccatcagctcggcctgcgccacttccgcccactgtattggtaacgcggtagagcagatccagctgggcaaacaggacatcgtctttgccggcggcggcgaagagctgtgctgggaaatggcctgcgaattcgacgccatgggcgcgctttccactaaatacaacgacaccccggaaaaagcgtcccgtacctatgatgctaaccgtgacggcttcgttatcgccggcggcggcggtatggtcgtggtggaagagctggaacacgccctggcgcgtggcgcgcacatctatgccgaaatcgtcggctatggcgcgacctccgatggcgcggacatggtcgccccgtctggtgaaggcgcagtgcgctgcatgcagatggcgatgcatggcgttgatacgccgatcgactatctgaactcccacggtacctccactccggtcggcgacgtgaaagagctgggcgccatccgcgaagtattcggcgacaacagcccggctatttcggcaactaaagcgatgaccggccactcgctgggcgcggcgggcgtacaggaagccatttactccctgctgatgctggagcacggctttatcgcgccgagcatcaacgttgaagagctcgacgagcaggctgccggcctgaacatcgtcaccaaaccgacggacgctaagctgaccaccgtaatgtccaacagcttcggcttcggcggcaccaacgccacgctggtgatgcgtaaatacaacgcctaatcagcatgtgatgcgcaaaggggagccaccggctccccttttttgtcatcttgacagggtaagagcccgcaggcacactgctcgcggatccattagtctctccactaatgcgtaagcgtttaacgtcaaccaacgcgccttaaccctgataatcaggtggagggggcgtgtcgttttgctcgccttactctgcgaatctggagtaatgcatgtccgcagttactgaaacaacatccaattcttcggcgaatttttcgcttttccgtattacgtttgccgtctttttgacctatatgaccgttggtttgccgctgccggtgatcccgctctttgtccatcaggagctggggtttggcaacaccgtggttggcgtggcggtagggatccagttcctcgccaccgttctgacccgggggtacgccgggcgcctggcagaccagtacggcgccaaacgttccgtcctgcaggggatgctggcctgcgccctggcgggcgcggcatggctggccgctgcgctgctgccgctgccggtgctcgccaggctcggcctgctgctgctgggccgcttgatcctcgggtttggcgaaagccagctgctgaccggaaacctgagctgggggatgggcctggtgggtccggcccgttccggcaaagtgatgtcatggaacggcatggcgatgtacggctcgctggcggtgggcgccccgctgggattattgatctatagccattttggcgtggcggtgctggcctgtgtcaccatgggactaccgctcgtcgcctggcttattaacggtaccgtgcgcaaagtggcggcccacggaggcgagcggccttcactctggagcgtcatcggcatgatctggcgcccgggcattggcctgggcctgcagggtgtcggctttgcggtgatcggcaccttcgtctccctctatttcgccagccatagctggccaatggccggctttaccctgacggcgtttggtggcgcctttgtgctgatgcgagtgctgttcggctggatgccggatcggtttggcggcgttaaggtggcgatggtctcgctgctgatagaggcggttggtctgacgctgctgggactggcgccgaatgcctggctggcgctggccggtgcggcgctgaccgggtgcggctgttcgcttattttcccctcacttggcgtggaagtagtgaagcgcgtcccggcgcaggtgcgcggcaccgcgctcggcggctatgcggcctttcaggacatctcctatggcctgaccgggccgctgaccggcctgctggcgacctcgctgggctactcgtcggtgttccttgccggcgccctctgcgcggcgctggggatcctcgtcacccttatctcatttcgccgctaggttattgtccggcctgaaaacgctgtaggaaacaccgcggcgtttggcatgaaggggagccgtaaacgccgccggtggctgctgggctacagcaggagccacagcacaaggagcaggacaaccgcgcccagcgccagctgccacggcttagcgctccacgtccgcctggcgactggctcctcctgcgggatggccagcgtctcctgggcgcgggccacccgcagcacaaacaccttgttcagcagcgccaggatctgcgccgggctcagcgtggtctgcggcgtgacctgccagctgcgacgggcaaagtcgacaattttctgccactccgcggcctccagcggctgcttgagcgctccctgcagcgaggtgagcgtcggcgcgctttgcgcactcagcgtttgccgcgcctgcagccagtacgaaagcggcaggaagtgcgtcgccgggatcagctccccggacttgacgccgcaaagctccagcatggattgccaaatcagcttgcttggttcgccggtggcggccgccagcttagtcaccagctgattgagcgtattatgctcggctggcaacagcgggcgcagggtcggcgggcgctgctgcggctgcgggatcgacagctggccatgctgcagcagatgcagaatgttctccagctgcgtctggctaagggcatgcagcgccgtttgcccataatgctgacgaatataatcgctcaccgcctggcggttattgccctgaccgagcagatcgctgagctgcgctaaggtctggcgatgatgatgattatcctgagcggcggctaagcgctggttgagactggcctccgcggcgctgaaatggcaggccagcaggggcgagtcacctttcagtccgaggtcatgtttgacgcaggcccacacttccgcgttctgctgcgaggtcagcgccaccaggcgcgtgatcagtcgctccagaacggtgcgttgctgcatggaaagcgaaggttcgccggtggcggcagtgcctgatgggcctcgccctggaggacggtctggcatatcagcaagggggtgcgtcatgattcatcctttcgatatcgcggtgctggaaccaggtgatgagtatgcctggcggccagattatggcacacttccccagttaactctcgttctcagacaggtactgaactgtgaaaatcctcgttgatgaaaatatgccctatgcccgtgagctttttagccgtttaggcgacgtgcagacgatcccaggccgtccggtcccggccgatgccctgaccgatgcggatgccctaatggtgcgctcggtcacccgggtcaatgaagcattgctcgccggcaaggccattaagttcgtcggcaccgctaccgccggcaccgatcacgtcgatcaggcgtggctgcagcaggcggggattggtttctctgcggcgcccggctgtaacgccattgcggtggtagagtacgttttttcatcgctgctgatgctggctgaacgcgacggctttgcactgcgcgaccgcaccgtcgggatcgtcggcgtcggtaacgttggcgggcgactgcaaaagcgcctggaagcgttggggatcaaaactctgctctgcgacccaccgcgcgccgatcgcggcgacgaaggtgacttccgctccctcgaggcgctggtccaggaagccgatgtcatcaccttccatacgccgctgtataaagaagggcaatataaaaccctgcatctggcggatgaggcgctgataagccgcctgaagcctggaacgattttgatcaacgcctgccgcgggccggtggtcgataacgccgcactgctaaagcggctggaagctggtcagccgctgagtgtggtattggacgtctgggagccggagccggatctaaacgttgagcttctcaagcgagtggatatcggtaccgcgcatatcgccggctacaccctcgaagggaaagcgcgcgggacgacgcaggtttttgaagcctacagcgcctttatcggccatccgcagcaggtagcgctggacactctgctgccggcgccggaatttggccgcattaccctgcatggaccgctcgatcagccgacgctgaaaagactggtccacttggtgtatgatgtgcgccgcgatgatgcgccgctgcggaaggtggccggcgtcgccggtgaattcgacaagctgcgtaaaaattatcaggaacgtcgcgaatggtcttcgctgtatgtgcagtgcagcgatgagcaggcggcgacgctgttgcgccagctcggttttaacgccgtgcatcatcctgttcgttaatgtcttcttaatgcccctgccggatactccggcggggccgctttatttctggagttaaccaccatgtctgaaggctggaatattgccgtactgggcgcaacgggcgccgtaggcgaagccctgctcgaaactcttgctgaacgccagttcccggtaggagagatttttgctctggcgcgcaacgacagcgcgggcgaacatctgcgttttggtggcaagtcggtgatcgtcaaagacgccgccgaatttgactggacccaggcccagctggctttcttcgccgccggcgtcgaagccagtgcagcgtatgtcgaagaagcgaccaacgccgggtgtctggttatcgatctcagcggcctgtttgcgctggagccggacgtaccgctggtggtgccggacgtgaacccgttcgtattaggcgattaccgcaaccgcaacctgattgcggtgcctaatagcctgaccagtcagctgttgacggcgctcaaaccgctgatcgatcagggcgggttgtcgcgcattagcgtcactaacctgctctccgcctcggggcaggggaaaaaagcggtggatgcgctggcgggtcagagcgctaagctgctgaacggcattcctatcgatgaagacgatttctttggtcgccagctggcgttcaacatgctgccgctgctgccggatcgtgaaggtagcgtgcgcgaagagcgccggatcgtcgatgaagcgcgcaaaattctccaggatgacgggctgatgatctccgccagcgtcgttcagtcgccggtcttctacggccatgcgcagatggtgagcttcgaagcgatgcgcccgctggcggcggaggaggcgcgcgacgcttttacccgcggcgaggatatcgaactttctgaagagggcgaattcccgactcaggttggtgatgcctccggcaatgcccgcctctccatcggctgcgtgcataacgattacggtatgccggagcagatccagttctggtcggtagcggataacgtgcgcttcggcggcgcgctgatggcggtgaagatcgccgagaagctgattgaggagtacctgtactgatgtctgagatggagcaacagccgatctgtaaaatcgcgctgggcatcgagtacgacggcagcaaatattacggctggcagcggcaaaacgaagtgcgcagcgtgcaggagaagctggaaaaggcgctctcgcaggtggcgaacgaaccgattaccgtcttttgcgccggccgcaccgacgccggcgtccatggcaccggccaggtggtgcatttcgaaacccgggcgcagcggaaagatgccgcctggacgctgggggtaaatgcgaatttacctggtgacatcgcggtgcgttgggtcaaacatgtaccggcggattttcacgcccggttcagcgccacggcgcgccgctatcgctacgtcatctataatcatcgcctgcgtccggcggtgttaagtcatggcgtgacgcattttcaccagccgctcgacgccgagcgtatgcagcgcgccgcgcagtgtctgctgggagagaatgactttacctcgtttcgcgcggtacagtgccagtcgcgtaccccgtggcgcaacgtgatgcatattaacgttacccgctacggcgcgtatgtggtggtggatatcaaagcgaatgcctttgtacatcatatggtcaggaatattgtaggcagcctgatggaggtcggggccggaaaccagccggagagctggatggcagaactgctggcagcaaaagacaggacgctcgctgcggcaacggcaaaagcggaagggttgtatctggtgtcggtggattacccggcccactatgatttaccggtgctgccaatgggcccgctgtttctggcggactaatagggtcattaagggtaaagacaaacatggacttgattcactttttaattgatttcatcctgcatattgatgtgcaccttgccgaactggttgcccagtatggcgtctgggtttatgccattctgtttttgattctgttctgcgaaaccgggctggtggtgacgccattcctgccgggcgattccctgctgttcgtcgcgggcgcgctctcggccttgccaaccaacgatctcaatgtccacctgatggtactgctgatggtcatcgcggccatcgtcggcgatgcggtcaactacaccattggccggctgttcggcgaaaagctgttcagcaatccgaactcaaagatattccgtcgcagctatctggataaaacccacagcttttacgaacgtcacggcgggaaaaccattatcctggcgcgctttgtgccgatagtccgaaccttcgcgccgtttgtggcgggaatggggcatatgtcctatcgtcattttgcagcctataacgtggttggggcgctgctgtgggtgctgctgttcacctatgccggctatctgtttggcgatttgccggtggtgcaggagaatctgaagctgctgatcgtggcgatcatcgtcctctccgtcctgccgggtgtgattgagatcatccgccataagcgggcggcgtcaaagcaggcgaagtagtttagcctgtgttgcgcgtgacggtgcagagcgtcacgcgcagcggtttgaccacttttttatcccatgttccgggatgatatgatttaatgtgcaacattcatggtctgtaagaggcaaaaatggcattatgcgccccttacgacaaaactggcatcgaccaggttcaggcagaaaggttatcaatgagctggattgaacgaattaaaagcaacatcactcccacccgcaaggcgagcattcctgagggtgtatggaccaagtgcgacagctgcagtcaggtactctaccgcgccgagctggagcgcaacctggaggtttgtcctaagtgcgatcaccatatgcgcatgtcggcgcgtaatcgcctgcatagcctgttggatgaaggttctctggtagaactgggtagcgaacttgagccaaaagatgtgctgaagttccgcgattcaaaaaaatacaaagaccgcctggcgtccgctcagaaagagacgggcgagaaagacgcgctggtggtaatgaaaggtacgctctacgcgatgccggtggttgccgccgcctttgagttctcctttatggggggctcgatgggttccgtcgtcggcgcacgctttgtgcgcgcggtggagcaggcgctggaagataactgcccgctgatctgcttttccgcctccggtggcgcccgtatgcaggaagcgctgatgtcgctgatgcagatggcgaaaacctccgcggcgctggcgaaaatgcaggagcgcggactgccgtacatctccgtgctgaccgacccgaccatgggcggcgtatcggcgagctttgcgatgctgggcgatctgaacattgccgagccgaaagcgctgatcggctttgccggtcctcgcgttatcgagcagaccgtacgcgagaagctgccgccgggattccagcgcagtgagttcctgattgaaaaaggggcgatcgatatgatcgttcgccgtccggaaatgcgtctcaagctggccagcattctggcgaagctgatgaacctgccggcgccggttgccgtttcggaagcgcctcatgaaggcgtggtggtgccgccggcaccggatcaggaacctgaggcctgataaagcagagggcagggcctggcggcgctgcccttttttattcatacgcgttaaccgtcaattcttacgggcatcatggaaaaagatcctattcctcaggccacgtcgcccctggctacgtggctttcttatctggaacatctgcacagtaaaaccatcgaccttgggctggcgcgcgtcagcgaggtcgccgggcagatggatatcgttaaaccggcgccgttcgtttttaccgtcgcgggcaccaatggcaaaggcaccacctgccgcacgctggaaaccatcctgatggcggccggttataaagtgggggtctacagctctccgcatctggtgcgctacaccgaacgcgtgcgcattcagggggctgaactgccggaggcggcgcatacggcttcgtttgctgaaatcgaagcggcgcggggtgacatctcgctgacctattttgaatacggcacgctctcggcgctgtggctgtttaagcaggcgcagctggatgtggtgatccttgaggtcgggctcggcgggcgtctcgacgccaccaacatcgtggatgccgacgtcgcggtggtcaccagcatcgccctcgatcataccgactggctggggccggatcgcgaaagtatcggccgggaaaaagcgggcatctttcgcgccggtaaaccggcggtggtgggggagccggatatgccgctcaccatcgcggaagtggctagcgagaagggcgcgctgctccagcgccgcggcgtcgactggcgctatgaggtggaaggcgaaacgtggtccttccgcgatacggcaggggcgataagccacctgcctctgcctcaggtgccgttgccgaatgcggcgacggccgtggcggcgctgcgcgccagcgggcttgccgtggatgacgctatcctgcgcgcagggatccgcgatgcgatgctcccaggacgctttcagataatcagcgatgccccgcgagtgatcctcgatgtggcgcacaacccgcacgcggcggcctatctcgccgggcgtctcaaaacgttagcgaaaacgggacgcgtgctggcggttattggtatgctgcatgataaggatatcgccggcacgttggccaatttggccccggaagtcgatgcctggtactgcgcgccgctggaaggcccgcgcggcgcgacggcggagcagctggtggaacatttgcgctgcggtacagtctatagcagcgtggcgcaggcgtggcgtgcggccatggctgacgctaaagtggaagataccgtgctggtgtgtggttcgtttcacaccgtagcgcaggttatggaagagatagacgcggggagaatcggtggcgagtaagtttcagaaccgtttagtcgggacaatcgtgctggtggcgctgggggtgattatcctgccagggctgctggacgggcagaaaaagcattaccaggatgagtttgccgcgatcccgctggtaccgaaaccaggcgatcgcgatgaaccggatatgttgccggcggcaacccaggcgttgccttcgcaaccgccggaaggggcggcggaagaggtgcgggcgggcgatgccgccgcgccatcgttagatccatcgcgtattccggtgaacagcaacagcttcgatgacgttcaggagccggtggtggccgcgaaaccgcagcccaagccgcagccgaaaccgcagccgcaacagcaggcctcgacgccaacgccgccgccggctaagccacagcagcaacagccaccgcagcagcaggcggccctgccggcgccgaccggcaaagcctatgtggttcagctgggcgcgttgaagaacgccgataaggtgaatgagattgtcggtaaactgcgggcctcgggtttcaaagtctatacgtcgccttcgacgccggtacagggtaaaattacccgtatcctcgtcggcccggatgcgtcaaaagacaagctgaaaggccagctgggcgatctgcagcagatctccgggcttagcggggtggtgatgggcttcaccccgaactgattgttttttccgccatgcggagagaacgtggcggggagaaacgccccgcaaaccctgtctcagccgccctgaagaggcgaaaggcagtctggcgttgaatgttttttcagcgccatttttatttctgtagggcatggaaatccctacgcaaacgttttctttttctgttagaatgcgccccgaactggacgacagggcgtaaatcgtgggacgtatatggtctggattgattacgccattatggcggtgctgggtctttcttgcctggtcagcctgatccgcggctttgttcgcgaagctttatcgttagtcacgtggggttgcgcgttttatgtcgccagccattactacgctgacctgtctgtctggtttacgggctttgaggatgaacgggttcgaaatgggattgctattgcggcgctgtttatcgtgacgctcatcgttggcgctatcgtgaactatgtgataggccagctggtggagaagaccggtttgtcaggaaccgacagggtattggggatctgcttcggcgcgctacgtggggtgctgatcatcgccgctatcctgttcttcctggacacctttaccgggatggcgaagagcgatgactggcatcagtcgcagtttattccctattttacccccgtcatcagatggttttttgaatacctgcaaagctcgtcaagtttcttgcctaaagtatagactttgggtcgttgctgaacgaggaaaagacgtatgtgcggtattgtcggtatcgccggtgttatgccggttaaccagtcgatttatgatgcgctaacggtgctccagcaccgtggacaggatgccgctggcatcatcaccattgatgccaacaactgcttccggttgcgtaaggctaacgggctggtaagcgacgtattcgaggcccgccacatgcagcgtatgcagggcaatatgggtattggccacgtgcgttatcctacggcgggcagctccagcgcctccgaggcgcagccgttttacgttaactcgccgtatggcatcacattggcgcataacggcaacctgaccaatgcgcacgagctgcgtaaaaagctgtttgaagaaaaacgccgccatatcaataccacctctgattccgaaatcctcctcaatattttcgccagtgagctggataacttccgtcactacccgctggaagcggacaacatcttcgcggcgattgcggcgaccaaccgcctgattcgcggcgcgtacgcgtgcgtggcgatgatcatcgggcatggcatggtggccttccgcgaccctaacggcattcgtccgctggtgctgggtaaacgtgacgttggcgacggtcgcaccgagtatatggtggcctcggagagcgtggcccttgatacgcttggttttgaattcctgcgcgatgtggcgccgggcgaagcggtctatattaccgagaaaggccagctctatacccgtcagtgtgccgataatccggtcagcaacccgtgcctgttcgagtacgtctattttgcccgtccggactcgtttattgacaaaatttccgtctacagcgcccgcgtcaacatggggactaagctgggcgaaaagattgcccgcgagtgggaagatctggatattgacgtcgttattccgatcccggagacctcctgcgacatcgcgctggaaatcgcccgcattctcgacaaaccttatcgtcagggcttcgtgaagaaccgctacgtcggccggacgtttatcatgcccggtcagcagctgcgtcgtaaatctgttcgccgtaagctcaacgccaaccgtgcggaattccgcgataagaacgtgctgctggtcgatgattccattgtacgcggcaccacctcggagcagatcattgagatggcgcgtgaagcaggggcgaaaaaagtgtatctcgcctccgctgcgccggaaattcgtttcccgaacgtgtacggtatcgatatgccgaccgccaacgaactgatcgcccatggccgcgaagtggatgagatccgccagatcattggcgccgacggcctgattttccaggatctcaacgatctgatcgacgcggtgcgcgcggagaacccggatattcagcagtttgaatgctcggtgttcaacggcgtatatgtgacccgggatgtcgaccagcagtacctcgactatcttgactccctgcgtaacgatgatgccaaagcggtccagttgcagaacgaagtcgaaaacctcgagatgcacaacgagggttaagccgttcacgcgtcgcgggcctgccgtaccgaaaggacggcgggctttttttcgcccctcaactgtgcgtcaatagttgcgccagaggctataatccggcaaagtctgcggcacacgcgcaaggggtaacagaacgtgaaacgactgattattggcatttccggcgccagcggcgccatttacggcgtgcggatgctgcaggtgctaagagatgtgccggatattgaaactcatctcatcctcagccaggcggcgcgccagacgttggccatggagaccgactactccgtacgtgaggtgcaggcgctagccgatgtggtgcatgacgcccgcgatatcgccgccagtatctcttccggttcgtttaaaaccgccgggatggtgattttaccctgctcaatgaagacgctctcgggcattgtccatagctatacggatggcctgctgacccgggcggcggatgtcgtgctgaaagagcgtcgtccgctggtgctctgcgtgcgggaaactccgttccatttgggccatctgcgtctgctggttcaggctgcagagctgggggcggtgataatgccgccggtaccggctttttaccaccggccacaaagcctggacgatgtcatcaaccagaccgtcaatcgggtactcgatcaatttgatattaatctggagcacgacttgtttacccgctggcagggggcctagcgtcgcactatagtggtgcatgaaatgtacgcttgcgctccggtggtgcaaatttgttgccgcgatcaaatcctcgacatttatttcgtctttttgcgctcaggcgctgcggtttcgccagtaatgctggtatcttcccttttaagacaatcctgcaactttattttaacaaatttaaccctgttcccggcacgcaccgggaagatggcacaaaaactgcaggattgatcggcaatcaccataacaagcaacgcaccacatcacgacacgacacttaagggtactgtatgaagaagacgattctggctctctctttactcgtgggaatgagcagcacggccagcgtgtttgctgctctgccgcagagcattcgcattggcactgacgcgacctatgcgccattttcgtcgaaagacgcgaaaggggactttgttggttttgatatcgatttaggcaatgagttgtgctcccgaattaaggtgaaatgtacctgggtcggcagtgattttgactccctgatcccctccctcaaagcgaagaaaatcgacgccatcatctcttccctctctattaccgagaagcgccagcaagagatcgccttctctgacaagctatatgccgctgactcgcgtctgatcgccgccaaagggtcgccgatccagccgacgctggaggcgctgaaaggcaagcacgtcggcgtgctgcagggttctactcaggaagcctatgctaacgaccgctggcgcagccagggcgttgacgtggtggcttaccagaaccaggatctgatctattcagacctcgcagctggccgtctggatgcggcgctgcaggatgaagtcgccgccagcgaaggcttcctgaaacagcctgccgggaaagatttcgccttcgccggcccgtccgttaaagacaaaaagtactttggcgacggcaccggtatcggcctgcgtaaggacgacgccgagctgaaagccgcgtttgataaagcgctgggcgagatgcgtaaagacggcacctacgacaaaatggcgaagaaatacttcgattttaacgtgtacggcgactaagactgctgcaggcccgcacaatggggtgggcctgccgccaggttcgtatccatgccccaaaagggtgcatctaaacgcgctgtggatcatttcagtgcaaaagcagccagttttttggctaaaaaatgcatagttaagcgtttctgatgcaaaaaatcggcctttctggtgcataaatctttgcccttaaggggcgaataatggcacgataactggcgtaaatagttctaataaacccgttagaatgacagtctgtcgaggatagttatgaaaaaactggcgttgtctctctctttagcgctggccctttccagcgtttccacggtctttgcagccatcccgcaaaaaattcgtatcggtaccgatccgacttatgctcccttcgaatcgaagaatgcgcagggagaattggtcggttttgatatcgatctggcaaaagagctgtgtaagcgtattaatacgcaatgtacctttgttgaaaacccgctggatgcgctgatcccctccttaaaagcgaagaaaatcgacgcgattatgtcttcgctgtcgattactgaaaagcgccagcaggaaattgccttcactgacaagctgtatgcggcagattcgcgtctggtggtgaaaaagggcagcccggtaacgccggatctcgccaccctcaagggtaagcgcgtgggcgtgctgcaggggacgactcaggaaacctatggcaatgagcactgggcgccgaaaggtatcgaaattgtctcctatcaggggcaggacaatatctattccgacctgaccgccggccggatcgacgccgcgttccaggatgaggtcgcggccagcgaagggttcctgaaacagcctattggtaaagattaccagtttggtggcccgtcaatcaaagacgagaaactgtttggtgttggcaccggtatggggctgcgtaaggaagacaacgaactgcgtgaagcgctgaacaaggcgtttgcagagatgcgtaaggacggcacctacgacaagctggcgaaaaaatatttcgattttaacgtatacggcgaataattctcacgcctcgccattgcgtgcgtttcgcgcgcaatggtgaatgacagacagggtaggcagcatgctgtatgggttttcacaggttattttgcagggtgcgctcgtcaccctggagcttgcgctcagctcggtcgttctcgccgtcctgattgggctggcgggcgctggcgcaaagttatcgagcaaccgtccactggcgctggtatttgaaggctataccactctgatccgcggcgtgcccgatctggtgctgatgctgctgattttctacggcctgcagattgcgctaaacagcgttaccgatgcgctgggcatggcccagtttgatatcgatccgatgatcgccgggattattaccctcggctttatctatggcgcctattttacggaaaccttccgcggcgcctaccttgcggtgccgaaggggcatatcgaagcggccaccgcctttggctttagcggcgggcagacgttccggcgtattctcttcccggcgatgatgcgctacgcgctgccggggataggcaacaactggcaggttatcctcaaggcgacggcgctggtctcgttgctggggctggaggatgtggtcaaagccacgcagctggccgggaaaagcacctggcagccgttctacttcgccatcgtctgcggcctgatttatctggtgtttaccaccgtttctaatggcgtactgctgctgctcgaacgccgctataccgttggcgtgaagagggctgacctgtgattgaaattattcaggagtactggaaatcactactgtggaccgacggctatcgctttaccggtgtggcgattaccttatggttgctgatctcttcagtggtaatggggggcatcctggcggtgtttctggccatcggccgcgtctcgagcaataagtttatccagttccccatctggctgttcacttacatatttcgcggcacgcctttgtatgtgcagctgctggttttttactccggcatgtataccctggaaatcgtcaaaggcacggagctgttgaacgcttttttccgcagcgggctaaactgcacggtactggcgttaaccctgaatacttgcgcctataccactgaaattttcgccggcgcgatccgctcagtacccgccggagaaattgaagcagcccgggcctacggcttctcttcggtcaaactgtatcgctgcattattctgccttccgcgctgcggattgcgctaccggcctacagtaacgaagtgatcctcatgctgcactctaccgcgctggcgtttaccgctacggtaccggatctgctgaaaatcgcccgcgatatcaactcggccacctatcagccgttcaccgcgtttggcatcgccgcggtgctctatttaattatctcgtatgtgctgattagcttgttccgtaaagcggaaaagcgctggttgcagcatatcaaaccttcttcgacgcattgagaacgccatgtccgacaataaattaaacgttatcgatctgcataaacgctatggggaacacgaggtgctgaagggcgtctcgctgcaggcgaaagccggggacgttatcagcatcatcggttcatcgggttccggaaaaagtacctttttgcgctgtattaacttccttgaaaaaccgagcgaaggcacgatcgtcgtcagcggccaaaatattggtctggtacgggataaagacggccagctgaaggtggccgacaagaaccagttgcgcctgctgcgcacccggttgaccatggtgtttcagcatttcaatctgtggagccacatgacggtgctggagaacgtcatggaagcgccgattcaggtgctgggcttaagcaaacaggaagcgcgcgaacgggcggtaaaatatctggccaaggtcgggatagacgaacgtcagcaggcgaagtatccggtgcatctttccggtggccagcagcagcgtgtctctattgcccgcgcgctggcgatggaaccggaagtgctgctgtttgatgagccgacctccgcgctggatccggaactggtgggcgaagtgttacgcattatgcagcagctggcggaagagggaaaaaccatggtggtggtgacccatgaaatgggctttgcccgccacgtctcttcacatgtcatttttctgcatcagggtaaaattgaagaagaagggcatccggatgcgctgtttggcgcgccgaaaagcccgcgcctgcagcagtttttgaaaggttcgctgaaataatcggctcatccggcgtctgtggacgccggatgagcttcccgctccagccgatagatccagtcatcgtaatcgacgccgttcagatgataggctttctccagcacctgggtgcgcacaaagccttgcttctccagcaggcgcgatgagccacggttttcacccagcacccaggcattgatggcctgcacccccagggtggtgaaaccatactcgcagaccgcccgcagcgcttcgctggcatagccttttccctgagcctgaggcagcagcgcgtagccgacgtcagcttcgtgcggatttttcggactgatgcggagcccaatatcgcccagcgcctcgccgaatttatcgcgcaatacaaacaccccgggatcggcacagcgactgacgaagacgctgcgcagcgcctcctcgcttaacacctcccccataaaacgcatcacctgcggatcctggcgcaggcgcagaaaaaagggccagtcatcggtaacaaagcgggtaagcgaaaggcgtggtgtggtgatggtcgtcataaagcagtcaatacgcagaaagaaaagcctaccttagcactttgcttcgccaggtaacaccggcgaaccggccggctggcggtgaattcaggcgattaagggtgctggttgtcctgaatatggcgatgctgcagcgccgggtgaggccatccaggcgtggagcatgagccagcagaatggaatcaggggagccaatgctcccctgtgtcagccattaactcagcacatcctttagcgcttcgtccagatcgtaccagcggaaggcgaagccggcggcctccagacgctttggcagcgcgcgctggccgccgagcaccaggacggcggattcccccatcaacaggcggatagcggcggcgggaacgcggaaaatcgccggtcgatggagcgcatgacccagcgcatgggcgaactgctcgttatgcaccgggtagggagaaaccatattgaacggaccgcgcagatcgttatccagcagccacagaatgccgttaaccatatcgtcgatatggatccaggccaggtactgtctgccgttgccgataggcccgccgaggccgagcttaaaggcgggtgtcattttgccgagaataccgccccgcggagccagtaccacgccggtgcgcagcaggcagacgcgggtgcgctcgctttgcgcttcgcaggcaatttgctcccagcgggcgcacagcttatgggtaaactcattgtgcggtggctcttcttcggtcaccaccacctcgccgaggtcgccatagtagccgatggcagacccgctgatcagcacggagggaggggtgtcgctggcgtggatcaggcccaccagccgctgcgtgagatcccagcggctatggcacaagcgttgtttctgctcggccgtccagcgtttatcagcgatgggttcacccgccagattgatgacggcatcaatgtcattgaggtggtgatggccctcgaaatcgcgccacagggtgacgcgcggatcgagacgggcgcgggcggtatccggatgtcgcgtggagaccgtgacgctatgcccgagctccagcaatctgggtatcagatgtcggccaatcaggccggtaccaccagtaagcaggatcttcataccacctccctgacatggttagcgacgccagctcatggtcatggacaccgagtcggcatagcgcagcgcatgaagtttatcaatctccacttcagcatatgtgacccagtgatgttcgcatgcgatattcagcacatcctgagttaatttttccagcagcgagaaacggccattctcaagatggctgattatacgcttggtaatggtgcggtagttcagcgcatcattgatgtcctcgctgtcgcgcgctttatcggcagggtagtgaatagctacattcactaccacgtcctggcggttggcgatctcttcctctttaataccaataaaagtccgcaggcgcaggttcttaatacgaataatggcgtctggttgagacattgcaggcttcctccgtggtgtaagtcctgcaatcatacaacaaagcgcgacgggcgagcagggggttaataaagctgaatttttaacatcgcttccgccgttgccggccgctgcttaatgcgctcataccagttgtgcaccgccggatagttcgccagatcgatacgctgtcggacatggcagttcacccagggccaggcggcgatgtcggcgatactgtagtggtcgccgccaagccacgggctgcatcccaggcgctgatttagcaccccatacagtcgttgggtttccacctgaaaacgttcaatagcgtagggcacggtttgcggcgcggtgtgggaaaaatgttgattttgccccagcatcggccccagcccgccgacctgccagaacagccactgcagcgtgacgtagcgttcccgcagctcgccgctcagcagcttaccgcttttttccgccagatagagcaggatggcgcctgactcgaaaacgctcaacggcgccccgccgtcagcaggcatgtggtcgacgatagccggaactttattattcggcgaaatcgccagaaactgcggatgaaattgttcccctttgccgatatcgacccgaattagccgataggctagctccgcctcttcgaggaacagggtgattttgtggccgtttggggtgggtgcatagtaaagatcgatcataatatttcccgccgtcgtgggtcgcaaactgttcgagtataggtgaagctgcgccacccgggagaaattccgcaagcgacccggcagccaggcgacgtgtcgtccgcgctcgagcagtgacatcgcctgtaagacaggctatgttggcttattgtcctgtctaccacccttgaggaagctatgagccagcctgtcattaccctgtggtccgatgccgattttttctcaccgtacgtgatgtctgtctatgtcgctctgcaggaaaaaagcctgccttttacccttaaaaccgtcgacctgaaccgcggcgaacatctgcaggcgggctggacaggctatgccgccacccgtcgcgtaccgctgctggaggttgatgatttcgcgctaagtgagtcttcggcgattaccgagtatctggatgagcgtttcgcgccgccggagtgggagcgcatctacccgcatgatctgcaaaaacgagcccgcgcccggcagatccaggcctggctgcgcagcgatctgatgccaattcgtgaagagcgatccaccgccgtggtgtttgacggggcgaaaatgccggacctcagcgaggccggcaggcaatctgcggaaaagctgtttgccaccgccaccacgctactggcccacggcgggcaaaatttatttggcgaatggtctattgccgacgcagacctggcgctgatgctcaatcgcctggttctcaatggcgataaggtaccggaggcgctggctgattatgcgtctttccagtggcagcgggcctcaatccagcgttacgtggcgctttccgccaaacgctgaggctgataacccgccgcgcttccgctatcatagaggcatcgtaaccagtggagatggaacctatgaagctgatgtttgcctccgatattcatggttcgctgcccgccacggaacgcgtgcttgaacggttcgcgcaaagcggcgccaggtggctgatcatactcggcgatgtgctcaatcacggtccgcgcaacgcgctgcctgaggggtatgcgccgggtgaggtggcggagcggttgaacagcgtggcggaacgcattgttgccgttcgcggcaactgcgacagcgaagtggatcagatgctgcttcgttttccaatcaccgcgccctggcagcaggtgcttagcgaacgctatcgcctgtttctgacccacgggcatctctatagtccggataatctgccgccgctggccgctggcgatgtcctggcatatggccatactcatataccggtcgcggaaaaacgcggcgcaatttacctctttaatcccggctcagtgagtatcccgaaagggggatattccgccagctatgggctgctggatcaggggcggctgcaggttttagcactcaatgataatcaggttattgcagaggttgcaatttacccgtaatttagccctcaatcataaagacgcgccgcgagagcgcatttaaagtaaggtttcctgatggcggaacagaatcatttggcaagcacagaatgggtcgatattgttaatgaaaacaatgaggtgatagcacagtccagccgcgagcaaatgcgcgcgcagtgcctgcgccaccgggcgacctatatcgtcgttcatgacggaatggggaaaattctggtgcagcgacgcaccgagacaaaagactttcatccgggcatgctggatgccaccgctggcggcgtcgtgcaggctgatgagcagctgctggaatcggcccgtcgcgaggcggaagaggagttaggcatcgccggggtgccgtttgccgatcacggccagttttattacgaagacaaattctgccgcgtctggggaagcctgttcagctgcgtctcccacgggccgttcgccctgcaggaagaagaggtcagcgaggtgtgctggttaacgccggaagagatcaccgcccgctgcgatgagttcacgccggactccctgaaagcgctggcgctgtggatgacccgcaacgccggtaatgagtatgatgatgcggaagagagcgagcgcgaataaagatcgcaaacgcgcggcagcaatcgtcgctcgcctcctgacgacaaaaaggcagccattcggctgccttttgctttgaccacagcggcagattacttctgctgctgagccgattggatcgcggtcagtgcgatggtatagacgatatcgtctaccagcgcgccacgggacaggtcgttgaccggcttgcgcataccctgcagcatcggcccgatggagatcaggtcggcagagcgctgtaccgctttgtacgtggtgttaccggtgttcagatccgggaagatgaacacggtcgcgcggccagctaccggtgagttcggcgctttggacttcgctacgtcagccatcaccgcggcgtcatactgcagcgggccgtcgatcatcaggtcaggacgtttttcctgcgccagacgggtcgcttcgcggactttctcgacatcgctacccgcgccggaggtaccggtggagtaggagagcatcgccacgcgcggttcgatgccgaaggcaatcgcggattcagcggactgaatagcgatttccgccagctgctcggcggtcgggtccgggttgatcgcacagtcgccgtaaacgtaaacctgttccggcagcaacatgaagaacacggaggagaccagcgagctgcccggcgcggttttgatcagctgcagcggcggacgaatggtgttggcagtggtgtgaaccgcgccggataccagaccgtcgacttcgtcctgttccagcatcagggtgccgagaaccacgttgtcttccagttgctcacgcgcgaccgcttcggtcatgcctttgttcttacgcagttcgaccaggcgacccacatagctttcgcgaaccacttccggatcgacgatttcaatgccggcgccaagctcaacgccttgggccgcggctacgcggttgatctcatccgggttacccagcaggacgcaggtggcgatcccgcgttcggcgcaaatcgccgccgctttcacggtacgcggttcgtcgccttccggcagaacgacacgtttgccggctttgcgcgccagctcggtcagctggtagcggaaggctggcggagagagacggcggctgcgctcggaggtcgcggtcagcgattcgatccagtcggcgttgatgtagttggccacgtattcctgaactttctcgatacgctcgtgatcgtcaaccggtacttcgaggttaaagctctgcaggctcagggaggtctgccaggtgttggtgttgaccataaataccggcaggccggtcgcgaaagcgcgttcacacagcttgctgatgcgtgcgtccatttcatagccgccggtcagcagaatggcgccgatttccacgccgttcattgccgccaggcaggccgcaaccagcacgtcaggacggtctgcggaggtaaccagcagagaaccagggcggaagtgttccagcatgtgcgggatgctgcgcgcgcagaaagtcacggatttcacgcggcgggtattgatatcgccttcgttaatgatggtcgcattcagatggtgagccatgtcgatcgcgcgggtcgcgatcagatcgaagctccatggcactgcgcccagcaccggcagcgtactgcctttctgcagctgagccgggtcaatcttcacgatttttgctttcgacgagtcgtcgaaaatttccgacaggtcaggacgggtacggccctgatcgtcgacaggggcattcagtttgttgacgataacgccggtgatgctggtatttttggcgccgccaaagctgttacgggtcagttcgatacgctcgttcagctgttctggcgtgtcggtgccctgagacatcacgaagacgatttcagcgttcagcgttttggcgatttcaaagttcagcgcctgggcgaactgatgcttacgggtcggtaccaggccttccaccagcaccacttccgcgtcctgagtattcgcgtggtagttggcaatgatctcttccatcagcacatctttctgattgctggagagcagagactcaacatggctcatcttcagcggttcagcggcggtggtggtggaggagctggcgcgaacgatggtggtggtctggtctggggcatcgccaccggaacgcggctgggcgataggtttaaagacgctcagacgaacgcctttgcgttccatagcgcggatcacaccgaggctgacgctggtcagacctacgctggtaccgggaggaattaacatgatagtacgggacacggtatatcctctttcgttaccgccagtatcaggcgggatacaaaacagcaccgccagctatccgtcatatttcaagttgcacgtgcgttggctctacttgctcaccccggtggcgtacgcgctgtacgcggccggggttttgctgtgtcgccgccttcctgcagctcgaattattgcgggtcagggctggcgatgtggaattatgcggtcagacggctggcgtcttgcgcgatgaccagctcttcgttggtcgggataaccacggcaggacgggtgccttctttgttgatgaagccagacttgccgaagcgggcagcaaggttacgctcatggtcaacttcaaagcccagtacgcccagtttgcccagcgacagctcacgcaccatcgcggcgttttcaccgataccaccggtgaaaataacggcgtcaagacggccgtccatcagcgcggtgtaggaaccgatgtatttcgccaggcggtggcagtaaacgtccatcgcgcgtttagcgtcggctttttcctgatagttgtcttccacgtagcggcagtcgctggtgacttcggtcagacccagcaggccggactctttggtcagcattttgttgatcgcgtcaacgctcatgcccagggtgtcgtgcagatggaagatgatggccggatcgatgtcaccggagcgggtacccatcaccaggccttccagcggggtcagacccatggaggtgtcaacgcatttaccattacggatagcggaaacagaaccaccgttgccgaggtggcaggtgatgatgttcagctcttccaccggcttgttgaggatcttagcggcttcctgagtcacgtagaagtggctggtgccgtgcgcgccgtaacgacgaacgccgtgctctttgtacaggctgtacggcagggcgtagagataggattcttccggcatggtctgatggaacgccgtatcgaatacagccacgtttttgtctttcaggtgcgggaaggattttagcgcttcagcgatgccgatcaggtgtgccgggttgtgcagcggtgcgaaagacgcggcgtctttaataccctgaattacggactcgtcgatcaccacggagctggtgtatttttcaccgccgtgtacgatacggtggccgattgcggtcagctgagcagacagttctggtttttgtgccagaatagtgttaacgataaagttcagcgcttcactgtgcgcggcgcccgcgcctaactcggcttcttgtttgctgccgtccattttccatttgatacgggcttccggcaggtggaagcattccgctaaaccggacagatattcgtcgccgttcacggcgtcaaggatagcaaatttcagagaggagctaccgcagttcagaaccagtactaacttactcgacatggaagtacctttttatgatacgtggctaaaaaaacgtcagtgtgtcattagcgtagcgcaggatgacctcgacatttatgattaacatcatgccttgttctgttttcgggcacgatgagagaagtacatttgattttatgccattttgcataattttcagccaatggcagaatatgcgataatttgactagcctggcaaagagtctaaccgccctttcaggcgggcacaggatacctgattgcggcatcctttgccaaaatcttttgaacgatgtcatgcatagttggtgttttgcacgaattttttaagttttatatgtaaagttgaggtaaagccatgtcgacccctgagaaacgccccgttagcttctttagcttgttcaaccgcgggcagcattacgcaaagacctggcctctcgacaagcgcctcgcgccggtgtttattgaaaaccgcattattcgtgccacccgctatgccatccgcatcatgccgccaatcgccatttttaccctctgctggcagatagctcttggcggccagctgggccccgccgtcgctaccgcgctgtttgcgctgagcctgccgatgcagggactctggtggttgggtaagcgttcggtgacgccgctgccgccttccattcttaactggttctatgaagtgcgcggcaaactgcaggaggcggggcaggcgctggcaccggtcgaaggcaagcccgattatcaggcgctggctgacacgcttaagcgcgccttcaaacaactggataaaactttccttgatgatttgtaattcactacggaaaacgcatataaaagaaggcgcatgatttatgcgccttctttatttcacgccctaccgtgctacaggagtcacaacatggaaatgaccaatgcgcagcgtctgattttatccaatcagtacaaaatgatgacgatgctcgacccggataatgcggaacgctaccgtcgtctgcaaaccatcatagagcgtgggtatgggctacagatgcgtgaactggaccgcgagttcggccagctgacggaagaaacctgccgtaccgttattgatatcatggagatgtaccacgcgctgcacgtctcctggaccaacctgaaagacgcggcgggtatcgatgaacgccgggtcaccttcctcggatttgatgccgccaccgaagcgcgttatctcggctatgtgcgttttatggtcaacgttgaaggccgctacagccattttgacgccggtacccatggctttaactcgcagaccccgatgtgggagaaatatcagcggatgctgagcgtctggcacgcttgcccgcgccagtatcatctgagcagtaatgaaattaatcaaattatcaacgcctgagggaggtgcccgtgcagtgtaaaggtttcctgttcgatttagacgggacgctggtggattccttgccggtggtagagcgttcatggtgcaagtggggcgatcgtttcgccattgaccatgatgaaattctcagttttattcacggcaagcaggccattacctccattcgccattttatgccggggcgcagcgaggaggatatccaggccgaatttcgctacctcgagcagatagaagccactgatattgagggtatcgtcgcgctgccgggggcattagccctgctgaatacgctcaatgaggccgggatcccgtgggcgattgtcacctccggctcgattccggttgcccacgcgcgtcatcgcgcggcgggcctgccgatgcctgaggtgttcgtcaccgccgagcaggtgaaacacggcaaaccggcgccggacgcctatttgctgggcgccgagcggctgggtctgcctgccggggagtgcgcggtggtggaagatgcgccggcggggctcctctccggactggcggccggctgtcgcactatcgcggtcaacgtgcccgccgatgcccctcgcctggatgaagccgacctcgtgctgagcagcctggaagatctggtggttgaacgccagactgacggcgtggtaaatgtgcgtcttaaagcgtaaacccatgatttcgccccgcgtcgtcggggcttttttatgccactatgtcgactcccacttgtgacaaggaaacgttgtgaacggtgaattgatttgggttttatccctcctggccatcgcggttgtgctgtttgctaccggcaaggtgcgcatggatgctatcgccctgatggtcattgtcgcctttgtcctcagcggaacgctgacgttaaatgaagctttttccggattcagcgatcctaacgtgatcctgattgccgccctgtttattatcggcgatggcctggtgcgcaccggagtcgccaccaaaatgggggcatggctggtgagcgtggcggggaacagcgaaaccaagatgctgatctacctgatgctcaccgtcgccggtctgggcgcgtttatgagctccaccggggtggtcgccattttcatcccggtggtacttagcgtctcggcgcggatgaatacctcgccatcgcggctgatgatgccgctgagcttcgccgggcttatcagcgggatgatgaccctggtggcgacgccgcccaacctggtggtcaacagtgaattgctgcgcgagggactgcacggcttcagctttttcagcgtcacgccgattggcctggtggtgctgatcctgggcatcgtctatatgctggcggtgcgctttatgctgaagacggataatggcgactccgcacgcgatgggcgaaaaagaagcaccttccgcgatttgatccgcgaatatcacctcaccggccgcgctcgccggctggccatccgcccgggttcgccgatgatcggtcagcggctggatgatttaaagctgcgtgagcgctactgcgccaacgtgatcggcgttgaacgctggcggcggttccgccgggtaattgtcaacgtcaacggggtatcggaatttcgcgcccgcgacgtcctgctgatcgatatgtccgcctccgatgtcgatttacgccagttctgcggcgagcaaatgcttgagccgatggtgctgcgcggcgagtattttgccgatcaggcgctggatgtggggatggcggaggtggcgctgatcccggattcagagatgattggcaaaacggtgcgtgagatagccttccgcacccggtttggtctcaatatcgtcggcatgaagcgcgatggcaaagcgatggatggttcggtggtcgacgagccgctgcagctcggcgatatcctgctggtggtcggcaactggcggcaaattgccctgctggcgaagcgcggccgggatttcgtggtgctcaatatgccggttgaggtcgatgacgcttcgccggcccacagccaggctccgcatgcgattttctgcctggtgctgatggtagccctgatgctcaccgatgaaattcccaacccgattgccgcgattatcgcctgtctgctgatgggcaaattccgctgcatcaatgccgagagcgcctacaaggcgatccactggccgagcattattttgattgttgggatgatgccgtttgccctggcgctgcaaaaaaccggcggggtggatctggtggtgaagggactgatggatgtcgccggaggcgaggggccttatctgatgctcggctgcctgttcatgatgtgcgcggcgattgggctgtttatctcaaacaccgccacggcggtgctgatggcgcctattgccttagcggcggcgaagtcaatgggcgtctctccctatccttttgccatggtggtggcgatggcggcttcggcggcgtttatgaccccggtctcctcgccggttaacaccctggtgcttggccctggcaagtactcatttagcgattttgtcaaaataggcgtgccctttaccatactggtgatggtggtctgcgtcctgctgatcccggtactgtttccgttttaagatattctggccgggtagagcacaaccgccgcccggccagaaccttacagcggcgaatcctggctaatttcgtccagcgacagctggaagcttgggacgaacacttgcataaagtaatccatctccgcgctgcgccgcgatgccagggtcttttccagccgacctttggccagcagaaattcgttattgcctgcagatagctcttcgaggcacttcaggtaagcgcagagggcgtcagcctgtttaacgatcgactgctcttcctcactgtagtgatgctcatcaatcagcggctcgaaaatatcgcgcagctcgtcagggaccatatccaccagcttttgctgagcaattttctcaatcgccttatattcctgggcaatctgcgaattgaaatatttcaccggagtagggaggtcgccagttagtacttccgaggcgtcatggtacatcgccagcagggcgatacgctcggcgttgacctggccgccaaatttgcggtttttaatcgccgccagcgcgtgggcgaccatcgccacctgcaggctgtgttcggagacattttcggtgcgcacgttgcgcatcagcggccagcggttaatcagtttcaggcgggagaggtgggcaaagaaatgactctgactcatagggacccttaatcagtgacaacatcgggttccattgtgcgcagggatcgccgccggatgcaaatgccggcggcggcgcgattaaagctgatggtagccggagaggaagcggccaaagcgggagatagccatctccaggtcgtcttcgcgcggcagggtcacgatgcgtacgtgatccggccacggccagttaaaggcggtgccttgcaccagcaggactttctcctgcagcaggaagtcgagcaccattttctggtcgtcatgaatattgaagcgtttggcgtcgattttcgggaacatatacagcgcgccttttggcttcacgcaggagacgcccggaatatcgttgataagctcccaggcgcggttgcgttgttcatacaggcgtccgccggggatgatgaattcgctgatgctctgatagccgcccagcgccgtctggatagcatgctgggccggcacgttggcgcaaagacgcattgaagccagcatctccagcccttcgatatagcccttcgcgtgttttttcgggccattcagcaccatccagccctgacggaagccggcaacgcggtaggttttcgacaatccgttaaaggtcaccgtcagcaggtccggcgccagggcggcaatagagtgatgctgggcttcgtcgtagaggatcttgtcgtaaatttcatcggcgaaaatgatcagattatgctgacgagcgatctccacgatctcctgcagcaattctttggaatagaccgcgccggtggggttgttagggttaatgatcacgatcccgcgggtgcgcggtgtgatttttgcgcggatgtcgtccagatccgggaaccagtcagaggattcgtcacacagatagtgtaccgctttgccgctggaaagcgacaccgccgccgtccacagcgggtagtccggggcgggaaccagcatctcatcgccgctgtttaacagcgcctgcatcgcctgcacaatcagttcggacacgccgttgccgatatagatgtcttccaccgtgacatcgcgcataccccgggcctggtaatgctgcatgatagctttacgcgccgagtacaatcctttcgaatcgcagtaaccctgggcggtaggcaaattgcggatgacgtcgacgaggatctcgtcaggggcctcgaagccgaatggcgccgggttgccgatgttcagtttcagaaccttattgccttcttcttcaagacgtttggcttctttcagaaccgggccgcggatgtcataacagacgttctctaacttgctggatttttcgatgggggacatgaatcttgaccttttagctgttatcgccactccctgccgtggaagtcagcacggaacaatgtactccccctccccgctgttttgaaggctttgcaggagaagattttgctaacgccggattttaagcgcaattgatttatctaccgattgcgggtttggtctgtggcttatgcctttttatgtcgattttttggtcgtaaatatagatttagtagcgattttgccatcatttatctcgtttgtttgcccggtaatatggggagggagaagggggagtcgctaaaaaacgctatcctgcatacaagcgcgattggcttgtaattttgatgttaaataattttaataaaaaacagcgtgcgaccacattattattatttttagcgggtaataatctgaggtttgttaattaatataaaatgttgaaaaaaatttaaaattgtctcagttaatccttattaaggcttataaaaaggagggggataggttagaatatcaccgttaatatccgtgttaaccgccaagaactgcggttgcattgagatttaatatattgttattacaggattttattgttccttttctgccggaaagttacgccagaagagcgattttctcagcatcactgaccgggttcccgcggcgacgtatggcgcctggctggtcgtggtaataaataataatgagaaatacgaacaatatattattccgcagttctgcgcatttgcccagacgagtactttggcatgtaataacgttcgtccagttgtttatccgccgttagacggtgagcacgaggctcagggaatagccggaaacctggcgtaaagcatcaacaaggcaggtcagcgttagccacctgtaagtgaagaaagatgattaatacaacacgtcccatactcaacctcgatctcgatctgctgcgtacctttgtcgcggtcgctgatttgaacacttttgccgccgccgccgccgcagtgtgtcgtactcagtccgcggtcagtcagcaaatgcaacgcctggaacagctggtgggcaaagagcttttcgcccgccacggccgcaataagctgctgaccgagcaggggatccagctgctgggctatgcccgcaaaattctccgttttaacgatgaagcctgtatgtcgctgatgtatggcagcctgcagggggctctgagcatcggtgcgtcagaagaaacggctgacaccatcctgccgtttttgttaaaccgcatcggctgtttctatcccagaatgacgttggagatcaaagttcatccccatgccgccatcatggagatgctggccgaggggctggtcgatctggcgttgaccacccatcagcctcccggctttacctcttttaccctgagaacatcacctactctctggtattgtgcagcggaatatgtgctggcgaagggggaatctatccccctgatcctgctcgaagagccaagtccattccgccaggatattatcgccgcgctggaaactgctcgcgtcagttggcatctggcccacggagcttcctcgctatcgggcgtgaaagcggcggtgaaggccgggctgggcgtgacggcgcgcccggtcgaaatgatgagcccggatctacgcgtggctggcatcagtgaggggttaccggcgttgccggacacccggtacgtcgtcagctgcaatccgcggacggtgagcgaactgccgcaggcgatttttcagtctctgagccaggagatccatccctgggaaacgggcacagcacttactccggaagagggagggaataccttggttttgtaagggtattcttgctaacaaagatcacaaaaactggtaacagaatgtaagtgcccaaaaagagcctcaggagttggtttcccgcctggcggctcttttttttgcactcttattgatgttttgaatcttttttgtatttctttgcagaaaaatcagcgtattggcgtgacaaggcgctcagcttgtcgacttttccctgcactttcaacacttcctgctaatgttaaaaaaccggatggattgttgccgatttcctggggtaattaacaaaaccgtgtcgcagatcaagaaaatacccctctttggggggaggaatcgaggctaaatcctgtcaaaatagaagggatttttgatttacgacggaaacggacacgattcaacaacactaaaaccgaacagtatgcaaggttatttcgcagaaaagggcatttaatgttaatgaaaagattccaatgtaaattaatgttatgaaaacttttgttaaagttgacaaaaggttaaagaaaggggtaaaaagccacggcatctgggcttctcacatcgaccagggacgcttttttgcacggttattttttattcctcccgtgaaacgctgtggcgttcatctgccagtaagagcagagggttttggcgctacacttttttggttaagcaatgcgtatgtcaacatccactgaagtcatcgctcatcattgggcattcgctatatttctcatcatcgctatcggcctgtgctgcctcatgctcgtcggcggctggtaccttggcggtcgcgcgcgcgcgcgtagtaaaaacacgccgtttgaatcggggatcgactccgtcggttcggcccgcttacgtctttctgcgaagttttatctggttgccatgttcttcgttatcttcgacgtggaagccctgtatctctacgcatggtcgacctctatccgcgagagcggctgggtcggctttgtggaagccgcaattttcattttagtgctactggctggtctggtttatctcgttcgcatcggcgcactggactggacgcctgcgcgttcccgtcgcacgctggttaacccggaaacagacagtcccactaaccgtcatatgcagtaaaagcgaggcaataagatggattatacgctcacccgcatagatcctaacggtgagaacgaccgttatcccctgcagaaacaggagatcgttaccgatcctctggagcaggaagtcaataaaagcgtgtatatggggaaactcgaacacgcgctgcatgacatggtgaactggggccgtaagaactcaatttggccgtacaacttcggcctttcttgctgttatgtggaaatggtgacgtcattcactgcggtgcatgacgttgcgcgttttggggcagaagttctgcgcgcctctccgcgtcaggcggacctgatggtggtcgcgggaacctgctttaccaaaatggcgccggttattcagcgtctctacgatcagatgctggagccgaagtgggtgatctccatgggcgcctgcgccaactcaggcgggatgtacgacatctattccgtcgtccagggcgtggataaattcattccggtcgatgtgtacatcccgggctgcccgccgcgtccggaggcctatatgcaggcgctgatgctgctgcaggagtccattggtaaagaacgtcgtccgctctcatgggtggttggcgatcagggcgtttatcgcgccaatatgcagtcggaacgcgagcgtaaacgcggcgaacgtattgcagtgaccaatctgcggacgccggacgagatttaatttgcgcctgcgggcgggagaaccacttcgcaaatcaatctacaacagcgcgaagtctcgccggcagtcaccacggaccttttgcaatggtgaacaatatgaccgatttaaccgcgcatgacgccgcaccagcctggcaaacccgcgatcaccttgatgacccggtgattggcgaactgcgcaaccgctttgggccggatgcctttaccgttcagccaacccgtaccggcgtaccggtggtatgggtgaagcgtgaacagctgctggaggtgggtgatttcctgaagaaattgccgaagccttacgtgatgctgtttgacctgcacggcatggacgaacgtctgcgcacgcaccgcgatggcctgcccgccgcggatttttccgttttctatcacctgatctccatcgatcgcaaccgcgacatcatgctcaaggtggcgctgtcggaaaacgatctgcatctgccgaccttcaccaaactgttccccaacgccaactggtatgagcgtgaaacctgggaaatgtttggcattaccttcgatggtcacccgaacctgcgtcgcatcatgatgccgccgacctgggaaggtcacccgctgcgtaaagattatccggcgcgtgccaccgagttcgacccgtttgagctgaccaaagccaaacaggatctggagatggaggcgctgacctttaaaccggaagagtggggcatgaagcgcggcaccgacaacgaggacttcatgttcctcaacctcggtccgaaccacccatcggcgcatggtgcgttccgcattattctgcagctggacggcgaagagatcgtcgactgcgtaccggatatcggttatcaccaccgcggcgccgagaagatgggcgagcgtcagtcctggcacagctacatcccgtataccgaccgtattgaatatctcggcggctgcgtcaacgagatgccgtacgtgctggcggtggaaaaactggctgggatcaccgtaccggatcgcgtgaacgtgatccgcgtgatgctctccgagctgttccgcatcaacagccacctgctgtatatctcgacctttattcaggacgtcggcgcgatgacgccggtcttcttcgcctttaccgatcggcagaaaatttacgatctggtggaagcgattaccgggttccgtatgcacccggcgtggttccgcatcggcggcgtcgcgcacgatctgccgcgtggctgggatcgcctgctgcgtgagttcctcgagtggatgccgaagcgtctggactcctatgagaaggccgccctgcgcaacaccattctgaaaggccgttccgtcggcgtggcagcctataccgccaaagaggcgctggagtggggcaccaccggcgcaggcctgcgcgccaccggtatcgacttcgacgtgcgtaaatggcgtccttactctggctatgaaaacttcgacttcgaagtcccgaccggggggggcgtctcagactgctacacccgcgtgatgctgaaagtagaagagctgcgccagagtctgcgcattcttcagcagtgcctcgataacatgccggaaggcccgttcaaagcggatcacccgctgaccacgccgccgccgaaagagcgcacgctgcagcatatcgaaaccctgatcacccacttcctgcaggtatcgtggggcccggtgatgccggccaacgaatctttccagatgattgaggcgaccaaagggatcaacagttactacctgaccagcgacggcagcaccatgagctaccgcacccgcgtgcgtacgccgagctttgcgcacctgcagcagatcccgtcggcgatccgcggcagcctggtatccgacctgatcgtctatctgggtagtatcgattttgttatgtcagacgtggaccgctaattatgcacgagaatcaacaaccacaaaccgaggcttttgagctgagtgcggcagagcgtgaggctattgagcacgagaagcaccactacgaagacccgcgtgcggcgtccatcgaagcgctgaaaatcgttcagaaacagcgcggctgggtgccggatggcgcgatctacgctatcgccgatgtgctggggatcccggccagcgacgtggaaggcgtggcgacgttctacagccagattttccgccagccggttggccgtcacgtgatccgctactgcgacagcgtggtatgccacatcaccggctatcagggtattcaggccgccattgagaagaaactgaatatcaagccggggcagaccacctttgatggccgctttaccctgctgccgacctgctgcctgggtaactgcgacaagggaccgaccatgatgattgatgaggatactcacagccatctgacgccggaggcaattcctgacctgcgggagcagtacaaatgaaaaccgtaattcgtactgcggaaacgcatccgctcacctggcgcctgcgcgacgacaagcagccggtgtggctggacgagtatcgcagtaaaaatggctatgaaggggcgcgtaaagccctgaccgggatggccccggatgagattgtcacggcggtaaaagacgctggcctgaaagggcgcggcggcgcgggcttctctactggtctgaagtggagcctgatgccgaaagacgaatccatgaacatccgttacctgctgtgtaacgccgatgaaatggagccgggcacctataaagaccgcctgctgatggagcagctgccgcacctgctggtggaaggcatgctgatctccgcgtttgcgctgaaagcgtaccgcggctacatcttcctgcgcggagaatatattgaagcggcccagcatctgcgtcgcgcgattgctgaagccaccgaagcgggtctgttggggaaaaacatcctcggcaccgggtttgacttcgagctgttcgtgcacaccggggcagggcgctatatctgcggcgaagagacggcgctgatcaactctctggaaggccgccgcgccaacccgcgatccaagccgccgttcccggcgagctccggcgtctggggcaagccgacctgcgtcaacaacgtagaaaccctgtgcaacgtgccagcgatcctcgccaacggcgtcgagtggtaccagaacatttccaccagcaaagatgctggcaccaagctgatgggcttctccggccgggtgaagaatccgggcgtctgggagctgccgttcggcaccactgcccgcgagatcctcgaagattacgccggcggtatgcgcgatggcctgaagtttaaagcctggcaaccgggcggagcagggaccgacttcctcaccgaagcgcacctcgatctgccgatggaattcgaaagcattggtaaagcgggcagccgtctgggcacctcgctggcgatggccgttgaccacgagatcaacatggtctcgctggtgcgtaaccttgaagagttctttgcccgcgagtcctgcggctggtgtacgccgtgccgcgatggtctgccgtggagcgtgaagatcctgcgcgccctggagcgcggcgaaggccagcctggcgatatcgaaacccttgagcaactgtgtcgattcctgggcccgggtaaaaccttctgcgcgcacgcgccgggtgcggtcgagccgctacagagcgcgattaaatatttccgcgaagaattcgaggctggcattaagcagcagttcagcaatacccatgcaatcaacgggattcagccgaacctgcttaagacgcgctggtaatctaaaggttttttatttttggaagcacgcaaatggctacgattcatgtagacggcaaagaatacgaggtcaacggggcggacaacctgctagaggcttgtctctctcttggtcttgatattccctacttttgctggcacccggcgctagggagcgtcggtgcttgccgccagtgtgcggtgaagcaatatcagaacgcggaagacacgcgtggtcgcctggtgatgtcctgtatgactccggcatccgacggcacctttatttctatcgacgacagcgaagcgaagcagttccgcgaaagcgtggtggagtggttgatgactaaccacccgcacgactgcccggtctgcgaagagggcggcaactgccacctgcaggatatgacggtgatgaccggtcatagcttccgccgctatcgtttcaccaagcgtacccaccgcaatcaggatctggggccgtttatttcgcacgaaatgaaccgctgcatcgcctgctaccgctgcgtgcgctactacaaagattatgccgacggcaccgatctgggcgtctatggcgcgcacgacaacgtctacttcggccgcccggaagatggcaccctggagagcgagttctccggcaacctggtggaagtctgcccgaccggcgttttcaccgacaaaacccactccgagcgctataaccgtaagtgggacatgcagtttgcgccgagcatctgccagcagtgttccatcggctgtaacatcagcccgggcgaacgctatggcgagttgcgtcgtatcgaaaaccgctataacggtaccgtgaaccgctacttcctctgcgaccgcggtcgtttcggctatggctacgtgaacctgaaagaccgtccgcgtcagccggtacagcgccgcggcgacgatctgatcacccttaacgccgagcaggcgatgcagggggcggcggatatcctgcgccagtcgaagaaagtgatcggcatcggctccccgcgcgccagcattgaaagcaacttcgcgctgcgcgagctggtgggcgccgacaacttctataccggtatcgccaaaggcgaacaagcgcgcctgcagatgatgctgaaagtgctgcgcgagggcgggatccacacgccaagcctgcgcgatatcgaatcctacgatgcggtactggtgctgggcgaagacattacccagaccggcgcgcgcgtggccctggcggtacgccaggcagtgaaagggaaagcacgcgaaatggcggcggcgcagaaagtggccgactggcagatcgccgcgatcctcaacatcggccagcgcgccaagcacccgctattcgtcaccaacgtcgatgacacccgcctggatgacatcgcggcgtggacctaccgcgcgccggtagaagatcaggcgcgtctcggctttgctattgcccatgcgctggacgacagcgcgccggcggttgacggcctgagccaggacctgcagggtaaagtcgacgttatcgttcaggcgctggccggggcgaaaaaaccgctgatcatctccgggaccaacgcaggcagcatggagatcatccaggccgccgctaacgtggcgaaagctctgaaaggccgcggcgccgatgtcggggtgaccatggtcgcccgggcggttaacagcgtcggactgggcatgatcggcggcggctcgcttgaagaggcgctggacgaactggaaagcggcgccgcagacgcggttatcgtgctggaaaacgaccttcaccgtcatgcttccgccgcgcgcgttgacgctgcgctggcgaaagcgccgctggtgatggtggtggatcatcagcgcaccgcgattatggacaaagcgcacctggtgctctccgcggcaagctttgcggaaagcgacggtaccgtggtgaacaacgaaggccgcgcccaacgtttcttccaggtttacgatccggcttactacgacgcgaaaaccgtaatgctggaaagctggcgctggctgcattcgctgcacagcaccgtcaacaaccgtcaggttgactggactcagctggaccacgtcattgatgcggcgattgcggcgctgccgcagctggcgggcattaaagacgccgcgccggatgcgaccttccgcatccgcggccagaagctggcgcgtgaaccgcaccgctacagcggccgcacggcgatgcgcgctaacatcagcgtgcacgagccgcgtcagccgcaggataaagacacgatgttcgccttctccatggaagggaacaaccagccgtccgccccgcgttcgcagatcccgttcgcctgggcgccgggctggaactccccgcaggcatggaacaagttccaggatgaagtgggcgggaaactgcgccacggcgatccgggcgttcgtctgtttgaagcgtccgccagcggactggagtacttcacggcggtgccggccagcttccaggcggaagagggcaaatggcgaattgcgccgtactaccatctgttcggcagcgatgagctgtctcagcgcgcgccggtgttccagagccggatgcctgagccgtacatcaagctgaacccggcggatgccgcgaagcttggcgtcaacccaggcgcaatgctctcctttagcgtggaaggccagaccctgcgtctgccgctggttatctctgaaggcctgaccgcgggacaggttggcttaccgatgggcatgccgggcattgcgccggtgctgaccggatcgcgtattgattcactgcaggaggcgaaagcatgagctggttaacgccggatcttatcgacattctgttaagcatcctgaaggccgtggtcattctgctggtggttgtcacctgcggcgcgttcatgagcttcggcgagcgtcgtctgctcggcttgttccagaaccgctacggacctaaccgcgtcggctggggcggttcgctgcagctggtcgccgacatgatcaagatgttctttaaagaggactggatcccgcgcttctccgatcgcgtgatctttactctggcgccggttatcgcctttacctcgctgctgctggccttcgctatcgtgccggttagcccgacgtgggtggtggccgacctgaacatcggcatcctcttcttcctgatgatggctggcctggcggtctacgcggtgctgttcgccggttggtcgagcaataacaaatactcgctgctgggggcgatgcgtgcttccgcgcagaccctgagctacgaggtatttctcggtctctccctgatgggcgtggtggcgcaggcggggtcattcaatatgaccgatatcgtcaataaccaggcgcatctgtggaacgttatcccgcagttcttcggcttcgtgactttcgccatcgccggcgtggcggtgtgtcaccgtcacccgttcgaccagccggaagcggagcaggaactggccgatggttaccacattgaatattccggcatgaaattcggtctgttcttcgtcggggaatacatcggtatcgtcaccgtttcagcgctgatcgtcacgctgttcttcggcggctggaatggcccgtggttacctcctttcatctggttcgcgctgaaaaccgcgttcttcatgatgatgttcattttgatccgcgcatcattaccgcgtccgcgctatgaccaggtaatgtcctttggctggaaggtatgcctgccgttaacgctggtcaacttgttggtaacggcggctgtcattctctggcaggcgcaataaggggtgaattgaacatgaccttaaaagaattattggtggggttcggcacccaggtccgtagtatctggatgattggcctgcatgccttcgccaaacgtgaaacccggatgtatccggaagagccggtctacctgccgccgcgctatcgcggccgcatcgtgctgacccgcgatccggacggtgcagagcgctgcgtcgcctgtaacctgtgtgcggtagcctgcccggtgggctgtatctcgctgcagaaagcagagacggtagacggccgctggtatccggagttcttccgcatcaacttctcacgctgcatcttctgcggcctgtgcgaagaagcgtgcccgaccacggcgatccagttgaccccggacttcgagctgggtgaatacaagcgtcaggatctggtgtacgaaaaagaggatctgctgatttccggtccgggcaaatacccggaatataacttctaccggatggcgggtatggcaatcgacggcaaagataagggcgaagcggaaaatgaagctaagccaatcgacgtcaagagcctgttaccgtaaggagaggggcaatggaattcgctttttatatctgtggcctgatagccatcctcgcaaccttgcgggtcgtcacccacaccaatccggtgcatgcgctgctgtacctgattatttcgctgctggcgattgccggggtgttcttctcgctgggcgcgtacttcgccggagcgctggaaatcatcgtctacgccggagccattatggtgctgttcgtcttcgtggtgatgatgctcaacctgggcggcaccgagatcgaacaggagcgcaagtggctgcagccggggatctggattggcccggccatcctctccgcggtgctgctggtggttatcgtttacgccatcctgggcattaacgaccagggtatcgacggtgcggcgattaacgccaaagaagtgggcattgcgctgtttgggccgtacgtcctggcggtggagctggcctccatgctgctgctggcgggcctggtggttgccttccacattggccgcgaagagcgcgccggcgaggtgctgagcaaccgtctgaacgacagcgacaaacgaaaaacggaggaacacgcatgatccccttaacacatggactgatcctcgcggccatcctgtttgtgcttggtctgacggggctggtgatccgccgcaatctgctgtttatgttgattagcctggaaatcatgattaacgccgccgcgctggcctttgtggtggcgggtagctactggggtcaggcagatggtcagataatgtatatcctcgccatcagcctcgcggctgcggaagcgagtatcggcctggcgctgctgctgcagctccatcgtcgccgccagaacctgaacatcgattcagtaagtgagttgcgtggatgaacatgcttgccttaaccattcttttgccattgattggctttgtgctgctggccttctcccgcgggcgctggtcggaaaatctttccgccgccgttggcatgggctcggtaggcctggcggcgctggtcaccgcgtacgttggcgtcgactttttcgctaacggcaaacaggcggtcagcgtgccgctgtggacctggatgtcggtcggtgatttcaacatcggcttcaacctggtgttggacggcctgtcgctgaccatgctctccgtagttaccggcgtcggcttcctgatccacatgttcgcctcctggtacatgcgcggtgaagagggatattcccgcttcttcgcctataccaacctgtttatcgccagcatggtggttctggtactggccgataacctgctgctgatgtacctcggttgggaaggcgtgggcctctgttcttacctgctgatcggtttctactacaccgatccgaagaacggcgccgcagcgatgaaagcgtttgtggtgacccgcgtcggcgacgtgttcctcgccttcgcgctgttcattctttataacgaactgggcaccctgaacttccgcgaaatggtggagctggcgccgcagcacttcgctaacggcagcaccacgctgcagtgggcgacgctgatgctgcttggcggcgcggtcggtaaatccgcccagctgccgctgcaaacgtggcttgccgatgcgatggcgggtccgacgccggtctctgcgctgatccacgccgcgaccatggtcaccgcgggcggctatctgatcgcccgtacccacggcctgttcctgatgacgccggaagtgctgcatctggtcggtatcgtcggggcggtcaccctggtgttggcgggcttcgccgcgctggtgcagaccgatatcaaacgcgttctcgcctactctaccatgagccagattggctacatgttcctcgcgctgggcgtgcaggcatgggacgcggcgattttccacctgatgactcacgcgttctttaaagcgctgctgttcctgtcgtctggttcggtcattctggcctgccatcacgaacagaacatcttcaagatgggcggcctgcgcaaatcgattccgctggtatacgtctgcttcctggtggggggcgcggcgctgtccgcactgccgcttatcaccgcaggcttcttcagtaaggatgagattctggcaggcgcgatggccaatggccatatcaatctgatggtggcaggcctggtcggcgcctttatgacctcgctgtacaccttccggatgattttcatcgtattccacggtaaagagcaaattcacgcgcacgcagggaaggggattacccatcatctgccgctgattgtgctgctggtactatccaccttcgttggcgcgctgattgtgccgccgctggagggcgtactgccgcagaccactgagctcgcccacggtagcgtgatgacgctggagattgcctccgggatcatcgccattgccgggattctgatcgctgcatggctgtggctgggcaaacgcacgctggtgacctccatcgccaacagtgcgcctggccgcttcttcggtacctggtggttccatgcctggggcttcgactggttatacgacaaggtgttcgtaaaaccattcctcggtattgcctggctgctgaaacgcgatccgctgaactcgttgatgaatatcccggcgatcctttcccgcttcgcaggcaaaggcctgctggtgagcgagaacggttatctgcgctggtatgtggcttcaatgagcatcggcgcggtggtggtgctggcgctgctgatggtattgcgttgatttgatcgcgcggttttgcccggtggcgcttcgcttaccgggcctacgagaccgtaggtcgggtaagcgaagcgccacccgacacaacaaaccgcactcaaacgtgaatgtagtcgaattcgttgaaaatcggtcctgaacgggactttaacaaggaataaaaatcgccatgttactaccctggctaatattaattccctttatcggcggcttcctgtgctggcagaccgaacgctttggcgtgaaagtgccgcgctggatcgcgctgattaccatgggactgacgctggtgcttggcctgcagctgtggatgcagggcggctattctctgacgcaatccgcgggtattccgcaatggcagtcggaattcgtgctgccgtggatcccacgcttcggcattagcatccatctggcgatcgacggcctgtcgctgctgatggtggtgctgaccggtctcctcggcgtgctggcggtgctctgttcgtggcgtgaaatcgaaaaataccagggcttcttccacctcaacctgatgtggatcctgggcggcgttatcggcgtgttcctcgccatcgacatgttcctgttctgcttcttctgggaaatgatgttggtgccgatgtacttcctgatcgcgctgtggggccacaaagcctcggacggtaaaacgcgcatcacagcggccaccaagttcttcatctatacccaggcgagcggcctggtgatgctgattgccattctggcgctggccttcgtccacttcaacgccaccggcgtgtggaccttcaactatgaagatctgctgaaaaccccaatgtctcacggcgtggaatacctgctgatgctcggcttcttcatcgccttcgcggtgaaaatgccggtggtgccgctgcacggctggctgccggacgctcactcccaggcgccgaccgccggctctgtcgacctcgcggggatcctgctgaaaaccgccgcctacggtctgctgcgctttgcgctgccgctgttcccgaatgcctccgccgagtttgcgcccatcgctatgtggctgggcgtgatcggtatcttctacggcgcgtggatggccttcgcccagaccgatattaaacgcctgatcgcctacacctccgtgtcccacatgggcttcgtgctgattgctatctacaccggcagccagctggcctatcagggagcggtgatccagatgattgctcacggtctgtccgcggcgggtctgtttattctctgcggccagctgtacgaacgtctgcacacccgcgatatgcgccaaatgggcggtctgtggagcaaaattaaatggctgccggcgatgtcgatgttcttcgcggtcgccactctggggatgccgggcaccggtaacttcgtcggcgaatttatgatcctgttcggcagctataaagtggtgccgacgatcaccgtcatctccacctttggtctggtattcgcgtccgtttactcgctgtcgatgttacatcgcgcttacttcggtaaagcgaagagcgaagtggcggcgaaagagttgccggggatgtccctgcgtgaactgtctatcatcctgctgctggtggtgctgctggtgctgttgggcttcttcccgcagccgatcctcgacacctcgcatgctgcgatgagcaacattcagcagtggtttgttaattctgtttctactacaaggccgtaattcgccatgacaataactccacaacaactgatcgcactgctaccgctgctgatcgtcggcttgacggtggtggttgtgatgctctccattgcgtggcgacgcaatcattttctcaatgccacgctgtcggttcttggacttaacgccgcgctggtctcgctctggttcgtcggccagaacggggcgatggacgtcacgccgctgatccgcgttgacggctacgccatgctttacaccggtctggtgctgctggcgagcctcgcgacctgtacttttgcctacccgtggcttgagggttacaaggacaacaaagaagagttctacctgctggtgctgatcgccgccctgggcggcattctgctggccggtgcgaatcatctggcggcgctgttcctcggtattgagctgatttcgctgccgctgttcggcctggttggttacgccttccgccagaagcgttcgctggaagcgagcatcaaatacaccatcctctccgcggcagcttcgtccttcctgctgttcggtatggcgctggtgtatgcgaactccggcaacctgtccttcctcgcgctgggcaaaagcctggcggacaacatgctgcacgagccgctgctgctggcgggtcttggcctgatgattgtcggtcttggctttaaactgtcgctggtgccgttccacctgtggacgccggacgtttaccagggggcgcctgcgccggtctccaccttcctggcgaccgccagcaagatcgctatcttcggcgtagtgatgcgtctgttcctgtacatgccggtgggcaacagcgaagcggtacgcgtggtgctgggcctgatcgccttcgcctctatcatcttcggtaacctgatggcgctgagccagaccaacattaagcgcctgctcggttactcttccatctcccatctcggctatctgctggtggcgctgattgccctgcagagcggtgaaatgtcgatggaagccgtgggcgtttacctggccggttacctgttcagcagcctcggcgcgttcggcgtggtcagcctgatgtccagcccgtaccgcggcccggatgctgactcgctgttctcctaccgcggcctgttctggcaccgtccgatcctgtcggctgtgatgacggtgatgatgctctccctggccggcatcccgatgaccctcggctttatcggtaagttctacgtgctggccgtcggtgtgcatgcgcatctgtggtggctggttgccgcggtggttgtcggctcggcgatcggtctctactactacctgcgcggggccgtcagcctgtacctgagcgcgccggagcaactgaatcgcgatgcgccgtcaaactggcagtacagcgccggcggtatcgtggtgctgatctccgcgctgctggtgctggtgctcggtatctggccgcagccgctgattagcatcgtgcagctggcgacgccgctgatgtaagttgattgactcaataaaaaaccgccgggatggcggtttttttatgcccggattttacgccatcttgtagaccataaagtcttccgccagcagcgtgttagggaaaatctcccggcattccgccagcatacgcagacagccttcggcatcgtagcgcgagctaaagtgggtggcgatcagcgtaccgacccccgcttctttggcaagcgccgcggtctgctgactggaagagtggccgcggctattggctttctccgccatcgcctgctcaagggtggtttcgtggaccattacatccgccccgcgagccatctccagcgcctgcgggcagggggcggtatcgccgaagatggtcagcgttttacccggggtcgctggccccagatagcggctgccgtcgatgacccggccatctgccagcgtgacgcgctgtccgcgcttgagttgatggaacagcggcccgggaggcacgccatcggcaatcagctgggcggcgtcgagggtgccgggcttgtcatgctgcgcaatgcgatacccatagcactccaccggatggctgagcggatacgcggtgacccgatagccctcttcgtcgaacaccagaccagggccgacttcgatgatggtgagcggatagtcggtccacgaaccgctcaggcgcagcgcggtctcaacaaactctttgagtccttttggcccgtagagggtgaggggcagggagtttccctgcatcgagcggctgcacagcaggccgggcaggccgaacaggtggtcgccgtgcagatgggtaataaaaatcttattcagtttgccgggatggtagggcgtgtgaagaaactgatgctgggtcccttcgccgcagtcaaacaaccacatttcagcgcgggtcggctgttgcaaattcagtattatcgacgtcatattacgcgtgcgggtcggcaccccggcggatgtccccaaaaaagttaattccatcgtccagtgtcctcagggcgagtcgcaaagtatcagtatatcaataaggagcagcagatgatgacctggcaggatctccaccatagtgaactcaccgttccccagctgtatgcgctgctgaaattgcgcagtgaagtctttgtcgtagagcagcagtgcgtctatcaggatgtcgacggcgatgatttggttggtgaaaatcgccatctgctcggctggcgcgatggcgaactggtggcctacgcgcggatcctcaaaagcgaagaggagtttgcgccggtggtgattggccgggttatcgtcagcacggccgcccgcggtgagaggcttggctatcagctgatggagcaggcgctggccagctgtcagcagcactggccgcaaaaggcgatttacctcggggcgcaggcgcacctgcaatccttttacgcccactttggttttacgccggtgaccgaggtctatgatgaggatggcatcccccatattggcatggcgcgagaaaagcgcgctgtctgactcctctgccccctcgtccagacgctgctctgacccggcgagcgggtaagataaaacccgctccctcatcatgggtactgctattccgccgtcgaaccccttataatgtggggttttactaccgtggaggtttgcgtgctgtctgtttccactgcgctggcccgtttgcaagacggcctgggcgagtcttttccagactcgcccggcacgcgaattatcgatgttgcctttccgctgaatgatgccttcgatccgctactatggtgcggccagcaggcgcaatggccgcagttttactggcagcagcgcaatggcgatgaggaactggcgacgctgggggcggtaaaaacctttttctcgctcgacgcggcgaaccgctttttacgccaggccggccggcaggatctgcgtatctgcggcctgaatgcgtttgaaccgcagcagggcagcctggcgctgccgcgtctggagtggcgccggtgcggcggcagggccgtgctgcggctggtgctgcatagtgatatctccctgcgtgaggatgccgcgacggcccgcgcgtttctcgccagcctgacaaccactcaggcgactcccggtgccataccgccgttgctgagcgagcgccactcatccgactatcctcaatggcaggcaatgattgcgcgggcgactaaggcgatcagcgccggtgaaatggataaagtagtgctggcgcgggcaaccgacctgcagtttgccgccccgctggacgccatgagcatcatggcggctagccggcgcagcaatcttaactgttttcatttcctgatggcgttcaatgcccggcaggcatttttcggctccacgccggaacggctgtggcgccggcgcggcgcgctgctgcgcaccgaagcgctggcggggaccgtcgcgaaccatcaggaagacgcgaaggcgcagcaactggccgactggttgatgaaagacgacaaaaaccagcgggaaaacatgctggtggtagaggatatctgccagcgcctgcagagtgaggcctcgacgctggacgtcctgccgccgcaggtggtgaggctgcgtaaggtgcagcatctccgacgctgcatctggaccgagctggcggcgcctgacgacagccgctgtctgctgcagctgcagcccaccgccgcggtggccggcctgccgcgccgggcggcgctggcgttcattcagcgtcatgaaccgttttcccgcgaatggtacgccgggtccgccgggtatctgtcactggcgcaaagcgagttttgcgtggcgctgcgttcggcgaaagtgaaccacgacaccctgcggctgtatgccggggcggggatcgtcagcggctctgatgcacagcaggagtggcaggagattgacaacaaagcggccgggctgcgctcgctgctgtgtccataaagcttgaatgacgatgcatatcaaaacgacgtcactttgccttatctatacttagcatcaatatttgataccggacaatttcatgtcagtaagcgcatttaaccgacgctgggcggcggtgatcctggaagctttaacgcgccatggcgtgcagcatatctgcatcgcgccgggctcacgctcgacacccttaaccctggcggcggcggaaaaccgcgcctttatccatcatacccatttcgacgaacgcggcctcggccacctggcgctcggactggcgaaggccagccggcagccggtggcggtgatagtcacctccgggaccgccaccgcaaacctctatccggcgctgattgaggcagggctcaccggtgaaaagctgatcctgttaaccgccgaccgtccgccggagctgatcgactgcggcgcgaaccaggctatccgccagccggggatgtttgcctcccatcctgcgcagacgatttctttgccgcgtccctcgcaggatattcctgcccgctggctggtctcaaccatcgaccaggcgctgggcgcgctgcacgccggcggggtgcatattaactgtccgttcgctgaaccgctgtatggtgatatggatgagaccggcgtggagtggcagcagcagctcggcaactggtggcagagcgacaaaccctggctgcgccaggcgctgcagttagagagcgagaagcagcgcgactggttcttctggcgacaaaaacgcggcgtcgtcgtggcgggcagaatgagcgccgcggaagggaaaaaggtcgctgagtgggcgcagaccctcggctggccgctgatcggcgatgtcctgtcgcagaccgggcagccgctgccgtgcgccgacctgtggctgggcaacggcaaagcggtcagcgagctggcgcaggcgcagatcgtcgtgcaactcggcagcagcctgaccggcaaacgcgtgctccagtggcaggcgacctgcgagccggatgaatactggctggtggataatctgcccggtcgcctcgacccggcgcagcaccgcggtcgccgtctgctctcaagcgttgagcgctggctcgaattacatccggcggagaaacgccagccgtgggcgacggtgatcccacagcttgccgggcaggcgtggcaggctgcagtcgccagcaacgagccttttggcgaagcgcagctggcgcagcgtattcggggctatctgccggagcagggccaattgtttgttggcaacagcctggtggtgcgcctgatcgacgccctggcgcagctaccggccgggtatccggtctacagcaaccgcggcgccagcggcatcgatggcctgatcgccactgcggccggcgtgcagcgcgccagcgcccgaccgacgctggccatcgttggcgatctctccgcgctctacgatctcaactcgctggccctgctgcgccaggcgtcggcgccgctggtgctgatcgtggtgaataacaacggcgggcagattttttctatgctgccgacgccgcaggacgaacgccgtcagttctatttaatgccgcaggacgtggatttcagccacgcggcggcgatgttcggcctggcctatcatcgccctgatgactggccgtcgctggatgaggcgctggccggcgcctggcgcagggcaggggcgacggtgattgagctggcggtcaatgagaccgacggcgcgcagaccctccagcagctgctggcgcaggtaagtcgcctgtgatcctcagcgctgctgtcgacaacggccagccgggctatccctggctggtgtttctgcacggtttttccggcgaccgcaacgagtggcggaaagtgggcgacgcctttcccgcctggccgcggctgtacctcgatctgccggggcacggcggctccgcggatatcgcggtgcaggactttgccggggtcaatactctgctgcagtctatgtttaatagttacaacatacataagtattggctgatcggctactcgctgggcggccgggtggcaatgaacttcgccagccatgcgcgcgcaggcatgcgcgggctgatcgttgaaggcggccatccgggcctgcaggatgcagaggcgcggcaggcgcggcgcagcaatgaccgcgcctgggcggaacgttttcgccgcgagccgcttgagcaggtctttgccgactggtatcagcagccggtcttcgcttcgctgaatgccgcgcagcgtgagtcattggtcgccttacgcagccggaacaacggcgcgatgctggcggcgatgctgcaggcaacctcccttgccgcgcaggccgatctgcgcgcgtctctgcaggcgcgcgattttccttttcactacctgtgcggcgagcgcgacgcgaagtttcgcgccatcgcgcagacgctcgcggcggatctccatcttattcaccatgccggacacaacgcgcaccgggacaacccggcggcggtgattgcctgtctggcgcagattctggcaagttaactgaaggacattctatgatctctcttgatgaagcaatgctctacgcccccgttgaatggcacgattgctccgaaggctataccgatattcgctatcacaaatcgactgacgggattgccaaaatcaccattaatcgtccgcaggtgcgcaacgccttccgcccgctgaccgtcaaagagatgattcaggcgctggcggatgcccggtatgacgacaatatcggcgtcatcgtgctgaccggtgaaggtgagaaagccttctgcgccggcggcgaccagaaagtccgcggcgactacggcggctatcaggacgactccggcgttcatcatcttaacgtgctcgacttccagcgtcagatccgcacctgtccaaaaccggtggtggcgatggtggccggctactctatcggcggcggtcacgtgctgcatatgatgtgcgatctgactatcgcggcggaaaacgccatcttcggccagaccgggccaaaagtcggctctttcgacggcggctggggcgcctcctatatggcgcggatcgtcgggcagaaaaaagcgcgcgaaatctggttcctgtgccgccagtatgacgctcagcaggcgctggacatggggctggtgaataccgtggtaccgctggcggatctggaaaaagagaccgtgcgctggtgtcgtgaaatgctgcagaacagcccgatggccttgcgctgcctgaaagcggcgctgaacgccgactgcgacggccaggctggtctgcaggagctggcgggcaacgccaccatgctgttctatatgacggaagaggggcaggaaggacgcaacgccttcaaccagaaacgtcagccggacttcagcaaatttaaacggaatccataatgcgcgtttcgcaggtttaccgctggcagataccgatggacgcgggcgtggtgctgcgcgagcggcggttaaaaacccgcgacgggctgttcatccgcctgcaggagggtgaacgcgaaggctggggcgaaatttctcccctgccgggattcagtgtcgagacgctggaagaggcgcaaatggcgctgttagcgtgggcacaggcctggcgcgacggcgccgagccgccgcttcccacgcagccctccgtcgcgtttggcatcagctgcgcgcaggcggagcttggcggcgaactaccgcaggccgcggattatcgcgcggcgccgctctgctccggcgatccggatgagctattcgccagactggcggcgatgcccggcgagaaggtcgctaaggtcaaagttggcctctgggaggcggtccgcgacggtatggtggtcaatctgctgctggaggcgatccccgacctgcagctgcggctcgatgccaaccgcgcctggacgccgctcaaagcgcaacagttcgccaaatacgttaatccggcgtaccgccagcgcattgcttttcttgaagaaccttgcaaaacgcgggaggattctcgggcctttagccgcgagacagggatcgctatcgcctgggatgaaagcctgcgcgaggcggatttccgctttgtcgccgagccgggcgtacgtgcggtggtgatcaaaccgacgctaaccggcagtttgcagaaggtgcagcaacaggtcgccgcggcgcatgcgctggggttgagcgtagtgatcagctcgtcgatcgagtccagcctcggcttgacccagctggcgcggattgccgcctggctgacgccgcagactattcctgggctggatacgctgtcgctgatgggcgcccagctggtacggccgtggcccgaaagtgcgctgccggtgctcaacattgatgcgctggagccgctgctgtgacctttaacgactggccctggcggcattggcgtcagcggcgcggagaggccctcgccttacgtctgaataaccagccgctgacctggcgggagctatgcgcgcgggttgacgcgctggcgtctggttttgccgcgcagggcgtaatggaagggcagggcgtggcgctccgggcctataaccagccggaaactctgctggcatggctggcgctgctacagtgcggggcgcgggtgctgccgctgaatccgcagctgccagcggtgttgctgcaggcgttgttacccgcgttaaccatgcagcatcagctggtgctgaatggcgatgtgttgccggggaatttaccgatgttaaccctgcagttggtcgagggcgagcatgctgcttgctggcatggcgatcggttgctgtcgatgacgttgacctccggttcaaccggcctgccgaaagcggcggtacatagcgccaacgcccatctggccagcgcggctggcgtgctggcgctgatgccgtttgccgcaggagatgactggctgctgtcgctgccgttgttccatgtctccggtcaggggatcgtctggcgctggctgctggccggcgcgcgactcacggtacgtgacaaacagccgctggcgcagatgctgcacggctgtacccatgcttcgctggtgccgactcagctatggcgcctgctgaatgatgatgctgcggtttccctcaaggcggtgctgctcggcggcgcgtcgatcccggtcgaattgactgaacgggcgcgaaagcagggcatacgcagcttctgcggctatggcctcaccgaattcgcctccaccgtgtgtgccaaagaggccgacggcgctgcggatgttggcgaagcgctgccggggcgagaggtgaaaatagtcgccggcgagatctggctgcgggcgtcgagtatggccgcaggctactggcgggatggtcaattgttgtcattaaccaacaatgaaggctggtttgcgacgcgcgatcgcggagcattgcataacggtcggctgacggttgttgggcgaatggataacctcttttttagcggtggagaaggtattcaaccggaagaggtcgagcgtgtgatactcgcccatccacaggtacagcaggtgtttatcgtgccgctggatgatgcggaatatggccagcgcccggtagcggtggtggaatgcgatgacggctgcgagttgagcgcgctggcggcatggagcgctgagcggttagcgcgttttcagcagccggtgcgttggctgcggttgccggaaacgttaaaaaacggcgggattaagatttcgcgccgggcgctgtgcgagtgggtcaggcagcagacgcatgcgaccgtatcgtagccacccgcattatcccgcggcataacgccgggtgggttgaacgcggtatgctggactaaagtagccctttcaggctgagagtaacgcgggtggcggcattaagatcgtagtttttgagatcttcggctttgacccaggcgtaatcgtcaaactcctcgttgatcgtcacatcgcgattggcgctcacgcagtcgaagatgagatagatcatgtagatcgtttcctgatgcccgtcggggtaggttttgacgcgggtatcgtcgcgaaagcaccatggcgcgatatgggtaaggatgagtttttcgccgagctcttcgcgtatttcccgccgcagcgcctcttcaatccgttcccctggctccacgccgccgccggataaggcccattgcccgggaaaaaccccgcggtcggcggccattttgcaaagcagataatggccttcattctcgatcagcgggcaaacaatcgtcctttggcgcatgggttttctcctgcagagggatggggcggtatgctggtgaaatagtttgcgagccgcctcggtaaactgcaagcgaaatacagttcaggtcttgttgagtgctacgttaagcgaaaatgattgtatggagcaccgccatggaaagggcgacgaattccccccacgatgctgtatttaaacacctgctgtcgcatcgggcgacggccagggattttctggacattcaccttcccgcaccgctgcgcgcgttatgtaatctgaacacgctgcggctggagtccgggagctttatcgacgacgaactgcgggcgagtcattccgatatcctttactcgctgcaaacgcaggcgggggagggctatatctatctgttgatagagcaccaaagctcggcggaccgccatatggcatttcgcctgatgcgctatgcgatagccgcgatgcagcgtcatctggataaagggcatacgcagctgccgctggtgatcccgctgctgttttatcatggtcgcgtttctccctggccttacccgatgtgctggctggcaggctttgccgatccggacatcgcgcggcggatctatggtgaagattttcccttaattgatatcactagcaccccggacgatgaaatcatgcgccaccggcgcgtggcgatgctggagctgctgcagaagcatattcgccagcgggatttgatggacctgcatgagcagctggtcaggctcctggcgctgggatacactagccgcaggcagcttaagacgctgttgcactatttattacaggcaggaaacgccgccgatccggttgcttttttgcgccatcttgcgcaaaacgtcccccggcggccgcataaggagacgctaatgaatattgcccagtttctggaacaacgcggccatcagcaaggattaaagcaaggtcttgaacaaggtctacagcaaggtatcgaacaaggtatcgaaaaaggtatcgagcaaggtgagcagcagaccgcggagcgtatcgcccgggcgatgcttgctaacggactcgacctgtcgctggtggcgaaactgaccggcctcgccccggaatgtctggcccggctgcagcattaattattcccttatccactcgcgccgcgccgatcgtgcggcgccagctctctgttttcgtcaatgtgtcagcgttaatcataataaacatgaatattactggcgttgaataggctgttcgtggttctggcaacgctcgatgccgtaaaaatacgcaactggttacactcttgtgaaaattcatttcgccaggtcattgattcctgatgggtgcgcagtagaattttcaggttttttcgggacttctttgattttaattttctggatagagtaaataatgaaaaaaagcatttttatggcgctggcgggcgtgatgatggtttcttcggcggcccatgcgattagcgttaccggtgaagccggcgagcattacaccaaccttggcgtcggcttcggcaccgagtccaccggcctggccgtttcgggtaactggctgcacagcgataacgacggcgacgccgcgggtttaggcctgggactcaatattccgctggggccgttcctcgcgaccgtgggtggtaaaggtatttacaccaatccgaaacagggcgatgaaggttatgcggccgcggtcggcggcggcctgcagtggaaaatcggcgacagcttccgcctgtacggcgattattactactctccggattcgctctccagcggcattgatagctaccaggaagccaacgtcggcgccagctggaccattatgcgtccgcttagcatccaggccggctaccgttacctgaacctggcgggcaaagatggcaaccgcgataacaccatcgccgacggcccatacatcggcgccagcgccagcttctaatctcttccggcgcggcatcttcttgctgcgccagattttcctcctcgtcagcatcccgctttgcgttatagtatttctcacctggcaggcaaggagtgagcaatgttgaatgtggaaatgctgtccaccggcgatgaagtgttgcatggtcaaatcattgataccaatgcggcatggctggcggatttcttttttaatcagggtttaccgttaacgcgccgcaataccgttggcgacgatctcgatgcgctggtggcgattctgcgcgaacgcagcgaacaggcggatgtgctgatcgtcaacggcggcctcggcccaaccagcgacgacctgagcgcgctggccgccgccactgcgaaaggcgaggggcttattttgcatccggagtggctggaaaccatgacccgcttttttgccgagcgcggcaggccgatggcggaaagcaaccgtaagcaggcggaaatcccggccagcgccgagatgatcaacaacccggtcggtacggcctgtggctttgccatccagctcaaccgctgcctgatgtttttcactcccggggtcccctctgaatttaaggtgatggtcgagcaggaaattttaccgcgcctgcgccagcgctttacgctgccggacccgccggtatgcctgcgtatgaccacctttggccgctcggagagcgagctggcgcaaagtcttaatccgctgacgctgcctccgggcgtggtgatgggttaccgctcgtcgatgccgatcattgaactcaagctaaccggaccggccaaccagcgcgacgccatgctggccctgtggccggaggtgcgtaaggtggctggcgacagcctgattttcgaaggcacggaagggttaccggcgcagatcgcccgctgtctgcaggagcggcagctgagcctgacgctcagcgagcagtttaccagcggcctgctggcgctccagctgtcccgcgccggcgcgccgctgctggccagcgaagtcgttccggcgcaggaggagacgctggcgcaggcggcccgctgggcggccgagcggcgcataaaccattttgccggcctggctctggcggtgagcggtcaggaaaacgatcatcttaacgtggccctggccaccccggacggcaccttcgcactgcgggtgaagtttagcgccacccgccacagcctggcggtacgccaggaagtctgcgctatgatggcgttaaacatgctgcgtcgctggctgaatggccaaccgctggccagcgaacatggctggattaacgtggtggattccctctcgctgtaagtcattccccccggcgcaccgtatcctcggggcgccggtcgtccaacctgttgtactcttctgaaaaaattctgtgcgttaagtcgcaattttctgctgcgaacggtccagtatacgggaaaacgattgccccgcgatgtcgctcacactttaccgcccggacaatcgcaacactgattccagtattcaggattggagtccagtatgttggaatcaacgaaagtcccggcgctgacccgcgcgattgagatcctcaatttaattggccgcatcggcccctgcagcgcggcgacgataatagcggagctggggatcccgaaaagcacggtgtatctgctgctgggcgagctgaaaaagcagcgcttcatcagtatggataatcaggataactactgcctgtggaccaagctggtggagctggccgggcaggcgctgagcaaaatggacctgcgcgagctggcgcggccgcgcctcacccggctgatggatgagtgcggcctgctttgtcacctgggcattatcgatcagggcaacgcctactacattctgaaaattgagtctcccgccaccatcagcgtgcgctcgcatgagggtaagagcctgtcgctttaccgctccgggatcggcaaatgtttgctggcctggcagcccgccagcgttcaggcgtcgattatcgaagacctgcagtgggagcgggccacgccaacgaccatcaccgatgctcaacagctgcgggaagagctggggcggatccgcgcccggggctggagctttgataatggcgaggactatccggatgtgcgctgcgtggctgccccggtatttaacgccaataacgacctgaccgccgccatctcggtggtgggtacccgtctgcaaatcaatgaagacaatcgcgattacctggctggtaaggcgattgcctgcgcgaaagatatttcacgtctgctggggtggaaaagccccttcgaacaactcgcctcatcataaggagaacatcatgaccctaccgaaaattaaacacgtccgcgcctggttcatcggcggcgccacagcagagcagggcgccggcggcggcgattaccatgaccagggggctaaccactggattgacgatcatatcgccaccccgatgagcaaatataaacagtatgagcagtcccggcagtcgtttggcatcaacgtgctggggacgctgattgtggaagtggaagccgacaacggacagaccggctttgcggtgtcgacggccggggagatgggctgctttatcgtcgaaaaacatctcaaccgctttatcgaaggcaaatgcgtcagcgatatcaaactgatccatgaccagatgcttaacgccaccctttactacgcgggatccggcggcctggtgatgaataccatctcctgtgtcgacctggcgctgtgggacctgttcgggaaagtggttggcctgccggtctacaaactgttgggtggggcggtgcgcgacgaaatccagttctatgccaccggcgcacgtccggacctggcgcaggagatgggctttatcggcggcaaaatgcctacccactgggggccgcacgatggcgacgccgggatccgcaaagacgtcgccatggtggcggatatgcgcgaaaaatgcggcccggatttctggttaatgctggactgctggatgagccaggacgttaactatgccaccaaacttgcccatgcctgcgccccttataacctcaagtggatcgaagagtgcctgccgccgcagcagtatgaaggctatcgcgagctgacgcgccaggcgcctgccgggatgatggtgaccagcggcgagcaccacggcacgctgcagtccttccgcaccctgtcggaaaccggcatcgatattatgcagcccgacgtcggctggtgcggcggcttaaccaccctggtggagatcgcggccatcgccaaagcgcgcgggcagctggtagtgccccacggctcgtcggtttactcacatcatgcggtgatcaccttcaccaacacgccgttcagtgagtttctgatgaccagtccggactgcgccacgctgcgcccgcagttcgacccgatcctgctcggcgagccggtgccggagagagggcgcattcataaatcggtcctggataaacccggctttggcgtcgagctcaatcgcgactgcaacctgaagcgtccttatcaacactgattgcgtcgggccgcccggcggcccgcgcctgaggatattatgatgagcaacactctgctggagagcgtggtgaagaaaaaccgcgcccgcttaatcccctttatgctggcgttgtacgtgctggcgtttcttgaccgttctaatatcggtttcgccaaagagacctaccagctggataccggactcagcaatgaggcctacgcgctgggggccggtatcttctttgtggtctatgccttcctcggggtgccggccaatctgctgatgcgcaaatttggcgccaggcgatggatcggctgcaccacgctgctgtggggagtgctgtcggcggcgatggcgtgggcggatacggaagcgaaattcctgctggtacgtaccctgctgggcgcggcggaggcgggcttctttcccggaatgatctacctcacttcacagtggtttccccagcaaaaccgcgccagcattatggggctgttttatatgggcgcgccgctggccctgacgctgggatcgcctttatccggtgcgctgctggagatgcatggatttatgggccatcccggctggttctggatgtttgtcattgaaggcctgctcgccgtcgccgcgggagcgttcaccttcttctggctggacgattcgccgcagcatgcccgcttcctgagcgcagcggagaaacaggcgctgataagcgagctggcgcgcgaggaggagaaaaagattgcctcgcgcctgtccgatgcgctgcgtaacgggcgggtctggcagctggcgctgatttatctgaccattcaggtggcggtctatggtctgattttcttcctgcccacccaggttgctgcgctgctgggcaccaaagtcggcttcgttgcctcggtggtgacggccatcccgtgggtggcggcgctgtttggcacctggcttatccctcgctactccgatcgcaccggcgagcgacgcaatattgccgccctgacgctgctggcggcggcggtcgggattgcagtgtccggactggtggcgccggtgctggctatcatcgcgctgtgcgtggcggcggtcggggtgatcgccgtgcagccggtcttctggacgatgccgacgcagctgctgtccggcacggcgctggccgcagggattggctttgttaacctgtttggcgccatcggtggttttctggcgccgatcgtgcgcgtgcaggccgaaacgttgttcgccagcagcgccgccggactgttaaccctggccggcgtcgccattgtcggggtggtcattatcttttcattgagccttacccgcgcggtaccccagcgcggcagcgtacagcattgaataaaggaatcgctatgaacgcactgttatctaaccccttcaaacggggattattacgcggtgagacgcaaatcggcctgtggctgagctccacctcatcctacatggcggagatcgctgcgacgtcgggatacgactggctgctgatcgacggcgagcatgccccgaacaccattcaggatctttatcatcagctgcaggcgattgccccctatgccagccagccggtcattcgcccggtcgagggcaaccgcagcctgataaaacaggtgctggatattggcgccagaaccttgctggtgccgatggtcgataccgccgagcaggctcgggaggtggtctcagcgacccgttatccccccatcgggagccgcggcgttggcgccggcgtggcgagagcggcgcgctggggaagggtggagaattatatggcggaggcgaatgacgaactctgtctgctgattcaggtcgagagccgaaccgcgctggagaacctggacgctattctcgaggtggacggcattgacggggtgttcatcggtccggcggatctctccgcctcgctgggctacccggacgatgccggtcaccctgacgtgcagcgggtgatcgagcagagcatccggcgcattcgcgcggcggggaaagcggccggatttctggcggtcgacccggcgatggcggaaaaatgtcttgcctggggggccaactttgtcgccgtcggggtggataccatgctgtatacccaggcgctggaccgccggctggcgatgtttaaatctgccagcgcccagccgcaagagaaaacgagctattgacggcacaggctggcgctgggctcagacgagcgcctgcgccagcaccgtcagcggatgctcgcagcgtttgctggtggacatctcaatctgccatttgcaggtctcgcagtcggtgacgacgaggtcggccccgctctcctcaatctgacggaacagcggggcgccgatagcctgggataccgcgtaattctcagttttaaacccgtaggtgcctgcgatgccgcagcactgggaatccagcacctccagctgcaggccggggatcagccgcagcagctcgagggtatacagcgaccagcccatcttttccatatgacacggggtgtgatagaccaccttcagcggcagcgggcgcagcggtagcgtcctgccggcagccagctgtttccagatccagcgggtggcaagctcgacccgatcgcgaagatcgctgttatcgacatcgaggagatgggggtattcatcacgtagcgtaaaggcgcaggtcgaggaggtggcaatgatcggtagcgtgttttcccgcatcgcggcgacgttgctctgcgcctgcttacgcgccttgtcgaaaaaaccgttggcgatgagcggtacgccgcagcatttttcttttgataacaactgcaccccggtacccagtgcgttgacgacgcgaatcagatctttacccaactgtggatggttatagttgacgtagcagccatgaaagaaagccacctgttcgctgtactgcttctgacgggcggcgagctggcggtaagcgcggcggaaggtgccgaaaccatatttcggcagcgtacgccggtgatcgatgttgagcgtcgcgtcgagcagacggcgcaccggttttaagccggtggcggcgttgaccaggggggcaaagggggtggaaagggtacccatcaggtcggtatggctgaggatggcgtcgcgcagggtcggcttttgctggccgtactgtgcccgggcgcgttgaatgatatcgccaattttcacatccgacgggcaggcgacctcgcagcgcttgcagttaatgcagtacttcagcgcctcgtcgtacagcgcgccatccttcagacgcaggcgttcgccgtccggccccgcttgtttcgggccgggatagcgcggattgacccgacttaccgggcaggtggtggtacagaccgtgcacttaatgcagctttcaaaacgggtatcgttcatggccggcctccggcaagggcgtggatctgtctggcggcgtgcagcgcggtaacggcgcagacgccgccgccacagccgagctgaatggcatcgaacccgccgagcaatgagccgatggcgaacagattatggaacggctgcccgcccagcagggggcgcagcagggcatcggttttcacgccgaagcgctgccacggttgtgaggcgaagaaatcgcgctggtaccagctttcccgtggcagggtctggtgaaggtcgaggccgaggatcggctcgcgcacgctatcgcgagtggcgacaagaccgttgctgaaaaagctgccgctggccagcacggtaaagcgcggacgcagcgcaatatcgccgtgattgcgcgtccagaccgcctcgacggcgtcctgtcgatggctgattttcaccacctcatcgcctgcgagccaggcgccgccctcgcgaatgaactggcgttgcagctgagaatgcaaacgcatcccgggaaccgaaggcggcagcgtcggcagcagacgcagcgggcagggtagacgcgcctgcagccagtggtaaaggcgatcgtcggcgaggccaaaacaggcgggcatgatcagcaggtcatactgctgcgccagcggtagcagcgctgcatgcagggccggccacatattctcatcatccaggacgcgggcgatattggcggcgcgaaactcggtcgggttgtcacgcagcacatccagcagcggtaactcgatttccaccgccgcggcggtaactccgtgttgaccgagcgcggcggcggcgagatgcggctgaaaatcagcaaagccgctgatccccaccagacaggcgccctgcgacggcaggggcgcgacaggcacctcaaggggcgacagccatgccgggcgcaacgtccccagcggcgttacccgccggtgcggccggcgcgcatcgccctgcatcaccgcgccgcaggcggccagcagggcttcggtctgtgtcgcgtattcgagcaccgcctcggcgccgagccgggaataagggtgttcaggaagctgttcagcgagttgctgcagaccttgtgcgacgtcagtgacgtgatcgccgttgggcagcgccgagagcaggtctaacgacgcggaggaaaaatgcagcgcgctctgcccgcggctgatgatgacgctgcgcaggccgtgctgattcagggccagcccgcacagcaggccggcgagcccgccgccgataatcgcgcaatcaaacttcatcccggtgctcctgtggcaatccgcacaggccgaggtagacccagcgggtgaattcgctttcgcgcagcgcatcgccccaggcgatgggctgcacgcccttccagcgttcattgagaaattccgagagctgggttaacgactgcgcgggcgtggtgacgttaaagcgctgtagcaggccggcagcgcggcaggcgcagagttccccctgacaggtccccatgccaatccgggtgcggcggcgcaggtcgagcagggtgttgaccgccaggttttccaccgcgtatttcacttcaccggcagtgacggcttcacattcgcagaccaggctacggtgctggcggctgtcgccaagccaggacggggtgcgatcgccgtgacggtagacggccgagccgcgcagcggggtggggagggagataatcttttgcagggtactttccgttggctcctgtgaaccgggcagcggggcttcggccgtggtacagggggtggtgtttcccagcttacgacagacggcgtcggtggcccactcggccataaggcgataggtcatcagcttgccgccggtgatagtaatgaagccttccataccgtcacgctgggcatggtcgagcaggacgatgccgcggctgacgccgcgcccgctgggatcgttatcgctggccaccagcgggcggacgccggagtaggcgcggaggatccgggtgcggcccatgaccggcgccagcttttccccttcgcgcagcagggtatcgacctccgccgctgttacccggttgtcgtcaatttcgtcataaggaatatgcattgaggtagtgccgatcagcgagatggtatcgccgggcaccagaatatcggcgtcggccggcttacggcagcggttgatcaccaggttgttaatccgatgatcgaggatcagcagcgatcccttcgccgggaacatggtgatgcgcaggtcggcatattccgcaatacgctgcccccagatcccagcggcgttaaccaccatcccggcgtacagagtgcgggcctggtgaagttggcggtcgtatacctggacgccgcagacgcgatcgccccggcgcagcaggcctgttacttcgcagccggtaaggatctgcgcgccgtgttcgcgggcgtcgagcatattggccgcggtgaggcgaaacgggtcgatggtaccgtccgggacctgcaccgcgcccagcagcgtcgggttgacggcgggctcccggcgcagcgcttcctgcggcgagagcggcgtggcctctatgccagcctgctgacaggcgtcgataaaggtttgctgccatgccaggtcatcttcaggcagggtgataaacagcccattggtcggttcaatacagtggcgggcgatgcggcgcaggatgcggttctcactgatgcattcgcgggcggattcgttgtcggtcaccgcgtagcgggcgccgctgtgcagcagtccatgattccggccggtcgccccggtggcgatatcatggcgctcaatgagcagcgttcgtaatccgcgccgggcgcagtcgcgggcgataccggcgccggttgctccgccgccgatgataatgacctcgctatcaagacgtcccgtcatcttcagctcctctgctttcgttttacgccatttagccacaattagtaaggttattgtttgatttcgagcatattcgcgcgttatttgagcgtgttatgtgatttcgtgctcacattggaacgttttgtcatatttctgtaacaaattgtgcgatgtttcacagtatcaactctacgtattgcctaccatcgcgaccatatttgaagttggtgattaatctgggattttgtcgtgacgtcagtagaaaacagcaagggccacggaggctgatatgttaagtatttttaaacccgccgcgcataaagcgcgtttgccagcagcggagattgacccgctatatcgccgattacgctggcagatttttattggcatcttttttggttatgccgcctactatttggttcgtaagaactttgccctggcgatgccttatcttatcgagcaggggttctctcgtggcgacctcggcttcgccctttccggtatctccatcgcctatggattttcgaaattcatcatgggatcggtctctgaccgctcgaatccgcgcattttcctgccggctggcttgatcctcgccgcgctggtgatgctggtgatgggcttcgtgccgtgggcgacgtccagcatcatgataatgttcgtgctgctgttcctctgcggctggttccaggggatgggctggccgccgtgcggccggaccatggtgcactggtggtcgcagaaagagcgcggcgggattgtctcggtgtggaactgcgcgcataacgtcggcggcggcattccgccgctgctgttcctgttagggatggcgtggtttaacgactggcacgcggcgctgtatatgccggcattcggcgccattctgctggcgattttcgccttcgcaatgatgcgcgacaccccgcagtcctgcggtctgccgccgattgaagaatataaaaacgactacccggacgattacagcgaaaagcacgaagaagagctgacggcgaagcagatctttatgcagtacattctgccgaacaagctgctgtggtacatcgctatcgctaacgtcttcgtttatctgctgcgctacggcattctcgactggtcgccgacctacctgaaagaagttaaacacttcgcgctggataaatcctcctgggcctatttcctgtacgagtacgcggggatcccgggcacgctgctgtgcggttggatgtcggacaaagtgtttaaaggcaaccgcggcgccaccggcgtgttctttatgaccctggtgaccatcgccactgtcgtttactggctgaacccgccgggtaatccgggcgtcgatatggcctgtatgatcatcattggcttcctgatctacggcccggtgatgctgattggtctgcatgccctcgagctggcgccgaaaaaagccgccgggaccgccgcgggcttcaccggcctgttcggctatcttggcggttccgtggccgcgagcgctatcgtcggctacaccgtcgatttcttcggctgggacggcggctttatggtgatgatcggcggcagcgtgctggcggttatcctgctggttatcgtgatgctcggtgaacgtcgccatcaccaacagctgaaacaagcctaaggagcggcgatgaaaatgaaacttaccgcgctgatgagcggaatgattctgtccagttcggcgctgtgcttcagcgcgacagcggctgataaaatggtcatcgcccaccgcggcgccagcgggtatctgccggaacataccctgccggcgaaagcgatggcttacgctcagggggcggattaccttgagcaagacctggtgatgaccaaagacgaccggctggtggtgttacacgaccactatctcgatcgggtgactgacgttgcgcagcgtttcccgcagcgggcgcgtaaagatggccgttactacgccatcgactttaccctggacgagattaagtcgctgaagttcaccgaaggttttgagccgaaaaatggtaagaacgtgcaaacctatcccgggcgattcccgatgggcaaatccgatttccgtattcatacctttgaagaggagattgagtttgtccaggggctgaaccattcaaccggcaaaaacatcggtatctacccggaaatcaaagcaccgtggttccaccaccaggaaggcaaagatattgccgccagcacattgaaggtgctgaaggaatatggctataccagcaagcacgataaggtttatctgcagtgctttgacgccaacgagctcaaacgcattaaaaatgagctggagccgaagatggggatggatctcaatctggtgcagctcatcgcctataccgactggaatgaaacccagcagaaacaggccgatggtaagtgggtgaactacagctatgactggatgttcaagccaggggcgatggcgcagattgcgcagtacgcggacggcatcggcccggattaccatatgctggtagcggaaggctcgaagccgggggcggtgaagctgacggcgatggtgaaagaggcgcatgccagccatctgcaggtgcatccgtacaccgtgcgcgcggatcagttgccggagtacgcgactaacgttaatcagctctatgacgtgctgtataaccaggcgggcgtcgacggcttatttaccgatttcccggataaagcggtgcagttcctggacgcgaaacagtaaaaagccggatggcggctacgccttacccggcgtacgaactgcggttttgttgacactgttctcggcgtgcaacgatttcgacccgggaataacgtttgttctatgttatttcctggaagattgcgctcccgatatttcttctgcgttatgcctttcatagcgcagggagcgcacagggggaggccagtcgccgcctccccctgtacccccgggctccggccagcaaaatcgccgctgcgcggtcccttcgacttatccctgcaggcttcgggtcgggccgaggtagcgtccatgcaaaacacggccctcagcccgcatccatgcgggctgccccggccttccgggaacgtctcagcgattttgaggccgtcaacaccggcagtttcagcagcccagggcggcagtgcgtaaacggccggtcctggaacagtaggtcaggtaagcgtagcgccacctgacaagactacatctcgatctcaatatcgcctttcgcccggcagcagcagggcaaaatttctcccggctggataaaggccagcggctcggtcagccagtcaacctggccggagaccaggcgagtgcggcaggagccgcagtagccttcgcggcactgatattcgacgtcgatattatgcgactccagcgccgccagcagggaagggtgttcatcctgacactcaaggcgagtgtcagagattttcaggaagatccgcttcattacagctggaagttactcagatcgtcggcatcgacttcagaatcgatctggccgacgagataagaactgacttccacttcctgcggcgccacctgaacgttgtcggagaccagccaggtgttgatccatgggatcgggttggagcgggtctggaacggcagatcgaggcccaccgcctgcatgcggatattggtgatgtactcgacgtactggcagagaatatctttattcaggccgatcatcgagccgtcgcggaacaggtagtccgcccactctttctcctgctgcgccgccagcacgaacaggtcatagcactcctgtttgcactcttcggcgatttccgccatttccggatcgtcgctgccggagcgcagcaggttcagcatatgctgggtgccggtcaggtgcagcgcttcatcgcgggcgatcaggcggataattttggcgttgccttccatcagtttgcgttcggcaaaggcgaaggagcaggcgaagctgacgtagaagcggatcgcttccagggcattaacgctcatcaggcacagatagagtttctttttcagctcgcgcagattcacggtcacggttttgccgttgacggtgtgggtgccttcgcccagcagatgccagtagctggtcatctcgatcagcgaatcgtaatagtgagagatgccttccgcacgtttctggatctgctcgttggtgacgatgtcgtcgaacacggtcgccgggtcgttgacgatgttgcggatgatgtgagtgtacgaacgcgagtgaatggtctcggagaaggcccaggtttctacccaagtctccagctccgggatggagatcagcggcagcaacgccacattcgggctacggccctggatggagtcgagcagcgtctggtacttcaggttgctgatgaaaatatgtttttcatgttccggcagcgcctggtagtcgatgcgatcgcgggaaacgtcaacctcttccgggcgccagaagaaggagagctgcttttcaatcagcttttcaaagatgtcgtatttttgctgatcgtagcgggccacgttaaccggctggccaaaaaacataggttccagcagctgatcgtttttcgtctgtgaaaaagtggtgtatgccattgaagtgagtcctgttgaactgtattgcccggcgggaatgggttggccgggcctacacaaacgtaggccgggtaagcgtagcgttacccggcaaaagtaccttagatcttacaagcgccgctttcgcagccgtcgtcctggatggacggggccaggtcatcctgagcgtcttcagcgccatcacgggtgttgtgatagtacagcgttttgacgccgaatttataggcgttgagcaggtctttgagcaactgctgcatcggcacttttccggacgggaagcgcgtcggatcgtagttagtgttggcagagatcgactggtcgataaacttctgcatgatacccaccagctgcagataaccgtcgttgttcggcatctcccacagcagctcgtaggcgttctgcaggttttcgtaatccggcaccacctggcgcaggataccgtccttggacgctttgatactcacgtggccgcgcggcggctcaatgccgttggtggcgttggagatctgcgacgaggtctcggacggcatcagcgcggagagcgtggagttgcgcaggccgtgagttttaatggactcgcgcaatgcttcccagtcgtagtgcaggggttcgctgacgatgccgtccagatctttcttataggtatcgatcggcaggatgccctgcgcataggtggtttcgttgaaccacgggcaggcgccttgctcgatagccagctcgttagaggccttcagcagatagtactgaatcgcttcgaacgttttgtgcgtcaggttgttggcgctgccgtcggagtagcgtttgccatgcttcgccagatagtaagcgaagttgatcacgccgatacccagcgtacgacgccccatcgcaccgcgtttagccgccgggatggggtaatcctgatagtcgagcagcgcatccagagcacgcaccgccagcactgccagctcttccagctcgtcgaggctgtcgatagccccgaggttgaaggccgacagggtgcacagcgcgatttcgccgttttcgtcgttgacatcttccagcggtttggtcggcagagcaatctccaggcacaggttagactgacgcaccggggcgactaccggatcgaacgggctgtgggtgttgcagtggtcgacgttctggatatagatgcggccggtagaggcgcgctcctgcatcatcagcgagaacagctcaacggctttaatacgctgcttacgaatggtgtcgtcctgctcgtactgggtgtacaggcgctcaaactcgtcctgatcggcgaagaaggcgtcatacaggcccgggacgtcggaagggctgaacagggtaatatcgccgcctttcagcagacgggtgtacatcagcttgttgatctgtaccccgtagtccatgtgacgaacgcggttggcgtcggtaccacggttgtttttcagcaccagcaggctttccacttccagatgccacattgggtagaagagggttgccgcgccgccgcgcacgccgccctgcgagcaggatttcaccgcggtctggaaatgcttgtagaatggaatgcagccggtgtggaaggcttcgccgccgcggatcgggctgcccagcgcgcgaatgcgcccggcgttgatgccgatgccggcgcgctgggaaacgtatttcacaatcgcgctggaggtggcgttgatggaatccaggctgtcgccgcactcgatcagcacgcaggagctgaactgacgggttggggtacgcacgccggacatgatcggcgtcggcagcgagattttaaaggtggacaccgcgtcgtagaaacgcttgatatagtccagacgcgtttcgcgcggatagttcgagaacaggcaagcggcgaccagaatatagaggaactgcgcgctctcataaatttcgccggtgacgcggttttgtaccagatacttgccttccagctgcttaacggctgcgtaggagaagttcatgtcgcgccagtggtcgaggaaaccgtccatctgctggaactcttcttccgtgtagtcttccagcagatgatgatcgtatttacctttctcgaccatcttcaccacgtgatcgtagagcgccggcggctcaaactgaccgaaggcttttttacgcaaatggaaaatcgccagacgcgcggcgaggtactggtaatccggtgcgtcgcgggagatcagatccgcagcggctttaataatggtttcgtggatgtccgcggttttgatgccgtcatagaactggatatgggagcgcagctctacctgggaaatcgaaacgttattcagtccttctgccgcccaatccagtacgcgatggattttgtcgagattgatgcgctcggtggtcccgtcgcgctttgtcaccagcagactctgattcatgtggattttacctgtccgtgaaagaaaatatcccccgtttatccacagaaggccgttgtgactaactctgtggataaatactatatgtagggggttgtcgataaaagaaacgctatatggtgagtattttagtaaggaatcttttgagtacaagggttgattttgacgttaaattgaggttgcggaagggtaataatccgcaagtccacgtcgcataaggcctggagaagaagtcaataaaacagaaaaaaaaatgaaaatttgatcgagtgctgatttcttcatcggaagaaataatcacgcggcttgatgccgcgcaatcatcataagcggaggtgctgacctcagtcctgtttggcggttgtatgcaacatatagttaacatcaacccccggcgctaacttgaaggtattggtcagcggattgtaatgcagaccgatgatatgctgctctttcagagttgtctgatctacccagcccagcagctcggccggcttgataaacttcttcacatcatgagtgcctttgggcaccatcttcatgacatattccgccccgactaccgccatcagccaggccttgccgttgcggttgatggtggagaagaagacctggccgccgggcttcactaaccgcgcgcaggcgtgcaccaccgactgcgggtcggggacgtgctccagcatctccatgcaggtcacaacgtcatactgctgcgggtgcttcgcggcatgttcctcaactgtttcctgaacatagtctacctgaataccgctctccagggcgtgcagcctggcgacctgcagcggttcggcccccatgtccagcccggtgaccgtcgcgccttcgcgcgccatgctctcggcgaggatgccgccgccgcagccgacatcgaggacttttttaccgaacaggccgccggagcgttcggcaatatagcccagccgcagcgggttgatgcggtggagcggtttgaactcgccctccagatcccaccagcgcgaggcgacggcttcgaatttggcgatttcagcatgatcgacattaggggctaccgacgttttttcggcattcatgggcgcttttactccttttctgttcagacctgcgagtatatcagcagcgcgccatgaataaaccgtattgctttacctctattagcgcggctgtgttataatttgcgacctttgaatccgggatacagtagagggatagcggttagatgagcgaccttgcgagagaaattacaccggtcaacattgaggaagagcttaagaactcttatctggattatgcgatgtcggtcattgttggccgtgcgctgccggatgtccgagatggcctgaagccggtacaccgtcgcgtactttacgccatgaacgtattgggcaatgactggaacaaagcctataaaaaatcagcccgtgtcgttggtgacgtaatcggtaaataccacccgcacggcgactccgcggtatacgacaccatcgtgcgtatggcgcagccgttctcgctgcgttacatgctggtggacggccagggtaactttggttccatcgacggcgactccgccgcggcgatgcgttataccgaaattcgtctggcgaaaatcgctcatgagctgatggccgatcttgaaaaagagacggtcgatttcgtcgacaactatgacggtacggagcgtattccggacgtcatgccgaccaaaattcctaacctgctggtgaacggcgcctccgggatcgccgtagggatggccaccaacataccgccgcataacctgacggaagtgattaacggctgtctggcgtatgttgacgatgaagacatcagcattgaagggctgatggcgcatattcctggccctgatttcccgaccgccgccattatcaatggccgtcgcggcatcgaagaggcctatcgcaccggtcgcggtaaagtgtacattcgcgcgcgcgcggaagtggaagtggacgcgaaatccggccgcgaaaccatcatcgtgcacgaaattccgtatcaggtgaacaaagcgcgcctgatcgagaaaatcgccgagctggtcaaagaaaaacgcgtggaaggcatcagcgcgctgcgtgacgagtctgataaagacgggatgcgcatcgtgattgaagtgaagcgcgatgcggtaggggaagtggtgcttaacaacctctattcccagacccagctgcaggtctccttcggcatcaacatggtagctctgcaccatggtcagccgaagatcatgaacctgaaggacatcatcgccgcgtttgtacgccaccgccgtgaagtggtgacccgtcgtacgattttcgaattgcgcaaagcgcgcgaccgggcgcatatcctcgaagcgctggccgttgcgctggccaacatcgacccgattatcgaactgatccgtcgcgcgccgaccccggcagaagcgaaaacggcgctggttgcccaggcgtgggatcttggtaacgtcgcggcgatgctggagcgcgccggggatgacgccgcgcgtccggaatggctggagccagagttcggcgtacgcgacggtaaatactatctgaccgagcagcaggctcaggcgattctggatctgcgtctgcagaaactgaccggccttgagcatgaaaaactgctcgacgaatataaagagctgctggagcagatcgcagagctgctgcacattctcggcagcgccgaccgtctgatggaagtgattcgcgaagagctggagctgatccgcgaccagttcggcgacgaacgtcgtaccgaaatcaccgccaacagcgctgatattaacatcgaagatctgatcaaccaggaagatgtggtggtcaccctgtcgcatcaggggtatgtgaaatatcagccgctgaccgactacgaagcacagcgtcgtggcggtaaaggcaaatcggcagcgcgcattaaagaagaagactttatcgaccgcctgctggtggctaacacccatgacaccatcctctgcttctcaagccgcggccgtctgtactggatgaaggtctaccagctgccggaagccagccgcggcgcgcgcggtcggccgatcgtcaacctgctgccgctggaagccgatgagcgcatcaccgccatcctgccggtccgcgagtacgaagagggcgtcaacgtctttatggcgaccgccagcggtaccgtgaagaaaaccgcgctgaccgagttcagccgtccgcgttccgccggtatcatcgcggtcaacctgaacgaaggcgatgagctgatcggcgtcgatctgacctctggtcaggatgaagtgatgctgttctccgcggccggtaaggttgtacgcttcaaggaagacgccgttcgcgccatgggccgtaccgccaccggcgtacgcggtattaagcttgcggaaaacgacagcgtcgtctcgctgattattccacgcggcgaaggcgcgatcctgacggtgacgcaaaacggttacggtaaacgtaccgcggcggcggagtatccgaccaagtcgcgtgccacccagggcgttatttcgatcaaagtcaccgagcgtaacggttccgtggtcggcgccgtgcaggtggatgactgcgatcagatcatgatgatcaccgacgccgggacgctggtgcgtacccgcgtttccgaagtgagcatcgtgggccgtaacacccagggcgtgatcctcattcgcaccgcggaagatgaaaacgtggtaggtctgcagcgcgtggctgagccggtggatgatgaagagctggatgccatcgacggtagcgcggcagaaggcgatgacgatatcgccccggaagcggataccgatgacgacatcgccgaagacgaagaataatcgtccgaggtaaatgttctggaagggccgggtattttcccggccctttttgcattaacattgcggcaaagccggtttaccgctaccttaaccgcattctgttgagtccctgacggccgagcatcgccacattgaaatatcttgcctcttttcatacaaccctgaaggtttcacgttatctgttcagagcgctggcggtattgctgtggctgcttattgcgtttgtctctgtgttttatatcgtcaacgcgctgcacgagcgggaagccgaaatccatcaggagcttaatctcaacgccgatcaggcccagcgctatatccagcgtaccgcggatgtaatgaaagagctgaagtatgtcgccggtaatcgcttgtcggcaggggacgcggtagcgcaagggcaaaacggcgatatggcggtgcccaactttgaacccctgtaccccgattccgactgcagcgcgatgagcgccacctggcgtaattcgctgcagtcgctggcatggtttatgcgctactggcgggataattttactgccgcctacgaccttaaccgcatctttctcatcggcagcgataacctctgcatggccaactttggcctgcgggacgtgccgattgagcgcgatcaggcgctgaaagtcctgcatcagcgcatagagcaatatcgcaacgcgccgcaaaatgagcgcggcaacaacctgttctggataagccagggcgttcgccccggggtgggctatttttacgccctgacgccggtctatatggccaatcgcctgcaggcgatgctgggcgtggagcagaccatccgcatggaaagcttctttacgccgggcagcctgccgatgagtgtgacgatctttgacgataacgggcagccgctgatttcgctggccggtgcggaaggtaaaatccagagcgaagcgaagtggatgcaggagcggatgtggtttggctacagttcgggtttccgcgagctggtgctgaaaaaaagcctctcgccgtcctccctgagcatcgtctattccgtctcggtagatcaggtgctggagcggatccgtatgctgatcatcaatgctatcgttcttaatatcctcagcggcgcgatgctgttcgcgctggcgcggatgtatgagcggcgcatttttatccccgcggagaatgacgcccagcgcctggaagagcacgagcagttcaaccgcaaaattgtggcttctgccccggtagggatctgtattctgcgcactgccgacgggaccaatattctcagtaatgaactggcgcacaactacctgaacatgctgacccacgaggaccgccagcggctgacgcagatcatctgcggccagcaggtcaattttgtcgacgtgctgaccagcaaccataccaacctgcagattagctttgttcattcacgctatcgcaatgaaaacgtcgccatttgcgtgctggtggacgtttccgcccgcgtgaaaatggaggagtcgctgcaggagatggcccaggcggcggagcaggccagccagtcgaaatcgatgttcctggcgaccgttagccatgagctgcgtaccccgctgtatggcatcatcggtaacctcgatctgctgcagaccaaagcgttgccgaaaggcgtcgatcgccttgtgacggcgatgaacaactcctccagcctgctgctgaaaatcatcagcgatattcttgatttctcgaaaatcgagtccgagcagttgaagatcgagccgcgggagttctctccgcgcgaagtcatgaaccatatctccgctaactatctgccgttggtggtgcgcaagcagctgggcctgtactgctttatcgagccggacgttccggaacaaatgtccggcgacccgatgcgcctgcagcaggtgatctcaaatctgctcagcaatgcgataaagttcaccgataccggctgtattgtcctgcacgtccagtgcgcgggggattatctgcagattagcgttcgcgacaccggagaggggatcccggcgaaagaggtattgcgcctcttcgatcctttcttccaggtggggaccggcgtgcagcgcaattttcagggcaccggccttggcctggcgatctgtgaaaaactgatcagcatgatggatggcgatattgctgtcgaaaccgagccggggatgggtagccgctttaccatccgtattcctctgtatggcgtgcagaatacctcaccggtgagcagagacggtttcgctggcaagacctgctggctggcgattcataacacttcgctggcgatgttcgtcacctcgctgctcagctaccacggcctgacggtccgccgccatgccggcgaaacgccggacgccgaggatgtcttactcactgacgatgaggcgctgagcggatggcagggaagggccatggtcatcttctgtcgccgtcatatcggtattccgcaggagcggtccgccggcgaatggctgcacagcgtgacgactccccacgaactgctgccgctgctggggcgtattttccatgttgcgctcgccagtgcggaaaatagcccggcgctgatggccccggaggcgcaggccggcaataacgacgacatgatgatcctcgtggtcgacgatcacccgatcaaccgccgcctgctggcggatcagctgggttcgctcggctaccagtgcgtgaccgcgaacgacgggatcgacgcgctcaacgtcctcagcaagcagcacatcgatatcgtgctcagcgacgtcaacatgcctaatatggatggctatcgcctgacgcagcgcattcgtcagcttggcctgacgctgccggtgattggcgtaacggccaatgccctggcggaagagaagcagcgctgtctggaatcggggatggacagttgtctgtccaagccggtcaccctcgacgtactgaagcaaacgctgacggtatatgcggcgcgggtgcgtaaagggcgggaataatggggagctccgtctcgccggggcgagacggagagggcgaagagattactctttgtccgtcgcgctcagcgagacggaagagaggtagttcagcaaggcgatgtcgttttcgacgcccagcttcatcatcgccgatttcttctggctgctgatggttttaatgctgcgattaagctttttggcgatctcggttaccaggaaaccttcggcgaacaggcgcagtacttcgctctctttcggcgacaggcgtttatcgccatagccgctggcgctgattttttccagcaggcgagagacgctttccggggtgaattttttccctttctgcagcgcggccagcgcttttggcaggtcggtcggcgccccctgcttgaggacgatcccttcgatatccagatccagcaccgcgctgaggatcgccggattgttgttcatggtcagaacaatgatcgacagatccgggaagtggcgcttgatgtatttaatcagcgtgatcccgtcgccgtatttgtcaccgggcatggacagatcggtgatcagcacatgggcgtccagcttcggaagattgttgataagggccgtggagtcttcaaactcgccaacgacgttcacccactcaatttgctcaagtgacttacgaataccgaacagtacgatcggatggtcatcggcaataattacgttcatagtgttcatgtataaggctaccttctacagcaagctcttgacgtaagcgtcaatgtcgctgatatatttttctatgccttgcgcatccttttcgcgaatcagatgctcaagcgtttcacataactgcttgccgggtatcagattaagcatagcaaatgcccctttgaggcggtgggcggtttgcgccagagcagcaaaatcgcccgcttcgatttcagtatacaatctctgaacatcatccggtaccgtatcggcaaacagtgcgtaatagccgctggcatggagttcggcgttactctcgtttcctgaggtgacgggctgaaccgcctcctccgccagctgctgctcaataagctgcaggatagcctcctgcatcgccgtgctaatattaaagttgacccgcagttggcccgggccgatcttgcgtatcccgacctcatcatcgcttaaaagcaagcctgaagcagtaagattagacggattatccgttaaataaagatcaaaggcttgactggtcgcccgatcgtccggtgtgatgcaggacgctccccagctctccagctggcgagtgacaatccgccgcacttcgctggaagtcacatccagcaggacgataacgtcatccagcaaatgctctcccgcctctggcgcctcttcgctggccggcattttcagatgcagggtatagcgcgtccccagcgactcccgggctttaatggtcaattgcccgcccagcttgcgcgtcatgcggtcgcatagccagaaggtaagggcgtttgctttgccgtacaggtcgctctgggtctcgttgagatacgggaagtgcatattgtcgatctcgtttgccgagacgccgttgccggtatccagaatgcggaaggtcaggcgatcgctggccgactcatcctgacagacgtcgagggtgatcttgccgataggcgtggtggtcactgaatactggattaacagcaccagcgtgcgccgcagagcttcacggtcgccatagcgctgctcgccggccgggagcgcattgttgatgagcagctgcagacccttgcgtttcatcgccggcagcacttccggcacgacgtcgtcaataagctcctgcaccgagaacaacgtctggttggttttccaggcatcgctttccagcagattggcgagctgaatgtcatcgatgagtttgaccagctcatcggcatgctgggccagcgtccggttctctgtactactgagcgccgctgcctctgccgccagcgtcagcgcgggctgcttcagggcgctgccgatgtgctgcataaaggcggcccgtccctgctggtttttctcatacaagcgctgggcctgcttgagctttttattgaccagcacttcgcggtcctgatcacggatgatcaggatctgggtgcgcggcgctacctggctgcgatactggcggatttcatactgctcattattgacggtggcctgaattaccccctgatgctggtccgccatattggtgatgttctgcagattcaggtgcggaagcagatggtcggcaattggattgctgataaccgttcggttggcttcctgatcgtgaacgagcagccccagcggcagcagagaaacaatctcttcgttaatggcgcgcagcagacgcagttcgctgttggcggcggaggggagcccggcgccagacgaatggctgcgtcctttatagtggcgaaaggtggtaaaaccaaacagcgccagcgccagcagaccaatgttgagcagcagcggcagaagaatgttctgcatggactccagcagcatggtgctcattggtaccgtccacagcaactgcataccggtggtgctgatatcggtggcgatgtcaatctgcatgccgttaaaggtgatcccgatatgatcggcgctctctttatccggcgtggtggcgagattttgcgacgggtcaggctcgatacggaagctgtcgatggtcatgcccggcgggatcagatcgttaatcggcaggtcgaaggcgaccaccgtggcaaggtgtccgggctggttgaaggtggtgcgtaacgtaaaatagtgcgcgttctgccaggcgagatggcgcaacggcgagaacgtctcgcgctcatcaagggtattagcctgcagcagcatttccgcgcgccgcgactccacgacgctgctgatcgttgactctttgaagctcgaagagaggtccttcaacggcagggtggagaccaggatcagactattgtccaggccgttgagatagtacatcgaccacggaatggtctccgcgccccacaaaatatcgagataatcggacattttctgcgtcatttcgagggtggagctgtcatgggagccaaagatcagggcttcggttttacgccggggtttctccaggtagtaaacgtcctgttttaaacgcgtctcctgcagaccgccgcttgcggtgttgactgaggtggcggcgatattgtcgtagatctgccaggtggcatagcgccaggcgtcaatgcgctggtgcagagcgtgggagacatcaaccacctgatagcttttctccttcagccaggcattgacggcgctttggatcatcacccccattgtcgccagcaggacaataaccatcaaaatgaagaagcggctgatgttgccggggatcagggagaattttttcggggtcatcttgtggctgaacgactcatcattgtttgtaaacaggatgtagcgccagagtaactggcaacaaagcagatgctgctggcagtataaaggctaatggcgtaaatccatactacagattggcgcctgcggtgcgatgccgcccaggaattatcttagaaacgaagcgtaaatgaaaccgcgccgggaaggttaaccggcgacgatattgacggaaacaaaagggaagaatcgcacgaaataacaagacattggcagaatatgccccactgatggcctaattgattgattaatagtcgttagggaatcattagccgtagcacagataaattaaagttgtgtaaagaagggtaaaaaaaaccggatgcgaggcatccggttgaaataggggtaaacagacattcagaactgaatgacggtaataaataaagttaatgatgatagcgactcttattttagccaccaatgatcattttgttttaccattcagtgctatagatatgttgttgtctatcgctttgattataaaaggttaaatattttttttgatgattagtgcgtatttccctgaccattttgcggtgaaaaaagttccgctgaatttacaaattgaaacatcttgtgggaactttgaaacatcttagaagttttagtatcatattcttgttggattattctgcattttgcagcacaatgaaatagccgactgattagaagggtaatcagtaagcagtggcataataaaaggcatataacaaacagagggttaataacatgaaagttaaagtactgtccctcctggtaccggctctgctggtagcaggcgcagcaaatgcggctgaaatttataacaaagacggcaacaaattagacctgtacggtaaaattgacggtctgcactacttctctgacgacaagagcgtcgacggcgaccagacctacatgcgtgtaggcgtgaaaggcgaaacccagatcaacgaccagctgaccggttacggccagtgggaatacaacgttcaggcgaacaacactgaaagctccagcgatcaggcatggactcgtctggcattcgcaggcctgaaatttggcgacgcgggctctttcgactacggtcgtaactacggcgtagtatacgacgtaacgtcctggaccgacgttctgccggaattcggcggcgacacctacggttctgacaacttcctgcagtcccgtgctaacggcgttgcaacctaccgtaactctgatttcttcggtctggttgacggcctgaactttgctctgcagtatcagggtaaaaacggcagcgtcagcggcgaaggtacttctccgaccaacaacggtcgtggcgctctgaaacagaacggtgacggcttcggtacctctctgacctatgacatctatgatggcatcagcgctggtttcgcgtactcgcactccaaacgtaacggcgatcagaatcgtttggataaaggccgtggcgacaacgctgaaacctacaccggtggtctgaaatacgacgccaacaacatttacctggcgactcagtacacccagacctacaacgcaactcgtttcagcggcaacggagaatctgattctattagcggttttgctaacaaagcacagaacttcgaagtggttgctcagtaccagttcgacttcggtctgcgtccgtccgtggcttacctgcagtctaaaggtaaggacatcgaaggttacggcgaccaggacctgctgaaatatgttgacgttggcgcgacctactacttcaacaaaaacatgtccacctatgttgactacaaaatcaacctgctggacgaaaacgatttcactcgtcgcgctggtatctctaccgacgacgtggttgcactgggcctggtttaccagttctaagttgcaagctgcataacaaaaaggcgcctctggcgcctttttttatgtccggtttaacctcgctggtatactcttgtcgccctggtaagaggagcctcgattaatggatatgactttctttcgcgccgcgctgctgggcgcctgcgttctgctctctggctgcgattcagctaccactcctgcgacccccaccgcgacggccaccgtgctggatggcaaaacgatgggcaccttctggcgggtcagcgtcattggcgtggatgaggcaaaggcccaggcgttgcgcgccaaggttcaggcccagctggacgccgacgatcgcctgctgtcgacctggaaaaacgactccgcgctgatgcgcttcaatcatgccgccactaccgaaccatggccggtgagcgaagcgatggcggatatcgtcaccctgtcgctgcggattggcgccaaaacgcacggcgcgatggatattaccgtggggccgctggtcaacctgtggggctttggcccggataaacagccggtcaccaccccggatgccgaggcgatagccgcggcgaaggcgcgcaccggcctgcagcatctgcaggttattaatcagagcggcaggcagttcctgcaaaaagatattcccgatctgtttgtcgacctctccaccgtgggggaaggctatgccgccgaccacctcgcgcggttgatggagcaggaggggatctcccgctatctggtgtcggtgggcggagcgctggtcagccgcgggatgaacggcgaaggcaagccctggcgggtagcgatccagaaaccgaccgaccgcgaaaacgccgttcaggcgattgtcgacatcaatggtcacggcatcagcacctccggcagctatcgcaactactatgaactcgatggcaaacgcatctcgcacgttatcgatccgcagaccgggcagccgataacccataagctggtctccgtgaccgtcattgcgccaacggcgctggaggcggacggctgggataccggactgatggtgctggggccggaaaaagcgcagcaggtggtgcgcgaggaggggctggcggtctacatgatcgttaaagaaggagagggttttaaaacctggatgtcgccgcagttccgcactttccttgtcggcgagaaaaattaaaaagcaagattgcgggttttttactgcgggctttaccacagactgagggtacacttacagctggagacccgtcatgaaaccgatagttgccgataccgatgatcgccgctggcaggcggtctgcgaacgtgatacccgggccgatggtcagttcgtctttgcggtactgaccaccggcatctgctgtcgtccctcctgccgctcgcggcgcgcgcggcgagaaaacgtacgcttttttgccgacgtcgccgccgccgtggcggcgggattccgcccctgcaaacgctgccaaccggataaagactacccgcagcagcaaagggtcgacaaagtggcgcaggcctgtcggctgctggagcaggacgcgcccctgaccctcgaggcgctggcaggccagctggcgatgagcccgtttcatttccaccgtttatttaaatccgtcaccggcatgacccctaaagcctggcaacaagcgtggcgggcgcagcgcctgcgggaagcgctggagcaggggataccggtgacccgcgccgcgctggcggcaggttttcccgacagcagcagctattatcgccaggccgacgcagcgttagggatgaccgccagccagtttcgccgcggcggcgccgccaccgtggtaacctggaccacgggcgactgcgcgctgggtcgttgcctggtggcgcagagcgagcgcggcgtctgcgcggtgctgccgggtgataacgatgcggcattgctcgacgacctgcgccggcgctttcccaatgccgagctgcgtgaaggcgaccctgatttttgtcagcagatggccgagattttcgcccacctcgacgacagccggcggccggtatcgctgccgctggatctgcagggcaccgcgtttcagctgcaggtctggcaggcgctgcggcagatcccggcgggtgagacccgcagctaccgccaggtggcagagcatattggccagccgcgggcggtaagagccgtggccggcgcctgcgcggcgaattcgctggcggtgattgttccctgccaccgggtggtgcgtgaagatggcgccctgtccggttatcgctggggaacggcgcgaaaagcgcagctgctggcgcgcgaggcccaacatgaggaggagtaatgctcgatctgtttagcgataccccaccgtggcaggagccgctggcccccggcgcggtggtgctgcggcgatttgcccgcgaacgcgccccggcgctgctgcaggcgatagccgacgtcgccagtcagtcgccgtttcgccagatggtcacgccgggcgggtacaccatgtcggtcgccatgaccaactgcggcgcgctgggctggactaccgatcgccacggctatttgtacgccccggtcgacccggtaaccgatcaaacctggccgccgatgcctgccgtatttcatgaactggcgctggcggcggccgccgccggcggctatccggagttttctcccgacgcctgtttgattaaccgctattgtcctggcgcaaaactgtcgttgcatcaggataaagatgaacaggatctgcgggcgccgattgtctcggtctcgctgggcttgccggccatctttcagtttggcggcttgcaacgcagcgacccgctgcagcggctgctgctggagcatggcgatgtggtggtctggggcggcgagtcgcgcctgttttatcatggcattcagccgctgaaagcggggcatcatccggaaacgggcgattgtcgttacaatctcaccttccgacaggcgggcggtcgccagtattaaaataagaattattcttgatgtcatcggcgagccgtttaaactgctggctgttttgcttttgcggatagcctgttatggaacttctctctctcgtctggcgccagtaccgctggccgtttctgggcgttattgctctcagcctgctcagcgccgcgctgggtatcggcttaatcgctttcattaacctgcgtctgattaccgctgtcgatacctcgctgcgggtcctgccggagtttcttggtctgctggggctgctgatggcggtgaccctgggttcgcagctggcgctaaccaccctcggccaccattttgtctatcgtctgcgcggtgagtttgttaaacgcatcctcgatacccagattgaacaagtagagaagatcggcagcgcgtcgctgcttgccgggctgaccagcgatatccgcaatatcaccatcgcctttgtgcgcctgccggagctggtgcaggggatcattctcacgttcggctccgcggcctacctcgcctggctgtcaggaaaaatgatgctggtgacggcgctgtggatggcgctcaccatctggggcggctttgtgctggtctcgcgggtgtacaaacatatggccagcctgcgcgaaacggaagataaactgtatcacgactatcagacggtgctggaggggcgtaaagagctgaccctcaaccgcgagcgcgcggagtatgtgtttaaccagctctacctcccggacgcccgggagtaccggcaccatatcgttcgcgccgataccttccacctcagcgcggtcaactggtcgaatattatgatgcttggcgccatcgggctggtgttctggatggccaacagcctcggctgggccgataccgccgtggcggcgacctattccctgacgctgctgtttctgcgcacgccgctgctctccgccgtcggcgcgctgcccacgctgctcagcgcccaggtggcgtttaacaagctgcgtcagttctccctcgccccgtaccgggccgactttccccggccgcaggcgcatcctgactggcagacgctggagctgcgcgatgtcaccttctattatccggaccagcgctttgcggtagggccgcttaatctgacgctgaagcgcggcgagctggtgtttctgataggcggcaacggcagcggcaagtcaacgctggcgatgctcctgaccggcctgtaccagccaatatccggtcagatcctcgtcgacggccagccgctggcggcggagaggccagaggagtaccgcaaactgttttccgcagtgtttaccgacgtctggctgtttgaccgcctgctcgggccgcagggcgaggaggccgatccggcgctggtggcgacatggctggagcgtctgcaaatggcccacaagctgcagctggagaacggaaaaatcgccgacctgcggctgtcgaaagggcagaagaagcgcgtggcgctcctgctggcgctggccgagtcccgggacatcattctgctggatgaatgggcggcggatcaggatccgcatttccgccgcgagttctaccaggttctgctgccgctgatgcagcagatgggcaaaaccgtgttcgccatcagccatgacgatcactacttccagcacgccgatcgtctgctggagatgcgcgccggccagctcgccgaacttaccggcgaagagcgggaacaggcttcccgcgatgcggtggcccgtacggcctgattcacaacgcgcgcccggaaaagcccgggcgccgctgaaattttcagcgtctacatcgctgacggttattatttccccctcctcgcgctatgcttaaggcttccggcccgcaggccggctcaccattctcaaaaggattgcccgatcgatgtccgttttgcataaaaaaagcgcccgcttgcgtgacgaagagcgcgcccgtctgatttggctcttgagcaccgataaagcggtgacttccgcgctgctgggcaaactgacgctggctgaacgatatgatgaagggacgctggccgatgacctggccgaagtggaaatgctggtctcgcatctgccgccgccggatctcgccgatgcgctggaagcgcttccctatgacgcccgcaccgcgctatggtgcctggtgcccgacgataaacgcggcgaagtgctgctggaggcctcagagaacgtctggggcgacctgatcgacaagatgagcgaccccgagctgctgcaggccatgcagccgctggatatcgatgaacaggtttacctgctgcagcatctgccgcgcaacctgaccggacggctgctggcgaccctgccggccgagaagcgcgcccgtattcgccagattatgcgctacgccgacaacagcgtcgggtcgatcatggagtttgaggtcattacggtgcgaccggaggccaccctggcggcggtgcagcgctatctgcggcgtctcggtaaaatgccggaaaacaccgataagctgttcgttaccacccgtaacaagctgctgctcggcgagctggagctgcagaccattctgctcaatgatgcgcagaagcgggtgggggaggtgatggagggcgatccggtcacctttcagccgcacgaagaagcggagaaggtggcgcgcaccttcgaacgtgatgacttgctcagcgccgccgtcattgatgccgacggcaagctgatcgggcgcctgaccatcgatgagatcgtcgatgtggtttatgaagaaaccgataacgatctgcggcggatgggcggcctgagcgatgaagaggatgtcttcgccccggtcagcaaagcggtgaaaacccgctgggcgtggctggcggtcaatctgtgtacggcgtttattgcttcccgggtcatcgacggcttcgaacacaccatttcacagctggtggcgctggcctcgctgatgccgatcgtcgccgggattggcggcaacaccggcaaccagacgatcaccatgatcgtccgggcgatggcgctgcagcagatccagcccggcagctttaccttcctgatcctgcgtgaaatgggggtcgccctgattaacggtctggtgtggggcgggattatgggagccatcacctggtggctgtatgacgatccgcagctcggcggggtgatgacgctggccatgatgctcaacctgctgatggcggcgatgatgggcgtgataatcccgatggtcatggtgaagctggggcgcgacccggcggtcggctccagcgtaatgatcaccgccatcaccgacaccggcggcttctttatttttctgggtctggcgacgctgtttctaatgtagcctgcgcttttgcccgcaggcggcgggggatgatcgccatcgcgacaatccccgccagcacaccgatcgccagattgctggttcccaccgtcgcggcgacggtcaccagcatcaccagcgtttccggccacggattacgcgccagctcgcccgggcgaatgctgtgccagctaaaggttttcaccgccacgatcaccatcaccccggccagaaccgccatcgggatcttcgccatcacctggctgagcgctgtcaccagcaggagcagcaccaggccggcgattaccgttgagaggcggctgcgggcccggcccatttccacgttcacgatagtctggccgatcatcgcgcagccggcgataccgccatagcagccggcaaggatattggcgatacccagcccggcgctttcccgcgatttgttcgacggggtatgagtgagatcatccaccagcttagccgtcagcaaggactccatcaggccgacaaaggcgatgctgagggcgcacggccagattatctgcagggtggtcaggttcaggggaacggtcagggcggtgaaccccggcaggccgccgctcattgacccttcatcgccgacggtcggcagctgctggccggtggtcgcggtatagagggtgagcgcgacgatggcgatcagcggcgccgggatagccttaataacgcgcggcgcccacaggacgataagcagcgtcaggacgaacaggccaacgattaacggttgtcgactccagaaatgcggcacctgagcaaagaaaatcaggatcccgagggcgttgacgaacccggtcatcaccgccgggggaataaagcgcatcaggcgcgccatgccgcacagaccaaacaaaatttgaataatacccgccagaatgacagccggtaaaatgtaccccacgccgtgctgatgcaccatcgggccaatcaccagcgccaccgagcccgcggcggcggtgaccatcgccgggcgtccgccgaagactgacatcgccaggcagagcaccaccgaagcaatcaggcttacctgcgggtcaacgccggcaatgactgaaaacgaaatcacttcagggatgagcgccagggcggtgagcacgccggccagcacttcgcgcgtcagtaaagacggggagcggaggatgagacgcaggttgccggaagcggcggggtcagaaactgggggcataaaaaaagttcgcagcttataaaaaaagagggagcggtgtcaggccctgcttccgtgcggtctgtcacaaaaccagggatgatagcgcggaatctgtcagcgcaccagtacaaaaagtgatttggtgtatacatttattaaacatttttataacggatctcaaaacagaacttaaaatttaaacaatatttaaatttttgagcttcggtggtaacgtgaggggtgagaatcgtatcacctgcgctaaataaaaacagcgagtaaagtaaggctcaaatccgatgaataaaaagatggccgtaccacgctcacaggcggttggtcccaacagcactcggaccaacacccgccatgagcaagagacggatgtattgttgattggcggcggcattatgagcgccacactgggaacctggctgcaggagcttgagccagactggtctattaccatggttgagcagatgtccagcgtggcggaagagagctcaaacgggtggaataatgcgggtaccggccacgcggcgctgatggagctgaactacacgccgcagaccgccaacggcatcaatatcgacaaagcggtcgacatcaacgaagccttccatatctcgcgtcagttctgggcgcatcaggtgacgcgcggcgtcctgaacaaaccaaaatctttcattaacagcgtgccgcacatgagctttgtgtggggcgaagataacgtcaacttcctccgtgcgcgctacgcggcgctgcagcaaagtgaactgttccgcggtattcgctattctgaagaccatcagcagatcaaagcctgggcgccgctggtgatggaaggccgcgacccgctgcaaaaggtcgccgccactcgctcagaagtgggaaccgacgtcaactatggtgaaattacccgccagctgatcgccggtctgcaaaagcatgataatttctccctacagctgggcaccgtggtgcgtcgcttcaagcgcaacgccgacaagagctggacggtcaccctggcggatgccgacaatcgtcgtcagaagcgggtcattaaagccaaatttatctttatcggcgccggcggcgcagcgctgaccctgctgcaggagaccggcattccgcaggccaaagagtatgcgggcttcccggtcggcggccagttcctggtctgcgaaaatccggaggtggtgaaccaccatctggcgaaggtctacggtcaggccgaagtgggcgcgccgccgatgtcggtgccgcacatcgatacccgtattatcgacggtaaacgcgtggtgctgttcggaccattcgccaccttctcgacccgtttcctgaagaacggttcgctgtgggatctgctggcctcgacgaatacctcaaatattttgccaatgctcaacgtcggcctggacaacttcgatctggtaaaatatctgattagccaggtgatgcagaaagataaagatcgtctggccgcgctgtgcgaatattatccggaagcgcggaaagaggactggcggttgtggcaggccggtcagcgcgtgcagatcattaagcgcgacgcgaagaagggcggggtactgcgcctgggcaccgaagtggtcagcgatgatgaaggcaccgtcgcggcgcttctcggcgcgtcgccaggggcctccaccgcggcgcctatcatgctgcagctaatggaaaaagtgtttaaagataaagtcaattcgccggaatggcagaccaagctgaaggcgatcatcccaacctacggtattcgtcttgacggcaacccggcggagatcgagaaagcgctggcgtggaccagtgaagtgctggaactgaaatatgagccagccggggcggtggatgaggtaccgcaggcggagctgaagccgctgagcggcggcaagccgatggcggatatcgcgctctgataaacgctctgacaaaaacggcagcctgcgggctgccgttttttattgccgtttgcgctgttcgccttagcggacgacagcgttgccgatagtctcgtcggcgcgccagatgcgatatttcacatcgacattgctcggcgtgtataccacgatcggcagtttgctgttgtagcgcagcatggcgtcatccccgaggccggcagtgacaaatttcttctcttttttgccgtccgggcaggccatcatggtggataccgggccgctcagcttctcaaagacatagtaatcatagccccagccttccagggttttactttccagttccccgccgagacgatgatggttgcagtcgacttccagcgtctggccgatcatcagctcaaccttgagcgccgactcatcctgctgctgcggcagctgaataacctgacgcttcatgcctttttccgctttcgggaacggcgcgactttttccagcggctggtctgcggccaatgcgccagcggacatgcaggcggcggtcagcagagaaacggctagcgtagtgatttttttcacggttgatcatcctttattttcgttcctgacagagatagcctatcatcactcagctgaatgttaagatttatttaccaatttttgcaaaatgaatagtgttatctactggtaagacatcggccgcgcagagcgcaacagaggcgctggcgggccgccagccccctgccgggaaagctattcattacggctatttttcgcttcctcaataaactcttcatcgatttcatcggtattgccggcatgttctcgtcccgacagcaggttccagcaggcgataaacagggcggcgatcagcggcccgatcacgaagccgttgataccgtagatctccatgccgcccagagtggcgataaggatcagatagtccggcatcctggtatccttgcccaccagcagtggacgcagaatgttatccaccaggccaatcacaatcacaaagaagccgacgataaaggcgccctgccacagttggccggtggcgaagaggtagatggccgctggcacccagataatggccgagcccaccgccgggataagcgacagaaacgccatcagcgctccccagagaatgctgccgtccagaccggcgatccagaaggcaaagccacccagcgccccctgcgccagcgccacggcgacggtaccttttaccgtggcgcgggccacagcggcgaatttagcgaacaaatgctgcttcacatagcttgataacggtagagactcgaggatcaacagcaccagataaggtccatccttcagcaggaaaaacagcagatacagcatgatgccgaagctgacggtgaagccaaaagtccctttgccaatcagaaacgcgctgccggccagatactgaccgcctttcagagcggcatcagagagctgctgctggatctgctgcgcgctatcaaggttatgatcggcgaggaagcttctggcccagccgggaagatgggcgaacaggctggcgaccaccgtcggaaactgggtgtcgttatgctgcagtttgctgtacaccaggttgagctcgtaggccagcgaggagagaatgatagccagcggcgtaaaaacgataagacagataatgacgatggtcatcagcgccgcgaggccattgcgctcgccgaggcgggtacggatcttgtttttgaccggattaaaaatcaccgcgaggatcgcagcccaaaggatggcggaataatagggtgagagaacatcaaaaaaggccagggttacaatgaagacgataaggatgaaaaatcccttggtaagtccattaactctcatgttatccgctcctgcttatgagtcatacggtcgaataatagatgctacgacgtaatttaccatcaggatagtcgtacatcttcacgatacattgaagaaagggcacaaattaagcgagcgggcggcaacaggggaaacaggcataaaaaaaccagccttaaaaggctggtttctgtggagtttttggtcggcacgagaggatttgaacctccgacccccgacaccccatgacggtgcgctaccaggctgcgctacgtgccgacgcgtggggaacaatattacccgttccccaggcgaatgcaagcgggtcacgcgcgattgattcataattaatcaatcagttagcgataaagcgtttttcgtcagtcaggacctgcagcaacaggctgagctgcggtttctgatctttaattttctcgccgtcgcggctccaggtggtataggtgccgttatggttgaggaccacggtgatggtcggggtggtgatggccagcgtatcgccgttggccgcggtgacccagttacgacgccgcgcggcgctgaacagatcttctccctgcgagtactcattggccggcgtcgaaacgtgaagcaggcgctgcatcagcgtagtcatcacatctttgttatcggtcagggtggcaatctcctgcgccggcgtgcccggccagtgaataaccagcggcacctgcagctgctcgcgcgaccagtcgaacgcgtcgtgtttcgcattcagcggcttgccgtggccgccggtaataattaccaccgtattatcgagtttgccggcttcgcgcagcgcagtcagcacccgatcgatctgggcatcaacgtcgccagccgccttgctgtagcggcggacaaagccctgctgctgcgtgtcgtcgagggtggtgccattgagcgagatccacgagaaccagcgattctcatcctgcgcgtaacggtccagccagccgatccactgattggccgtctgctcgtcgctctgggtcttcgcgctcggcagcgagaaatcggagagcagcgcctggcgatacagcgggctgctaaacccatcggaggagaagaggcccagctggtagccttgctggttgagggcagtaatcagcgcggcgggaatacgcgccgagaggacaccgtccatatagccaggcgaaataccgtagaacaagccaaacaggccgctgtcggcggtattgcccgagctcatatgctgggtaaagttaacgttttctttggcaaatgccgccagcgccggcatggtcttttcaaaccgcgagtagttcaggttgtcgacggtgatcagcagcacgttgtagcccgcgccgaggtcacggtagcgcaggttgctaagcggatactggaccgataccgcctccggcgccccttgctccaccagacgacgctgataatcctgggcgtcgagcaggccatgtttctcaaggaaacgacgggcggtcatcggataggagagcggcagattcgcccgctgcatagtgatcgggcgatagaaattggcgtccgcccagatatagaccaggtggctgctgacgaacgacaaaaagaagaaccaggcgaccgggcgggcgtaatggcggcggcgcgtcaggctgcgcagcttttgccagctccaggtggcgaagagcatttcaatcaagaagatgaccgggacgctgataaacatcagctgccagtcgcgcgccatctcattctggtcagggttgatgaccagctcccagacgaccgggtttaagtgcagatggaagcgggtaaaaacctcgctgtctatcagcagcagcgtcatcccggcggtggcaaggatcaccgacaggaagcgcatcaggcgctgcgagaccacgataaaggtcaacggaaagaggatcagcacatagctggtaaacaccagaaagctgaaatgcccgacgagactgacgtacgaaaatagtcgtccggcaagcgtcgtcggccagtcggcgacaaaaaggtagcggctgccgagcaccatggccaacaacatgttgaacagggcgaaccagtgcccccagctaaccatctgggagactttttctcggtagggctgacgtagagtcaccatatactgttgctgttatccttaatgcgctggatcgtcgttaatcgaagattgcaaagcctgcgcgaaagaacgggcgatggcctgacgctgcgccggcgcgacgctactgttgatcaggttggtcaccatattgcctaacaccatcagtgaaaggtccaccggggctttgtgtgattccaggacgttcgtcagctcgctgagcaactgttcgacctgttgatcgctatagcgggaaatttgcggcataaactcaaaatctgtttgttcgtgaaagggcaacatattaccgtagcagcagctttttttccgcattttttcgccgcggcgcaaaagcgcatcaatcgacgttaacgacgtcgaaatgtgtggcgccagttgcgtcggccacccggcggtggttgaataccgcccggtctaaaaggagagtttaacatgagtctggatatcgaccagattgccctgcatcagttaatcaaacgtgatgaacaaaatctggagctggtgctgcgcgagtcactgctggagccgaacgcgacggtcgtcgagatgatggctgaactgcaccgggtctatagcgccaaaagcaaagcctatggcttgttcaatgaagagagcgaactggcccaggcgctgcgcctgcagcgtcagggggaagaagagtttctggcgtttagccgcgcggcgaccggtcgcctgcgcgatgagctggcgaaatacccgttcgccgaaggaggcattgtcctcttctgccagtatcgttaccttgcggtcgagtatctgctggtggcggtactcaataacctgagcagtatgcgcgtcaacgaagagctggatatccgctcgacccattatctggatattaaccatgccgatatcgtcgcgcgcatcgatctcaccgaatgggaaaccaacccggagtcgacccgctatctgaccttcctgaaagggcgggtagggcgcaaagtggccgatttctttatggatttcctcggcgccagcgaagggcttaacgccaaagcgcagaaccgcggcctgctgcaggcggtggatgacttcgccgccgatgcccagcttgataaatccgagcgacagaacgtgcgccagcaggtctacgcctactgcaacgaacagctgcaggctggggaagagattgagctggagtcgctgtccaaagagctcgccggcgtcagcgaaaagagcttccaggaattcaccgctgagcagggctatgagctggaagagagcttcccggcggatcgcagcaccttacgtcagctgaccaagtttgccggcagcggcggcggattgaccattaacttcgacgccatgctgctgggcgaacgcgtattctgggatcccgccactgataccctgaccattaagggtaccccgccgaacctgcgcgaccagctgcagcgccggacgtcaggcggcaattaagccctgcgccccgtcggcgctaccgctgaacggggacgatctccacgccgctctgcaccaactgttggcgcagcgcggcgtcgggttctccatcgacaatcagcgtactggcgaggctcagctcgccgatggcaaaggccgacgcggcgttgagcttttcccgggaggccattaccacggtttctgccgccctggccgtcagcgcgcgcttgatgcctgcctcttcgtaatcaccggtggtgaaacccgcccgcgggtggacgccggtcacccccataaagaacagatcggcgttgatccgcgccattcccgccagcgtctcggcgccgacggcgacaaccgaatgtttaaatactctgccgccgagcaggatcacctcgattcgcgggtggtccaccagcgccacggcgatgcccgggctgtgggtgaccaccgtgcagctgaggtcggcgggtaaaaagccgatcatcgccgcggtggtggtgccgccatcgacaatcaccacctgtcccggctggatcagggcggcggcggcgcgggcgaccgcctgcttggaggcgatctgcacgcttttgcgcgtttcaattggcgcaatggcggcggataccggcaatgccccgccatggacccgctgcagttttccctccgccgccagctcgcgcagatcgcggcgaatggagtcctcggagacgttaaaccgctggcttagctccccggacatcacctgtttttcctcggtgaggatctggaggatctgctgttttctctgactggcgagcatcggttttccttcatcgaatgatcttgtttgtgcacgattatgcatgttatggtgcctgctgtcacctcaaaggggaaataacatgcaaacacacgcaccgcacgtccgccacgttcgcgagacgctgctctcggataactggtacacgttgaaaaaatataccttcgaactgctgcgtcgggacggtcgctggcaggagctgagccgcgaggcctatgaccggggcaacggcgcagtcattttactctacaaccgggaaaagcggacggtggtcctgacccgtcagttccgttttccggtatttactcatggccacgacggatatctcattgaggcggccgccgggctgttggataacgcctcgccggaggcgcggatcgttgccgaagcggaagaggagaccggctttcgcgtgacccgtgtcgaacccgtcttcaccgtctttatgagccccggctccgtcaccgaaaaactctacttttttatcgccgaatatcaggccgatgaccgtcggggcgacggcggcggactggcggcggaaggtgaggacattgaagtactggagtggccgctgacgcgggcgctgcaggccattcgcgatggcgagatcatggatgctaaaaccattatcctgctgcaacacctggcgctgaatgccgacacgctcctcgccggctgagcggcaaggagcggggagttaacgcagctcgcgggcaatggcgctgtacatcagcgccgcttccaacggctgagcgttgaaggaaggttccgcctgcggccaggtcgaccactggacgatcaccagatgttccgcgcggttcaccatgatcacctggccgtagatccccagcgcccacagcgaccctttaagcccttcctgcggcgtcggctggacgttttgcgcattcgccggaatcgcgttattccaccactgatagccgtaaataccctccggatgcgctgccgagaccgagtttagcgccttggtccagctggcggcttgatcgaaccagccagtcggcaccagctgtttgccattgcttaaccgaccgtcacgggcgacgaattcaccaaagcggccccagtcttcaagggtggcgttaaagccgtgggcgccgacgtcgtgcttcccttgctgataagcatgccacacgccgtcgtgggccatcccggccggctgccatagagcctgttcaagccaggcggccagcgacatgccggtggcgcgctccaggatatccccaagcagccaggcgccgccggaagagtaggaccactgctcgcccgccgggtgttgacgcgccaggccggtgacgattttacgcacgcaggcataggcgcccgggtgcgcttcacactgggtcaggcgggcgaaatgcgactgcgggtcggtgtagtcttcattccattccaccccgctggtgtgttgaatcaactgcttcagcgttacgccgtcccaggcggtgcctttcagttcgggttcataaacggtaatcaggtcatcaagggagtggattttaccctgttgaatggcgataccgaccagcgtcgagaccaccgatttgcctaccgagcgcgaggtccacagggtggtgtcggtattaccttcggcgagatatttccaggcgactttaccatctttcagcaccagcataccgctgacgttctcgcgcttcaggtaatcctgcaaattccaggtgtggccgttgagcgtatagcgggcatcggtcagttgtttttcagcgcgctccagcggcgtcgaggcgccgtggcggaagacatcgccggcatagttgcgatagtcattgcgaaagccaatcacgcgtgaagtctgatcccagctgagcatgtctttggccgcgggtagcgtttgatcgtaaggcgttgggcagacatccagcgtcaggctgccgcagtgttgcgccattgccgccgccggcagagccgccaatattaacgccagggccagtggttttcttatcattgtcatttcctcgtttgccatagattcgctgcgcagtatataaatcggcgcgcgccggctaaaatcagcacatgggggattttcccccttaagggagaaaaaggatgaaaaccctacagtactcattcgcacagattgaagccttcgcgacgattgctgagaccggcagcctgtcgcaggcggccattcgtttagctaaagaccggaccacgctgcgcgatctgctggactatctggaagatgcgctgggctaccggctgttcagccgtgaaggacgtagcctgacgctaaccgccgagggcgagcagctgtttcgccaggcgcatctgctgttgcgtcaggcgcaggctttcgagtcttttgcgcaaacgctgccgcaaaccgccgggcaggcgctgcgtctggtgtacgatcccttcgtgccgcgtgaatttctctgtgcgctggccgataacctggcccgacggcagatccgcctgagctgctggagcgcctcgcgtcgcgaagccgagcaggcgctgagcgatggcgtggcggagatggcgatttgtcaggctaacaaccgcacgctggggagcgaaatggagtggcgggcgctcggcaccgtggatctgcgtttctacgcggcggacagcctgttccacgacgctccgcggccgctgacgctattgaatctttcgttgacgccgcagttagtgatgcaccggcgcagtgacgatcaaatcgcccgccggctgcagatttccggccatacgctgtatatgaatgaaattaccctgttgcgccatgcgctggagcaggggaggggctgggggtttttaccggaccatttgcggccaggcgagtggcagggagtcagtgaaatcgcgacggaggtcggcagtcaggggctgaacgtcactatggtgatgctctggctgcccggaatgaataagcatcggatgcttagcgacatcgtgcacgaggcgccggagctttggctgcgcagataacaaaacgccccggagcctgagaccccggggcgcttgccatacaacttgctatcggcgattacgcgcgaacgaagtcgatgtgagtcagtttcggcttgaacgcgtggcgctgaacagcctgaactttgactttttcttctttgccatcaacaacgacggtcagaacttcgctgtaaaactcagctttgtcctgcatgttccatactttgtcgtggtccagttcgatagcaaccggagcagctgcgccaccgtagatgattgccgggaacttgttagctgcgcgcaggcggcggctcgcacccttaccctgctctttacgtacttctgcgttgatagtaaacattgatgtctctctatatataaagcctgctacaggcgacccagcaacaggcggattatctgctttgcgaatgcaaaagcgggcggcattatagccgccaaacgacacccgggcaatcaaaacctcagctttccggtaattaacgcagctcgttggcgcgacgaaaacgcccctgataatcgaacactttttcccgcacctgccagtactgccccttcatgcgggcgacgacaaagtccggatggcgcagcagcgcctgctgggtcacgatatccgccggcggtatccagcgcagcggcaccccgggggtgcgggtatgcgggcgaataaacagttgttcgaaggcggtgcgctgggcgggggtctgcagacggaagcgctcactgacatccgccccgtcttcatcgtagtaggtgattttcagccacgggcccttctcgtcgccgccgtgctgcaggaccatgccgctgcagcgcagcaccagcgcgtccttcagcttcagcgccgccttcagcatatcgtccgggtcaaccagtatagtgtcgcactcccggcagcggcgggcggcgatgtcgttttccgcattacactgcgggcagtttttaaagcgaaagcggaagtcgcactgttcgcggtggccgtcgtcatcttcgaaccacccctggcagcggcggccaaagtgttcaatcaaggtgccgtcggcggtggttttgccccagaaggtattggcgaagccgcaggccgggcagaagacctgcaccggcacgttgtcgcttttgcccttcggcgtccccacttccggggcatacaggtcatgcggattgccggcgtagtcgaggatcagacagtcggttttccccggcgccaggcgcagaccgcggccaacgatctgttggtaaagactcaccgactcggtggggcggaggatggcgatcaggtcgacgtgcggggcgtcgaagccggtggtcagcaccgcgacgttcaccagatagcgatacgcctgcgctttaaaggcctcgatgatgcgatcccgctccggcccaggcgtttcgccggtgatcagcgccgcctggcctaccggcagcaggccggtcacttcccgggcgtgttccacggtggcggcaaagatcatcacccctttgcggttttcggcgaactccacgatctggctgacaatatgcggcgtgatacgctgttgttttttcagctcatggttaagatcggcttcgctgaacaggccgttgctttgcgcctgcaggcgactgaaatcgtactgcaccaccggcatatcgaggcgctccggcggcgtcagatagccgtgtttaatcatatagcgcagcggtagctcatagatgcagtcgcggaacagggccttttcatcgccgcgcaccatcccatgataatggaactgatagatccagcccttgccaaggcggaacggcgtggccgtcaggccgagcagccggatctgcggattgacctgccgcaggtgaccgatgatctgctgatactggctgtcgtcatcatcgctgatgcggtggcattcatcgacgatgagtagcgaaaattcgctgcgaaactggtcgagattgcgtgccaccgactgcacgctgccgaacaccactttgccgtggctctcttttcgctgcagaccggcggcgaagatatccgcctcgaggccaagggcgcagtatttggcatggttctgcgccaccagctctttgacatgggccagcaccagcacgcggccgcgcgccagcctggcaagctcggcgatcaccagacttttgcccgcgccggtgggcaggacaatcgccgccggctcggtatggcgacggaaccaggcgagggtggcatcgacggcttcttgttggtaaggacgtaatgtaaaagtcatgaattcacggggctaattaactggcgaatagtatgccatgaatcttttcccttgagtggtgttaagagcccgttatactagccggtgaaattcttctttttcgggcgatttgcccgctccagcactatgacaggctaaaaaaatctcatgcgacttgataagtttatcgctcagcagctgggcgtcagccgggctattgccgggcgtgaaattcgcggcagccgcgttaccgtggacggcgacattgtgaaagatgcctcttttaagctccagccggagcacgaggtggagtatgacggaaatacgctgacccagcagaatggcccgcgttattttatgctcaacaagccgcaagggtacgtctgttccaccgacgatcccgatcatccgactatcctttatttcctcgacgagccggtggcgcataagctgcacgccgccggacggctggatatcgacaccaccgggctggtgctgatgaccgatgacggccagtggtcgcatcgcattacctcgccgcgccaccattgtgaaaaaacctatctggtggcgctggaaagcccgctggcggaagggaccgctgagctgttcgccaaaggcgtccagctgcataacgaaaaagatctcaccaaaccggcgttgctggaagttatcactccgaccgaagtgcgcctcaccatcagcgaaggccgctaccatcaggtgaaacgcatgttcgccgccgtgggcaaccacgtggttggcctgcatcgggaacgcatcggcgacatcctgctggatgaatcgctggcgccgggtgaatatcgtccgctgacggaagcggaaatcgccagcgtgggcgccccgcagccacggagtaaaacgtgacgctgaagcagaattcttcactggggattgtgtttatccttggcctgctggccatgctgatgccgctgtctattgatatgtatcttccggccctgccggtgatcgccgcccagtataacgtcccggacggcagcgcgcagatgacgctcagcacctatatcctcggctttgcgctgggtcagctgctgtacggcccgatggcggacagccttggccgcaagccggtgatcctcggcgggacgctggtcttcgcggcggcggcggtagcctgcgccctgtcgcaaaccgtcgatatgctgattgtcatgcgtttcttccacggtctggcagccgcggcggccagcgtggtgattaacgccctgatgcgcgacatctatccgaaagatgagttttcgcgcatgatgtcgtttgtcatgctggtcacgaccattgcgccgctggtggcgccgatggtcggcggggcggtgttggtctggttcagctggcatgccatcttttggatcctcgccctggtggccctgctggcctcgctgatgatcggcctgtttatccgcgaaacgctgccggctgaaaggcgtcagccgttccatctgcgcaccacgctgggtaactttgccacgctgttccgccacaagcgggtactgagctatatgctggcgagcggctttagcttcgcgggcatgttctctttccttagcgccggtccctttgtctacatcaatataaaccacgttgcgcctcagcactttggctactattttgcgctgaacatcgtttttctgtttctgatgaccatgttcaacagccggtttgtgcggcgggtaggggcgttgcgtatgttccgcgccgggctgtggatccagtttgccatggcggtgtggatggtggtctgcgcgctgctggatgtcggcttctggtcactggtgatcggcgtagcggcctttgtcggctgcgtatccatggtgtcgtctaacgccatggcggtgatcctcgatgagtttccgcatatggcgggcactgcttcgtcgctggcggggactttccgtttcggtatcggggcgattatcggcgcgctgctgtcgatggcgacgtttaccaccgcctggccgatgctgatctctattgccttctgcgcaacctgctctattttcttctcgctttacgcatcccggcggcgaaaaatcgcacgctaggtcacattttcaggggcgaaatcgcccctttcttgatgcatgtcaaccgcaatgggcttcagggttctgcgatttgtttcctttatgtaaaatcaattagtgtaaaaagtcgcattgttgcgataaaaaagttgttttggatcacagaaacgggtacatatagcgccaatcggctcgccgggtataaaaaataaagcgctggattataagcgcttaaccctggtccgccgccgctgtaaacgttttctgcctcaaggcaggactatttgtcaacagtgtgttaatattgatgtaaatttattgtgaagccttttgcttccggggaaaccaagtgaatacacaacaactctctatcgtacaccgtctgccgcagagctatcgctggctggccggttttgcgggttccagagttgaaccgattccgcaaaacggcgcgcagaacgagaacagtctcgttgccctgaaattgctgagcccggacggtgagaaagcctggccggtgatgcataagctcagccaggcgttaagcgacatcgaagtcgactgttccgtgctggagtgcgaaggcgaaccctgcctgttcgttaacctgcaggatgagtttgccgccacctgtcgtctgaaaaactttggcgtggccatcgccgagcccttctccggcaataaccctttctgaccgtcagcttagcgccagcagctggcgggtatactcatgccggggtgcgctgaagacggacttgcactcgccctgttcgaccacctctccctgacgcagcaccattacctggtgacacagcgcccgcaccacgcctaaatcatggctgataaaaatataggccagctgatgctttcgctgtaaggctttcagcaggttcaggatctgcgcctgaacggttttgtccagcgatgaggtcggttcatcgaggacgatcagctgcggtttgacgatcaacgctctggcgatggcgatacgctgtcgctggccaccggagaacgccgccggatagcgctggcggctggccgggtcgaggccgacctcctgcatggcaaggatcaccgcctgttcgcgttcggccgccgtcagcgtcggctggtggacgcgcaagccttcctcaatgatctgctgcgccgtgaggcgcggattgagcgacgagttcggatcctgaaaaaccacctgcatctgtcggcgcagcggtagcagctgtcggcggttacgcccctgaatcggctggccggcgaaggttatcttgcccccggacgggatcaggcgcagcagggccaggccggtggtgcttttaccggaacccgattcccccaccaggcccagcgtctcgccggcgcgcagctgaaagctaaggctgttgaccacccgatgatgatcgaccacccgacgcaggatccctttgcgaacgggaaacgccacctttaaatcgtccgcctgcagcagcaccggggcatcggcggccagcggcaccggctccccgtccggctcgctatccagcaggcgttgggtgtagggatgcgctggcgcgctgaacagcgcccgacagtcattgtgttccacgcagcggccgttctgcataaccgccacccggtcagccagctggcggacgatgctcaggttatgagtgataaacagcagccccatgttcagctcctgcttcagctcgcgcagcagttgcagaatttgcgcctgcaccgatacgtccagggcggtagtcggctcgtcggcgatcagcagctccgggcgagtcagcagcgccatggcgatcatcacccgctggcgctcgccaccggagagctgatgcggatagtccgccagccgccgcggcgcctgacggatcccgacgcgctccaggcagtcgaggatctccccgcgcgccgcctgtttgcgcattccccggtgtaacgacagcacctcgtagagctgtttttccagggtgtgcagaggattgagcgataccatcggttcctgaaagatcatcgcgatccggttgccgcgcacgccgcgcagggtcgcctcatccgcatgcagcagcgactggccatgaaaacggatgtcaccgctggggtagctggccggcggggtagggagcagccgcagcaccgacagggcggagatgctcttacctgagccggattcgcccaccagggccagcgtttcgccgaccgccacctcgagcgacagattatgcaccacggtctgcgtctcgccctgctggcgaaaggcaatagagagattgtcgatagctaatagcgggtgggtcatattacaccgccttactcgggtcaaaggcgtcgcgaaccgcttcaccgataaaaatcagtagcgtcagcagcacggcgacggagagaaatgcggcaatgcccagccagggcgcctgcaggttgtttttgccctgcagcagcagctcgccgagggagggcgagccgagcggcaggccgaagccgagaaaatccagcgacgtcagggtggtaatggagctgcacaggataaagggcaggaaggtgagggtcgccaccatcgcgttgggcaacatatgccgcaggatgatctgccggtcgctaacccctaacgcctgcgccgcccgaacatagtcgtagttgcgagtgcggagaaattccgcgcgcaccacgcccaccagcgtcatccagccaaagagaacggtgattgccagcagccaccagaagcccggctgcacgacgctggagagcaggatgatcaggaacagcgttggcatgccggaccagacttcgataaagcgctgtccccacaggtcgattttaccgccgtagtaaccctgtatcgccccggccagcaccccgagcacgctggagaacagcgtcagcagcagaccgaagagcaccgagatgcgtgtcccatagaggatccgcgccagcacatcgccgccgttggcgtcggtgccgagccagttgctggctgagggcggcgatggaaagggaaccgtgctggcaaaattaattgtcgtcgcgccgaagcgcactggcggccatagcgcccagccgtgagtcgccagctggtgctgcagccagggatcctgatagtcggcggcggtggcgaacgcgccgccgaaggtttgctcagtgtagttttttaacaccgggacgtacagctggccccggtactgcaccagcagcgggcggtcgttggccagcagctcggcgcccaggctgcataggaagagaattaaaaacagccacagcgaccagtagccgcgacggttgtggcgaaagcgcgcccagcgggcctgattaacgggactgaagaaagacattagcggccctcaaaatcaatgcgcgggtcgaccagcgtatagctgatatcgctgacgatattcagcagcaggccaatcagagtgaaaatatagagcgtgccaaacatcaccggatagtcgcgggagaccgtcgcttcatagcccagcagacccaggccgtttagcgagaacatcacttcgatcagcaacgagccggtaaagaacatactgataaaggtggccgggaagccggcgatcaccagcagcatggcgttacggaacacgtgtccccagaggatctgtttctcaccaacgcctttggcgcgggcggtgaccacatactgtttgcggatctcgtcgaggaagctgtttttggtcagcatagtcagcgcagcaaagccgccaattaccgtcgccagcaccggcagggtgatgtgccacaggtagtcgaggatcttttgataccaggggagggtgtcgaaatttggcgagaccagaccgcgcagcgggaagaggtcgaaatagctgccgccggcaaaaatcacgatcagcaggatggcgaacagaaaggcagggatcgcatagccaatgataatcagcgtactgctccagatatcaaagcggctgccgttgctgaccgctttgcggatgcccagcggaatggagaccagatagataatcagcgtgctccacagcccgaggctcaccgagaccggcaggctgtctttaatcagctgcagcacggaggcgctgcgaaacaggctgtcgccgaaatcaaagcgcagataatcgcccagcatcttcagatagcgctcgtggagaggtttatcgaagccgtagcggtgggtgatctcggcgatgacttccgggtcgaggccgcgcccgccgcgatagtgaccctcgctgatattgcctgcgccggtgcgggcatggctggcgcccattccgccgtcgccagcccccggcatcccgccgcgctgattaaactcgatggcggcgatggcctgatcgaccgggccgccaggcgcgatctggacaataaaaaagttaatggtgatgatggcccacagggtggggatgactaacagcaaacggcggatcaggtagctgcccatgggatgtccttagcgtctgtccgcggggagggtggccgctttgttcacgtcgtaccaccaggtatcgaggccggacgaatagatggggcgggtcgcggggaaagagaacttattccaccacgcggtgcggtcctgcgccatataccacatcggcaacatgtagttattccaggtcagcacacgatccagcgcccgaccgagagggatcagtttctgcttattgccctgccactgcaggatctgcgcaatcagcttatccactaccgggctttgcacccccggcgcgttgtagctggagtgaatatagtcggacgcccaggagatttgcaggtcggtccccggccagggcatggcgcgccacaggcttggcatcatgtcgtaatcccggctgcggcggcggttgctgtactgcgaattatcaacctgacgaatatccatgacgatccccagacgctgcaggttgtgctgaaacggcagcacccagcggtcattgcccccggccggcagcagtagctcaaagcgcagcggcttgccggtggcggcgttgacccggcgctggttcttcaccgtccagcccgccgcattgagcagggcgtcggctttgagtaagttggcgcgatcgaagccatcgccgcgggagaccggcggctggtaatcctggctgaagagctccggaggcagttcgtttttcatcggcgtcggcagggccagctcggctgcgtcaggcaggctgcgggcggcatattcggtgttctggaaatagctgttggcgcgctgataggcgctgtaaaacagcgccttgttcatccattcgaaatcgaacgccagggtaatggcctgccgcacccggcgatcggcaaaaatcgggcgctgaatattgaacgccagccactgggtatcctgcgccgaggtattggtatgctcatctttaatgatgtagccgcggctgaagttgcgaccgacgtagcgggtagcccagtttttggcgacggtctcttcccggcgatcgacggctcccgctttaaaggcttcgaaagcgacattgtcgtcgagataatagtcatagcgcagcgtatcgaaattccagcgaccgcggttgaccggcaggtcggccgcccagtagtcggcgacgcgggaataggtaatatattgccccattcgccaggcgctgatgcggtatggcccgctggccagcggcggcttcgacagcgggtcgctgagtttgtgctggcgccagaacgcctcgggcatcaccggcaggctcagcagactcagcatgttctctttgccgggctggccgaggtcaatacgcacggtcaacggcgcgatggccttcacggtggtgcctttataaaacaggcgaaactgcggcaccccttcggtcataaacttgttgaaggtaaacgccacatcgcgggcggtgatcggcgtgccgtcatggaagcgggcgcgcgggttgagcgcgatctccatccaggaatagtcctcggcatagcgcgcccgctcggcaatcagcgggtagtagctgccgggctcatcatccgaggtggtgaacagggtatcgtagagcgcctccgtgcgtaccgcggggttgccgcgcagcgcataacggttgaagttatcaaaggtgccgatcgccgccagggtgagggtgccgcctttcggcgccctgggattgacgtaatcaaaatgactgaaaccggcggcgtatttcggttcgccgataatcgcgaaggctacgctttcctgaatggtttgcgccttagcgtccaggctaaacagagccagcagaatcagaaagaggcgcgcatacataggcggcagaataccctgtcatggccggcccccatggccgacatccgttcccgcatcataagtgagacttagcgcgttgtgaaatagttcgcgggttcatcgtgcgcagccaccagcccggccagcgacagcggtcggctgatccagtacccctgcaggaaatgaacgccctggccgcgaagccactccgcctgttcctgggtctccaccccttcggcgacggtcattaatttcagccggcggctgagggtcagtaccgcatccagcaccggcgaggttactgtttcagtaccaatcgcctgcacaaaaccgcgatcgatcttcagataatcgaagttataccgttcgagatagatcagcgcgctatgcccggtgccgaaatcatcaatcgcgatttcgaatccctggcggtggagccaggcgaagttagccatcgatttttctttatcaatcatcgcccgctcggttacctccagcaccacgtgaaagtggtcggctggcagcgcggcggcgaagcgcagcatatcgtcacggaagctgtcggcctgcagatgggcaggggaaatattcagccccagcttcacgccgcgcggcagaatacgcttcaacaccgcagcgtcgctggcgatcagcgcgagcaggtgatgggttagcggcacgatcatctgctgggtttcggccaggttaataaaaacgtcgggcggaatttcaccaaccaccggatggcgccagcgcattaggacctccacgccgctgatacgtagagtctgagcattaaccaccggctgataaacgatgtagaactggttatttttgatccccagcagaatggattttcgcggatccgatttgatcgtcagcacgtaatagcagagcagccccgccagcaggccgcagacgaccccgagcagcagagcaaactgcgtattttccgccagccagctgttggcatacagatagaccttcagcggtaagccctcgatctgtgcctggcggatcggcgcgttatgcagcgtttgcggatccaccagccgattactgaaggtggagatagcggtgtgatcaatggccagcgcaatgccgctgaaatcgttttgccgcgcggaatagaggatatacggtgtgagattagcgttaatcgacacgaaaatgccgctgttttgatcgccgggtttacctacccacagcgccagcgccgcgctcttcggcatcatcggcgtgcctggtaaaatcgccatagcaacgggtttgctgatatcgatggccgggatcagctggctgaggggcgtattcatggctcccgtagccgatgagcaaaaggcgatgccgtttttgaccagcaggaaagcgcggacgttggggctgaacgcggcgtgggaggtaagcccggagtcaatattctcgcagggctggtccaccagcggctgcaggccgtcaatggtctggcgcaggtcgtgaaaatagcttttcagataggtattaacattgttgataatggcgtcgaaacgctcggcccggttatggtagatcaccataaactgaatgctcccggccaacagcgcgacgatgatccccacgctcaggctggttaaccaggttttacgctggggcgaaaagtagcgagtaagcatagccagattctttccgtgttattgaagcgcatcaacggagtgtcggtcgtcgtttttctcattcccacttaaaagacatagcttattttgcgacgttgagaaccaggtggcaaaaaaaaacactgcctggggcagtgttttttatcccgcagccagccaagggataaccggcggcggtagaggacagtttacgagcggctcaggactcgacgcgcttcattgtagcgctttttccagtacggctcatccatgctggagatagtcaccccgctgctggtggaggcgtgaacaaactggttgttgccgaggtagatcccgacatggcggccggtagagccggcgcgaaacagaaccagatcgcctgtacgcagttgggcacgggaaatcgattttccggtttcctgctgttcagaggttgaacgcggcagttccagaccaaagtgttcgcggaaggtgcgctgcacaaacgctgagcagtcgatacccttgcgggtgctgccgccgaggcggtaacgcacgcctttccagctggcatactgatccattaaacgggactttacgtccaggttacggaccatcgtttcaaattcatcctgagaggcttgcagtgatgataaatcgccactacccacagcatgcgtctcagaatgcatattcctggcggtacttgttgaactacacgcggaaagcagaaccgctactgcaatcgcgggggctacccgcaagatatatctcaaaatcggctgagatttgaccatgctgtttattttcccttgttgtccttaacgacaatgtcgttataaaaaatgccaaacgtgttagagcctaaatacccatccgcaatgagacaattccttaagcttaaatttgtgcagtcacgcacaattttattcatgccctgaattaatgctgcggaaaaggcaaaacgagaacgagattaccctatcaaacgccgcatggcgagcggttttgcgcgatttcttataagtattttggtgacaaaaagtgaatcatcgggaaaggccaaaattacggcaatatcgggcaaaaaacagacaattccttcatttgtcacgggattaatgtgacaagaagatgaacgtcatgttgaaaaaagggaaaatgtaaaaagggacccaaaaggtccccttatagttaatgactctggcggctgccggagacattatttggccgatattctgctgggtaagtagcgatcgaaaaaggcgatcaatttatcgctcagcggggtcatcaatacccagggcgcgccgatcagcacggcggtcagggagccgacggcaatatcgctaaaccagtgggcgccaatcattacccgcgggaaagcaaagaccacaaagataatcagcgcgacgcccagcgcgcgacggccaaaatagcgccacataaagctcgcgaagatcagcagcatcatcccatgatcgccagggaagctgtccttcgacgcatccttagtggggaagttaacgacgtcgctgacgcgggtaatatcgctaaaaaacagcgacgggctggcgcgctgtaccggcatcaggtgttgtgcgagctggttgatgatcaccgccgccagcagcatcaccaggcccatgatggcgatctgacgacggcctgcagtcggcgcctttagccaatagctcagcatcaggcagcccatcgccagcagcgaacaggcgtcgaaggcgcgattgttgatgatcgccagcagccaggcataagcatggctgacgctgacgccatggttaaagaaatggaagatcgcggagtcgaccggcaaccacgcgccatggttggctggcagataccaggagcaaaatagcgctacacccgcgatgttaagcagcaggattaaaggaattcggtttttcatcatagccattgcgattttgtgacagtcggcggcaaccttagccgccttaacttaaacgaagcctcaacaacgaggtctggagtgcgttccagtcggcttcattcgcggaaataagctcgatccggctatcgggcggagcgacgctgagggtctcgatatggagatcctccccctgacggttgattcgcaccgccccctcggcaatgcgcatcacgcctttaacgcgccccactggcgccagcctggcccattcgagcaggccgatggtgtcaaagaccgtctccgcgtcgaagatccagccgcagccctgatagccctggccattgttgagatggcggcgccagcgctggtgttccgccaggctgagcgcggcgaggccggaagtggggggatggcggtgggcgtgctccgcgctcgccgccccagcgctgccaccagtcggccagcgcccgggcgctttcggcggtttcccgatcacttttattcgccacaatgatgtccgccgcggccagctgatcgcggaagttgtcgttgctgacggctctttcatccagcagttggcggggatcgaggatgcacagggtggcgcgcagatcgatccagggctcatacaccgccgcggtgaggatatcgaggatctgctttgggtggcccaaaccggtgggttcaatcagcaggcgatcgggtttgccctggcgcagcagggtgttcagcccaacctgcatcggcaggccattgacgcagcacatgcagccgccggggatctctttgagcagggcgccgctgtcggccagcagcgcgccgtctatcccgacttcgccaaactcgttaaccagtacggcccatttttcatccgcaggcttctgcgccagcagatgaagaatcgaggtcgtcttaccgctgccgagaaagccggtgatcaaattggttctggtcactcttttctccaggataaatgtaatgttgtaacagttacgcctatcctgacgaaaaaagggggaaaagagaagtcctgaggcggacagaagagaattctgtccgcataagcgcaaatattgttaagaattcagcgcgcgggcgacggcctcgcgggcgccgtgcgtcgccagctgttgccaggcggcgcggatcccggcgacaaactgggcgttgtgcggcaggtcgcggccaaatatttcctccagccccagcagggcgtcgacgcgctgctgctcatcgctctgggccacccgctgccggatcttgtcgaccagcggatcgcgcacgtcgatcgtctgaccggcgtcgtccgtgccgctgacgtagcgcatccagccggccacgccgagagccagcagcggccaacggctgtcgcgcgccagatgtacgcggatgccatcgagcatgcgctggggcagcttctggctaccgtccatggcgatttgccaggtgcggtgtttgagcgccggattgctgaagcgggcgatgagactgtcggcataggccagcagatcaacgccggtaatggtcagcgtcggagcctgttcgtcaagcatcagctggcgggcggcgcggcggaagacgtcatcccgcatgcagtcgctaatgtgcgcatgccctgccagatagccaagccaggcgaggaaagagtggctgccgttgagcatccgcagcttcatttgctcccagggcaacacgtcatcggtcatctgcacgcccgccgtctcccaggcggggcgcccggcgacaaagtgatcttcgaccacccactgaatgaagggttcgcaactgatggcgcagggatcgtcgacccccagcacggtggcgatttccgccagcgactccggtgtggccgcaggaacaatacgatccaccatggtgcccgggaagctgacgttgtcggcgatccagtccgccagcgccgggctgcgtttttccgccatgccgaggacggcattttttaccacgtgaccgttgtcggggatattatcgcaggagagcacggtaaagggcggaaggcctcgttcccggcggcgggccagcgcttcaactaaaataccgggagctgactgcggcagcgtcggattctccagatcgtgaataatgcgcggatgcgtcggatccagtttcccggtcgccggatcgatgcagtagcctttttccgtaatggtcagcgagacaatcgctacctgcggctcgcaaaatttttcgataatcgccgccagcgaatcgagcctggcgttcagacattcgtgcaccgcgccgatcacaatgggctggttgccgtcggcgcctttttccagcacggtaaacagatggtcctgttcgcgaagctggctcatcagcgtgtcgccgctgaacagactgatttcacagatcccccagtcgccgccgacgttattcagcacgcgatcggtgagcagcgcctggtgcgcgcggtgaaacgcgccaaagccgaaatggacaatacgcgagcggagctggctgcgatcgtattgagggtattgcacgttcttcggtagcgtagcggttgcaattgttgtcattcttcccacacctgtttaactgcttattaacaatgccagtctaaagttatatgacaggaagttaaattggtaagccgaaattatccgctgactgtgagctggatcaatcaataggccagcactgtttgcagccaggtgagaaacatgtatggtagtcgtcatgagtgtcgccattattggtataacaacttttgtgagggcatagcgatggagcaaacctggcggtggtatgggccgaacgatccggtatcgcttgatgatgtacggcaggcgggggcgaccggcgtcgtcactgcgctgcaccatattgcaaacggtcaggtatggccggtcgacgagattaaagcgcgtcaggcgctgttagcggcaaaagggttgacctggtcggtcgtcgaaagcattcccgtccacgaggatattaaaacccacagcgggcagtatgcgacctggattgccaactatcagcagagcatccgcaacctcgcggcctgcggcatcgataccgtgtgctacaactttatgccgatcctcgactggacgcgcaccgatctggaatatgagctgccggacggctcccgggcgctgcgtttcgatcagatcgctttcgccgcctttgagctgcatatccttaaacgcccgggtgcggaagcggattacagtgaagaagagcagcgtcaggctgaggtctatttcaaggcgatgagcgaagcagatatcgataaactgactcgcaatatcatcgccggcctgccgggagcggaagagggctacacccttgaccagttccgcgcgcgtctggcggagtacgaccacattgataaagcgcagctgcgtgaaaatatggcctatttcctgcgcgccatcgtgccggtatgcgaagaggtagggatccgcctggctgtgcatccggacgatccgccgcggccgatccttggcctgccgcgtatcgtgtcgaccatcgaagatatgcagtggctgaaggagacggtggatagcattaataatggcttcaccatgtgtaccggatcgtatggcgttcgcgccgataacgatctggtgaagatggtggagacctttggcgatcgcatccattttacccatctgcgctctacctgccgtgaagcaaacccaaaaaccttccacgaggcggcgcaccttagcggcgacgtcaatatggtggcggtggtggatgctatcctgcgtgaagagcagcggcgtaaacaggccggcgatctgcgcccgatcccatttcgtccggatcatggtcatcagatgctcgacgatctgcgcaagaaaaccaacccaggctattcggcgattggccgtctcaaggggatggcggaagtgcgcggcgtcgagctggcgctgaaaatgaccaaataccctgaactgctgtaatcgcggcaatggggataataaaaaggacagccagcgctgtccttttttactgtcggggcgttaccgatgattaatccgcgcggcccatatagcggcactcttcgatatgaatgcggattttctcaccggtggtcaggtattccggcacctgaatcaccaggccggtgctcatggtggctggcttggtgcgggagctggcggacgcacctttaatacccggcgcggtttcgataatttccaggtcaacggtctgcggcagctccagcgccagcagctggccgtcccaggtcaacacctgcatgtccggcatcccaccttccggaataaactgcagctcttcttcaatctgctctttggtaaaggtgtaaggggtatagtcttctttatccatgaacacgtattcgttgccatcgacgtaggagaagtcgacgaaacggcgggtcagggtgacggtatcgacgatatcgtcgcctttgaagcgctcttctactttcaggccggtgcgcacatcggagaagcgcattttatacagtgtcgcagcaccgcgggcgctgggtgactgaatatcaatatttttcacaatcagcagcttgccgttgtaattcagcaccataccttttttaatttcattcgctcttggcattgcagtaatcctgtcacttaacgagtcaaaaatatcgcgtaaaactactcgcgcccgggcgttcaggcaagcggatttcgcgagttttgctatcttctggcaaaacgtttaggctgtggcgcaaaatgagcgtttgggagtcgggttgtggaatgtcgtactgattgtggcgcatgttgcatcgccccctctatatcatcgccgatccccggcatgccgcagggcaagccagctaacacccgttgtatccagctttccgagcgcaatttatgccttattttcggctcccctctgcgcccgaaggtgtgcgccagcctgcagccctcgccggagatgtgcctcacccaccgcgatgaagcgatcacctggctgctggagcttgagctggccaccgcgccctgagctcaacgcagcagatgagagggatggaaaccaatgtgcttacacgtctcttatccgccacaggcaggcctgagtgacaacgcccatcgccagcgcaatccagaacaccgcgtgatagctccagatctccgctactacccccgccagtgaaccggcgatgatccagccgacgcgggtagtattggtatagagggtggtggccgctcccgcctgccccggcatcaggtcctggaaatagagcatgccgatcccggcgaggatcccgatatagatggcgttcagcacctgcatcgccagcagcagcgctggcgtatgcaccgtcagcatgccgacgtaaaacagcaccccggccactgcagaaagacgcatcagaaagcgtttgccgaaacgccgggcgtagtaaccggcaatcagcatggtcggaatttccagtccggcggcggtgcccatcatcagccccgccagcttctccggcagatgcagctcgttaatgataaacagcggcatgttaatgatgtacaggctgttagtaccccacatcagggtgcagatgctgaacagcagcagcgcatcgcggcgatgcgtgcgcggagcttccagccggccggtcgctaccggctttgctttgcgcatgctgggcaagaatagccagaccatgatcccgcagacgataaacgccgccgcggcgctgagatacatcgcggtaaaaccaaaccccatcgccagggcgtaggccagcgggggaccaatcacccatgccagggagacctgggcacgtaaaatggagctgaacatcaccgcttcgcggccggtcctgtcggcatgctcccgcgcgagggcaaacatctgcgggttggcggtcgatccaaagctgctgagaaaaacgccgatgaacagcaaaatgaaatagttgcggttccaggcaaagaggacgcaggccagcacccccagcagacagcagacgacaatcagctgcttgcgatcgccctgacggtcggagcggccggcgaggaactgactgaccagaatgccaataaccgcgctgccggtaaaaaagaaaccgaccatcgccgggcggacgtgcacttcgttggtcagaaacaggctcagggtcggggtttgcagcgccccggcaatgcccgtcagaaaggcgacgattaagaaggcggaagaggtgacatcgaacccgcgtcgggggagagcggcgctacggttttccatgggtttggttttctgtagtttcaggagacggcgcggagtttacgcctgctggctaaaaataaacagtagtatggcacgaataattaaaaaggcgtttcaaaatatagggttcagcaaaaagctgacgttcgaggcggtcgatagctaatgcttcagcaaaagtgtgcagtacctctaagttctgcgatcaagtagctgacgtaccttgcgcgttgagcaagaaaggtacaaaattcttgaaacgtttcagcgtcattcggcaatccgttccccgtcagatggcgccttttttctcaagttagctgaaacgattcaattcagcaggagaggagaaccatgttccagttatctgtgcaggatattcatcccggccagcaggccggtaataaagaagaggccatccggcaggtcgccgccgcgctggtcagcgccggcaacgtggccgatggctacgtgaacggcatgctggcgcgcgagcagcagacctcgaccttcctcggcaacgggattgcgatcccgcacggcacgacggatacgcgtgaccaggtgctgaagaccggcgttcaggtgtttcagttcccgcagggcgtcacctggggcgaagggcagaccgcctatgtggcgatcgggattgccgccagctcagatgaacacctcggcctgctgcgtcagctgacccacgtgctgagcgatgacgcggtcgccgcgcagctgcagtccgccaccaccgcggaagagctgcgcgcgctgctgatgggagagaagcagagcgaagcgctgaagctggataacgagaccctcagtctcgacgtcgcggccagcgatctgctgaccctgcaggcgctgaacgcggcgcgtctgaaagaagttggcgctgtcgatgccgccttcgttagccacgtcattaacgatacgccgctgaacctcggtcagggcgtctggctgaacgacagtgcggaaggcaatttgcgcagcgccgtggcggtcagccgcgcggctaacgcctttacccgcgacgagcagccggtttccctgctggtcacggtggcgatggccgacgagcagccgaccgcagtgctgaaccgtctgagcaagctgctgctggacaagaaagctgaacatttgctgaaagccgacgccgccaccgtgctggcgctgctgaccagcgacgacgccattgccgaagatgtgctgagcgccgaattcgtggtgcgcaatgaacacggcctgcatgcccgtccgggcaccatgctggtcaacaccattaaacaattttccagcgacatcaccgtcaccaatctcgacggttccggcaagccggctaacggtcgcagcctgatgaaggttgtggcgctgggtgtgaaaaaaggtcaccgtctgcgttttaccgcgcagggtgaggatgcgcaacaagcgctggatgcgattggcgaagcgatcgccgcaggccttggggagggcgcataaatgagcagacgtgtagcaacgattacgttaaacccggcatacgacctggtgggattcaccccggagattgaacgcggcgaagtgaacctggtgcgcaccaccggcctgcacgccgccgggaaaggcattaatgtggcgaaagtgctgaaagatctcggcattgacgtcaccgtcggcggtttcctgggtaaagacaaccaggacggctttcagcagctgttcagcgagctggggatcgccaaccgtttccaggtggtgcagggccggacccgtatcaacgttaagctgacggaaaaagatggcgaagtgaccgatttcaacttctccggctttgaagtcaccccgggcgactgggaacgcttcgtcaacgactccctgagctggctcgggcagttcgatatggtctgcgtcagcggcagcctgccgtccggcgttagcccggaagccttcaccgactggatgacccgtctgcgcagtcagtgcccatgcatcattttcgacagcagccgcgaagcgttggttgccggactaaaagcggcgccgtggctggtgaaaccgaaccgtcgcgaactggaaatctgggctggccgcaagctgccggagatgaaagatgttatcgacgccgcccatgcgctgcgcgagcagggtatcgcccacgtggtgatctccctgggcgaagagggcgcgctgtgggtcaacgcctctggggagtggattgctaaaccaccttcagtggaagtagtcagtaccgttggcgccggcgattcgatggtcggcggcctgatttacggcctgctgatgcgtgaatccagcgagcataccctgcgcctggcgaccgccgtcgctgccctggccgtcagccagagcaatgtaggaattaccgaccgtacccagttggccgcgatgatggcgcgcgtcgacttacaaccctttaattgacagcaggagaggcataatgaaaacgctgctgattattgatgccggactcggacaggcgcgcgcctacatggcgaaaaccctgctgggtgccgcggcgccgaaagcgcaccttgagctgattgataacccgaatgacgccgaactggccatcgtgctgggaaccgcgctgccggccgatagcgcgctgaatggtaaaaacgtttacctgggcgatattaaccgtgctgtcgcccatccggagctgttcctgggagaagcgaaagaccacgctaagccctacgttgcgccagcggcggtagccgttccggccgccgctcaggggcagaaacgcattgtcgcggtcaccgcctgtccgaccggcgtcgcccacacctttatggcggcagaagccatcgaaaccgaagccaaaaaacgcggctggtgggtgaaggtggagacccgcggctccgttggggcgggcaatgccatcaccccggaagaggtggccgaggcggatctggtgctcgtcgctgccgatatcgaggtggacctggcgaaattcgccggcaagccgatgtaccgcaccaccaccggtctggcgctgaagaaaaccgcccaggagctggataaagcggtggcggaagccaaaccgtaccagccatccggcaaacctcaggcggctgctgaagggaaaaaagagtcggcgggcgcctatcgccacctgctgaccggcgtctcctatatgctgccgatggtagtggccgggggcctgtgtatcgcgctctcctttgccttcgggatcaaagcgtttgaagtgaaagacaccctggcggcggcgctgatgcagatcggcggcggctcggccttcgcgctgatggtgccggtactggcaggctttatcgccttctccattgccgaccgtccgggtctgaccccgggccttatcggcggtatgctggcggttagcggcggctccggctttatcggcgggatcatcgctggtttccttgccggttatgtggcgaaagccatcagcacgaagctgaaactgccgcagagtatggaagccctgaagccaatcctgatcattccgctggtctccagtctgatcgtgggtttggcaatgatctatctgatcggtaaaccggtagccggtatcctcgcctggctgacccactggctgcaaaccatgggcaccgccaacgcggttctgctgggcgcgatcctcggcgcgatgatgtgtaccgatatgggcgggccggtaaacaaagcggcctatgcctttggcgttggcctgctgagtacccagacctatgcgccgatggcggcgatcatggcggccggtatggtgccaccgctggcgatgggtatcgcgacgctggtagcgcgcaataagttcgacaaagggcagcgggaagggggcaaagccgcgctggttcttggcctgtgctttatctcggaaggggcgattccttttgccgcccgtgacccgatgcgcgttctgccgtgctgtatcgtcggcggcgcggtaaccggcgctatctccatggcggtcggcgcgaaactgatggcgccgcacggcgggctgtttgttctgctgatcccgggggcgattacgccggtgctgggctacctgctggcgattgttgccggaacgctggtggcgggccttgcctacgccgtgctgaaacgccctgaggcgcaaacagcggaagttgaaaaagcggcataatcctaccgcaataaaaaagggccgattgttcggccctttttttgtctctatttacgccacttcggcaatctgctgcgcccgcagccaggcaatctcttccgcccagatatccgggttgatggtttccagaatcagcggaataccgtcgaagcggctgtcctgcatgatccagctgaagcaatcgtggccgatgttgccttcccccaggctgtggtgacggtcgacccggctgccgaaggcgctcttggcatcgttgagatgcatgccgcgcagatactgaaaaccgacgatgcgttcgaaggcggcgaaggttttttcgcaggcttcggcgctgcgcaggtcgtagccggcggcgaaagcatggcaggtatcgatgcagacgccgacgcgggatttatcttccacaccgtcgatgatggccgcgaggtgctcgaacttaaagccgaggttgctgccctggcctgcggtgttttcgatcaccgcagtaacgccttcggtcttcgccagcgcgatattgatcgattcggcgatgcgcgccaggcactcctcctccgggatctgctgcagatggctgccggggtggaagttgagcagcgtcagtcccagctgctggcagcgggtcatttcatcaatgaaagcatcacgggatttttccagcgcttcttccaccgggtggccaaggttaatcaggtagctgtcgtgcggcaggatctgccccgggccaaagtgatacttttcacaggcggctttgaattcggcgatggtctcgtcgctgagcggcgcggcgcgccactggcgctggttcttggtgaagagggcgaaggcggttgcttcgatttcggcggcgcgaatggcggcattggccagtccacctgaggcgctcacgtgcgctcctacgtatttcataaaaaaaactccagttaaagccgctggggggtgggtaatgatagcggcttaactggagaaagatgtagtgctttatgccatcaggctgtggatagcgacgttaatgaccccgccgccgacaatcaaccagacgaacagcatcagcgccatcagcagcggtttcgccccggcttttttcagcgcgctgacgtgggtggtgaccccgagggcggccattgccatcgccagcaggacggtatccagcgtcaccagcatatccaccacggctttcggcagcagatggaaggagttaaacaccgccaccaggatgaacataatggcgaaccacggaatggtgattttgcttttctcgccgttgcctgccggggtcagctgtttaacacgcgccgccaggaacagcaggaacggagccagcatcatgacgcgcagcattttggcgataaccgccgcgttctccgcgtccgggctgaccgcatggccggcggcaacaacctgcgccacttcatgcatggtggagcccatatagatcccgtagttctccggggtaaaccagtgcgccagcagcgggtacatcgccgggtagaggaagatggcgatggtaccgaagataaccactgtagcgacggcaaccgtcactttactggcttcggctttgaccaccggctcggtggcgagcacggccgccgcgccgcagatgctgctgccggcgccgatcagccagctggtgtgtttatcgagaccaaacactttctggccaaggaagcaggcgatgaaaaaggtactggagagcgtcagaacgtcaatcaaaataccgctcacgccgacgtcggcaatctgggcgaacgtcaggcgaaagccgtagaggatgatccccaggcgcagcagatgctgcttggcgaagatcaccccgccgtcgcagggctgccagattttcgggtagaccgtgttgccgacgaccatcccgaacaggatagcgagggtcagggcgctaaagcccgcgccggcgatggccgggaaactaccggcccacagggcggcgccggtcagagcggcggtcagcgccaggcctgggacaaaatgccacagggaacgatgtttggtgggtaaagtgagtgctgtcataaccttctcctttgtctgcctaaaggttacgccgcgcgggattaaatataaaattgattatatgtttataatcaatcgtaataagtggttaatggccgcttcgccggttacaacggggcgagagcgggttaggcagaagcggggcggtctcgccggcaagacgatgattttgtgatataagcggattttccttccgtcagccgcctcgatttgtgtcaccatagtaaggaaggttattcaggttggattactaaacgggtgggttatgcatattacgctgcggcagctggaagtgttcgccgaagtccacaagagtgggtcgaccactcaggcgtcacagatgctggcgctttcgcaatccgcggtcagcgccgcgctgaccgatctggaagggcagctcggcgtgcagctgtttgaccgcgtcggtaaacgactggtggtgaatgagcatggacggctgctgtacccgcgtgcgctggcgctgctggagcgggccctggagatcgagcagctgtttcgcggcgataacggggcgatccgggtctacgccagcagcaccatcggcaactatattatgccggagattattgcccgctatcgtcatgacttcccggatctgccggtcgagctgagcgtcggcaacagcctggacgtcatcaacgccgtcgccgacctgcgggtggatttcggcctgattgaggggccgtgccatgccgccgatattattgccgagccgtggctggaggatgagctggtggtgtttgccgcgcccaactcaccgctgctggcgggggaggtgaccctgcagcaactggccgaggcgccgtggatcctgcgcgagcatggctccggcacccgggagattgtcgattacgttctgctgtcgcatctgccggcgtttcatctgggcatggagctgggtaattcagaggcgatcaagcacgcggtcaggcatggcctgggcatcagctgtctatcgcggcgggtgattgccgaacagcttgcctcgggcacgctggcggagctgaaagtgccattgccccggctgacgcgcacgctgtggcggatccatcaccggcagaagcatatttctaaagcattacaacgttttctgcactattgccaggtgtagcagcccggttttatcgcctgattacggggggaattcgctggcaattccgcaggttagtgctttactaataatttgcgggcgatcatgaagctctcttataactttgcatttgtaccggatggaaccccgatcgtctgctacaatcgcgcctcattttttggatggatagcattatcacatggtttcggaatctaaaaccacagaagcgcccacgctacgtcgtgaactgaaggcgcgccacttgaccatgatcgccatcggcggttccatcggtacgggtctttttgttgcctctggcgcaaccatttcgcaagcaggtcccggcggggcgctgctgtcttatattctgatcggtttgatggtctatttcctgatgaccagcctcggcgagctggcggcgtttatgccggtatccggttccttcgccacctacgggcagaattatgttgaagaaggcttcggcttcgcgctgggctggaactactggtacaactgggcggtgacgatcgccgttgacctcgtggcctcacagctggtgatgagctactggttccctgacactccgggctggatctggagcgccttgttcctcggcatcatgttcctgctgaactggatctcggtgcgcggctttggcgaggcggaatactggttctcgctgataaaggtagccaccgtcattatctttatcatcgtcggcgtgatgatgattgtcggcatcttcaaaggggcgcagccagccggctggagcaactgggggatcgcggatgcgccgttcgccggcggtttctcggcgatgattggcgtggcgatgattgtcggcttctcgttccagggcaccgagcttatcggcatcgctgccggtgaatctgaaaatccggagaagaacattccgcgcgcggtgcgccaggtcttctggcgtatcctgctgttttacgtcttcgcgatcctgattatcagcctgatcattccgtataccgatccgagtctgctgcgcaacgatgtgaaggatatctccgtcagcccgttcaccctggtgttccagcatgccggtttgctgtcggcggcggcaatcatgaacgccgttatcctgactgccgtgctgtcggcggggaactccgggatgtacgcctccacgcgtatgctgtacaccctggcctgcgacggtaaagcgccgcgtattttctcgaagctgtcgcgtggcggcgtgccgcgtaatgcgctgtacgcgaccaccgtgatcgcggcgctgtgcttcctgacttccatgtttggcaaccagacggtgtacctgtggctgctgaacacctccgggatgacgggctttatcgcctggctgggtattgcgatcagccactatcgtttccgtcgcggctacgtcctgcagggtaacgatattaataatctgccgtatcgttccgggttcttcccgctggggccgatcttcgccttcgtgctgtgcctgatcatcaccctcggacagaactacgaagcgttcctcaaggacaccattgactggggcggcgtggcggcgacctacattggtattccgctgttcctcgtcatctggtttggttacaagctggcgaaaggcacccgctttgttcgctacagcgaaatgaccttcccggaccgctttaagcgttaatcttcgcgattgtgcgataaaagccctctgtgaagagggctttatattgctggcaaagtgcaatcttcagggattgcccggcggcgctgcgcttgcgcgggcctacagataaccgcgtaactgattgatattgctatttttgtaggccgggtaaggcgaaagccgccacccggcagacatgtgagcacaataacgaagacagatttgtcatcacccggaagccctctgaacagagggctttttttatgtttgtgcggttacagcttgtcacaattcttcataattatattgataatcgtaatcattatctttatcattttcgcccattacggatgaagccactccccgtctctgccgcttgtacagactgacaccgggcgaccagccacatcgacgagaaaacagcgcgagcatgccgccgacagagcggcaagccgccagcgcgtgtgagcagcaccttgttgtttgtttggttgtacacctcatggagatttggaatgttcaggttaaccccttttatccgggcgggattgtctgcgtccgtcgtatcgttggcgtttccggctctggccgatgtgaatgaagaaacgctggtggtgaccgcctcggccactgaacagaatgtcaaagacgcgccggcgagcatcagcgtcatcacccaacaggatttacaacgcaagcctgttcagaacctgaaagacgtgctgcgcgatgtgcctggggtccagctcaccaacgaaggggataaccgcaagggcgttagcatccgcggtctgagcagcagctataccctgatcctggtcgacggcaagcgcgttaactcgcggaacgccgtcttccgccacaatgacttcgaccttaactggatcccggtggatgctattgagcgtatcgaagtggtgcgcggcccgatgtcctccctctacggctccgatgcgctcggtggggtggtcaacattattaccaaaaaaatcggccagaaatggaccgggacgctgagtgctgataccactattcaggagcaccgcgatcgcggggatacctataacggccagttcttcaccagcggcccgctgatcgacggcgtacttggaatgaaggcctacggcagcctggcaaaacgcgccaaggacgatccgcagtcatccagtaatgccaccggcgagacgccgcgcatcgagggcttcaccagccgcgatggcaatgttgaattcgcctggacgccgaacgaaaaccacgattttaccgcaggctacggctttgaccgtcaggatcgcgattccgattcccttgaccgcaaccgccttgagcgggagaactactctctgagccataacggccgctgggatatcggcaatagcgagctcaagttctacggcgaaaaggtggataacaaaaatccagggcagagcgggactattacctcggaaagcaatgccatcgacggcaagtatgtcctgccgctgggcatgattaaccagctggtgaccttcggcggcgaatggcgccacgacaaactgaaagatccggtcaacctgagcagcggcggccagtcaacgtcggccagccagtacgccctgtttatcgaagacgaatggcgcatcatcgagccgctggcgctgaccaccggcattcgtatggacgaccatcagacctatggcgatcactggagcccgcgcgcctatctggtgtataacgccaccgataccgtcaccgtcaaaggcggctgggcgacggcgtttaaagccccgtcgctgctgcagcttaaccccgactggaccaccaactcctgtcgcggctcgtgcagcatcgtcggtaacccggatctgaaaccggaaaccagcgaaagcttcgagctcggtctctactaccgcggggaagagggctggcttgaaaatgtcgaaggcagcatcaccaccttccagaataatgtcgacgacatgatcgacgttctgcgcacctccagcgccagcgaagcgccgggctacccgaactttgtcggctggaaaaccgtcaacggcaagcgcgtgccgatcttccgctatttcaacgtcaacaaagcccgcatcaaaggggtggagacggaggtgaagatcccgtttggcgatgagtggaagctgacggtgaactacacctacaacgatggtcgcgatctgagcaatggcggcgacaaaccgctgcagacgctgccgttccataccgccaacggcacgctcgactggaaaccgctggacgattggtccttctacgtgacggccaactataccggccagcagcgcgcggtgagcgccaccggcaaaacgccgggcggctacaccctgtttgacgttggcgcggcatggcaggtgaccaaaaacgtgaaactgcgctccggggtgcagaacgtgggtgataaagatctgagccgggacgactacagctataccgaagaaggccgtcgctactttatggcggtggattatcgcttctgattgccggcgctaaaacgcgtcctgtaggcctgaacatgcgccgcgaagcagcttcgcggcgcattggcgtttagccaaagagatgctgcgcatggaagcgcagatggtcttcaataaacgaggcaataaagtaatagctgtggtcgtaaccgggctggatgcgcagcgttaacggccaggccttctgccgcgcgacctccgccagtaccgccggctgcagctgtccggcaaggaaaggatcgttgtcgccctgatcgataagcgtcggcacggcgtcctccggccggctggcctgcatcagcgcgcagctgtcccaggagtgccatgccgattcatccgcgccgagataggcggtaaacgctttcttgccccacgggacctgggagggattgacgatcggcgcgaaggcggagacgctggcgtagcggccgggatttttgagcgccataatgagcgcgccgtggccgcccatcgagtggccgctgacggcgcagcgttcgccgacgctaaactcgctacgaataagcgcgggcagttcgtcacgcaggtaatcgtacattcggtagtgcgccgcccagggcgcctcggtggcgttcaggtagaagccggcgccttgtccgagatcgtaaccgtcgtcgttggccgcctcgtcaccgcgcgggctggtatccggcatcaccagcgcgatgcccagctcggcggcaatgcgctgggcgcccgccttggtggtaaagttctcatcgttacaggtcagccccgacagccagtacagcaccggcggcggcgtttcgcgctcaggcggtaaaaaaatgctgaacgtcatggcgcagttcaggacaggggagtgatgacgccagcgttgttgctggccgtcaaaacagcgatgctcttcaagcagttccatgcaaggctcctcggaagggatgtgcgcgtaaacgttcataatacagatatttcattagccggtgagcaactttcactttctccttttgagaacttactgcatcattaatgcaacttatagccaacatgccggtgtagcgacggcgcttatgaatgcgtacagcggttggaacattccggatacggcgataaggatttggcgttgcgcctgaggcatggcttcgctccctaataaaaggcagcgccaatttcaataattatcgttacggctactggattctgtgcgccacctcacgcacaatgaatacaaactttgcccccagaaaaagcaaagagcgccacacctgcaggagaaacataaatgtcatcactgagtaaagaagccgtcctcgttcatgaagcgctggtcgctcgtgggctggagacgccgatgcgtgcgccagtacaagaaattgataacgaaacacgcaagcgtttgattaccggtcatatgaccgagattatgcaactgctgaatctggatctgagtgatgacagtctgatggagaccccgcatcgcatcgccaaaatgtatgtcgatgagatcttctccgggctggattattctcgcttcccgaaaatcaccgtcattgaaaacaaaatgaaggtcgatgaaatggtcaccgtgcgcgatatcaccctgaccagcacctgcgaacaccatttcgttaccatcgatggtaaagcgacggtagcctatatcccgaaagattcggtgatcggcctgtcgaaaatcaaccgcattgtgcagttcttcgcccaacgtccgcaggtccaggagcgtctgacgcagcagatcctgatcgcgctgcagacgctgctcggcaccaacaacgtggcggtatccattgacgcggtgcattattgcgtgaaggcgcgcggcattcgcgacgcgaccagcgccacccccaccacctctctcggcggcctgtttaaatccagccagaatacccgccaggaattcctgcgcgcagtacgtcaccacgactaaaacggagcagggtgcatggagagaaatgtcacgctggactttgtccgcggcgtcgccatcctcggtatcctgcttctcaatatcagcgccttcggcttgccgaaggccgcttatctcaatcccgcctggtcaggaagcgcgtcccttagcgatgcctggacctgggcgctcctcgacctgctggcgcaggtgaagtttctcaccctgttcgcgctgctgtttggcgccggtcttcagctattgcttccgcgagggaagcgctggatccagtcgcggctgacgctgctggcgctgctcggtttcattcacggtctttttttctgggatggcgatattctgctggcctatgccctggtggggctggtgagctggcgcatggtgcgtgaggcgcaccatgtcaaatcgctgttcaacaccggggtggtgctctacctcaccggcattgcagtgctggtcctgttggggatgatctccgggaccgcggcgaatcgctcgtgggcgccggacgcggcgaacctgcagtatgagcagtactggaagctgcacggtggcatggaggcggtcagcaaccgggcggatatgctatctgacaatctgctggcgctgggcgcgcagtatggctggcagctggcggggatgatgctgatgggcgcggcgctgatgcgcagcggctggctgaaggggcagtttagcctgcgtcactaccggcgtaccggcgcgctgctggtggcggccggcatggcggtcaatctgccggcaatattcgcccagtggtatctggcctgggactatcgctggtgcgcgtttttactgcaggcgccgcgcgaacttagcgccccgctgcaggctatcggctatgccgcgctggcctggggctactggccacagctctgccgtttccgcctggtgggcgctatcgcctgcgtcggacgcatggcgctgaccaactacctgctgcagaccctgatctgcaccaccctgttttatcatctcgggctgtttatgcgcttcgatcgtctgcagctgctggcctttgtcccccccatctggaccattaacctccttgtctcatcgctctggctgcgccgcttccgccaggggccggtggaatggctgtggcgtcagttaaccctgcgtgcgtcaggcacatcattgaaagacacatccagataacgatctcgatcacaatcattaacaaaacggatgtaaacgtttccagccgtgtgacctcactcacgcagcggaccgcgggtcgctgccagaatagcctccttgctaagcacaggaggtgaatgtgacgtgctgtaattctcttaaggttgctgagtatgatcaccattcgtgatgtcgcccgccaggcgggcgtttccgtggccaccgtgtcgcgggtgctgaataacagcgcgctggtgagtccggatacgcgcgacgtggtgatgaaagcggtgacccaactgggctaccggcccaacgccaacgcccaggcgctggccacccaggtcagcgataccatcggcgtggtggtgatggacgtctccgacgccttcttcggcgcgctggtgaaagcagtggataccgttgctcagcagcatcagaaatatgtgctgatcggcaacagctatcacgaggcggaaaaagagcgtcacgccatcgaggtgctgatccgtcagcgctgctcggcgctgatcgtccattcgaaagcgctgagcgatgatgaactgagcgactttatgcaacatatcccggggatggtgctgatcaaccgcatcgtgccggggtatgcccatcgctgcgtcggactcgacaacgtcagcggcgcgctgatggccacccgtatgctgctcaatcatggtcaccagcgcatcggctatctctcctcaaaccacggtattgaagatgacgatatgcgccgggaagggtggagcaaagcgctgcaggagcaaggcatcatcgccccggacagctggatcggttccggctccccggatatgcagggcggtgaagcggcgatggtcgaactgctggggcgcaatctcggcctcaccgcggtgtttgcctataacgacagcatggcggccggcgcgctgacgacgctgaaggacaacggcattgtcgtgccgcagcatctgtcgctgattggctttgatgatattcctatttcccgttacaccgatcctcagctcaccaccgtgcgctatccggtaatgtcgatggcaaagctggccaccgagctggcgctgctgggggcggccggcaagctggatcgcgaggcgacgcactgctttatgccgacgctggtgcgccgtcattccgttgcccagcggcaaactgtggggccgatcactaactgacgcgatcgcgggatgtaaccgctttcaatttgtgagtaaattcacagtatattaacattcgcctgattatgatggcagcgtttaccagtctgaaccacgaggtgatggatattcctcactttatttagtaggaacaaggcgttaaacgagttttacagtcgtatttttctggagcgttacccgacacggaagaccgaattttcgtcgtgaaatgcgttgtgcggtaacactaatgcaacaaatcccgcctgcattttctcacaataatgaccctgcataataaaaccggagattccatgaataagaaggtgtttaccctgtctgctgtaatggctggtctgttatttggcgccgccgcacacgcagcagatacccgtatcggcgtgacgatttataaatatgacgacaactttatgtcggtagtgcgtaaggcgattgaaaaagatggcaaatccgcgccagacgtccagctattgatgaatgattcgcagaacgaccagtcgaaacaaaacgatcagattgacgtgctgctggcgaaaggcgtgaaggcgctggcgattaacctggttgacccggccgccgcaggtacggtgattgaaaaggcgcgcgggcagaatattccggtggtgttcttcaacaaagagccttcccgcaaagcgctggatagttatgacaaggcttattacgtcggtaccgactcgaaagagtcggggattattcagggcgatctgatcgccaagcactggaaagccaacccgaactgggatctgaataaagacggtcagatccagtacgttctgctgaaaggcgagccgggccatccggatgcggaagcgcgtaccacttacgttattaaagagctgaatgataaaggtctgaagacccagcagctgcagctggataccgcgatgtgggataccgcccaggcgaaagacaaaatggacgcctggctctccggcccgaatgccaacaagattgaagtggtgatcgctaacaacgacgccatggcgatgggcgcggttgaagcgctgaaagcgcacaacaagagcagcattccggtgttcggcgttgacgccctgccggaagccctggcgctggtgaaatccggcgcgatggccggtactgtgctgaacgatgccaacaaccaggcgaaagcgaccttcgagctggcgaaaaaccttgccgacgggaaagacgccgcggcaggcaccaactggaaaattgacaacaagattgttcgcgtcccctacgtgggcgtcgataaagacaacctgagccagtttaccggcaaataatcgtgatgtgaattgcgggcgtgggttatccacgcccgattattcctgatacagaaccagactcctgctggcgctagtgcgccggacggggcttgcatgaacgcagccaggtataactatggtcagcaataatagcgaacggtcaggcgaatatttgttggagatgagcaacatcaacaaatcgtttcctggcgtcaaggctcttgataatgtcaacctgaaggttcgtccgcactccattcatgcgttaatgggtgagaacggcgccggtaaatcgacattattaaaatgcctttttgggatctatcaaaaagattccggtagcattctttttcagggaaaagagatcgatttccattcggcgaaagaagccctggaaaacggtatttcgatggtgcatcaggaattaaacctggtattacagcgttcggtcatggataacatgtggctcgggcgctatccaactaaaggcatgtttgtcgatcaggacaaaatgtaccgggataccaaggccatttttgatgagctggatattgatatcgatccgcgcgcccgcgtcggtaccttatcggtatctcagatgcagatgattgagatcgcgaaggcgttttcctatgacgccaaaatcgtcatcatggatgagccgacgtcatcgctgacggaaaaagaggtcaaccatctgtttaagatcatccgtaagctgaaagatcgcggctgcggtatcgtctatatctcgcataaaatggaagaaattttccagttgtgcgatgaaataaccatcctgcgcgacggccagtggatcgccacccagccgctggaagggctggatatggataagatcatcgccatgatggtcgggcgttcgcttaaccagcgttttccggatcgcgaaaacactccgggcgaagtgatcctccaggtgcgcaatctcacctcgctgcgccagccctccattcgcgatgtctcctttgacctgcataagggcgaaattctcggtatcgccggcctggtgggcgctaaacgcaccgacatcgtggagaccctgttcggcatccgtgagaaggccagcggcaccatcacgctgcacggcaagaagatcaacaaccacagcgccaacgaggcgattaaccacggttttgcgctggtgaccgaggagcggcgctctaccgggatttacgcctatctggatatcgggtttaactcgctgatctccaatattaagaaatataaaaacagcgtcggcttgctggataactcgcgaatgaagagcgatacccaatgggttattgactcgatgcgcgtcaaaacccccggtcagcatacgcagattggctcgctttccggtggtaaccagcaaaaggtcattataggccgctggctgctgacccagccggagatcctgatgctggatgagccaacgcgcggtatcgacgtcggcgccaagtttgaaatctatcagctgattgccgaactggctaaaaaagacaaagggatcattattatttcttccgaaatgccggaactgctggggattaccgaccgcattctggtgatgagcaacggcctggtcgcgggcattgttgagactaaaaccaccacgcaaaacgaaatactgcgtcttgcgtcattgcacctttaagatcaggggcttcacatgagtgcgttaaataaaaagagttttctcacttacctgaaagagggtgggatatatgttgtccttctggtcctgctggccattattattttccaggatccgacatttttaagtctgctcaacctgagtaatattctgacccagtcctcggtgcgtattattattgccctcggcgtggccggacttatcgtcacgcaggggaccgacctctccgccggccgtcaggtgggtctggcggcggtgattgccgccaccatgctgcaggcggtggataatgccaataaggtattcccggatatggcgaccatgccgatcccgctggtgatcctgctggtgtgcgccatcggggcggtcatcggcctgattaacgggatcgtcattgcctacctgaacgtgacgccgtttattaccactctcggcaccatgatcatcgtctacggcattaactcgctgtactacgacttcgtgggcgcgtcgccgatctccggcttcgacagccacttctcccatttcgcgcaggggtttgtggcgctgggctccttccgcctgtcctacattaccttctacgcgctgattgccgtcttctttgtctggatcctgtggaacaagacgcgctttggcaaaaacattttcgctatcggcggtaacccggaagcggcgaaggtctccggggttaacgtagcgttaaacctgctgatgatctatgccctctccggcgtgttctacgccttcggcggcctgctggaagccggacgtatcggttcggcgaccaataacctcggctttatgtatgaactggacgccatcgccgcctgtgtggtgggcggcgtatcgttcagcggcggggtagggacggtgtttggcgtggtgaccggggtgattatcttcaccgtcatcaactacggcctgacctatatcggcgtcaacccttactggcagtacattattaagggggcgattattatcttcgccgtggcgctggactccctgaaatacgcccgtaagaaataagattgaacgcatcaaaaacccgcgcctggcgcgggtttttttatatctgaaacgaatgcgttgatggaggctacttttctttctgcagctccagcagctgctccggggtgacggccgggtaggattgggcgtcatccggcacgtcatgctgctgcgccggaatcgggatgagagggccgagaaagcgcggttcccgtttgaagatatagaggtccgccagcgcgccaaagcgggcgccgaactcgcgcagccgcacgctccacatatccttcggcgacggcaccgcgtagcactgggcctggatccccatatgcagggcgataaacagcgcccgttcgcagtggaagcgctgggtgatgataatgaagtcgttggtgtcgaacactttccgggtacggacgatcgagtcgagggtacggaaaccggcatagtccagtacgatatccgcgggatcgacgccgcctttaatcaggtcccgacgcatggtcatcggttcattgtagctttgcagagcattatcgccgctcagcaggagatagttgaccttgccgctgttgtaggcgttcagcgcaccctggatgcggtaacggtaatactgattgatgacgccggtgcggtaatatttggcggtgcccagcaccacaccgacctgacggtagggcaggtcctgcagttcatcatagatatagggcgcggttttccagctcatccagcggtcaaggcccagcacggtcaacagcagcaggccgagcaggactaacaggctgtagaacgcacgctttaacatgaacttggctcaataatagacaacggagtcttcaggctactttacccgccgggtaagcgcaagaaacccgcgtttgattgcggggattttcagcaatatagacagatcgccgaatgcaggccgggtaaggcgtgagccgacacccggcatagggatcttcaggtcgccatggcgcgaaccgtaggtcgggtaagcgtagcgccacccgacacctaacggtataaaaagtcggccggataagccgaagacgccgtccggcaatctgctcaggctgatcaacctaacaggacgcgctcaatattgtggcagcccagcgccttcagggtggcgacggtggcatcccactggatcagcgccgcgtcggctttctccgccaggattgcccgctggatagcgggataatcatagccgttgaggctcaggagattcagcgccccctgcagcggcggcagcgtcgggttgaacgctgcgttttccgcatagctaccgctgaaaatggtaccgtctttcagctccagcgccacgccggaaggcgagtggctatagggcgcatggcagcggttggcggcctgaatagctgcctgggttagggcatcgccgctgaccgggaagccatggtcctgttcatccatcagcagggttttgatctccaggtctttcgggccaaaggcgtccggcagatagtgctccagggcatgcgcttcgcgacccggcagatgaatgcgcagcgccagcccgctgttcagttcgttcataaactgacggcaatgaccgcacggcgtgtagttcaccgtgatagcgcgcagggaggtctcgccgcgcagccaggcgtggctgatggcgctctgttccgcgtgaacggtctgctgcatggtagcgccgagaaactccatattgccgccaaagtaccagcggccgctgacgccgcgggcgatagccccgacgttaaaatgagaaaggtcggggcgcgcgcaggcagcggcaagcggcagtagcgcaaaagccagcgcgtcttcgtccagacctgtcgcatgctgcagcgtcgccacctgatcggcttcgagcagcgccgggaaatgcgggtcggtgagcatcggggcgatggccgcctgcagatctgctgccagagtcgtcaaagcagcttgaaaacgtgagtgcatagcgttgcctcataacagtgtaatgggaagccagtgtacgggcggccagcggttccatatgtgatgaatatctcattctttatgcaactccgatttgttgcattaaaaaatgtgattcaaatcactattaacctaccactgcgaggatcagcggaaataagaacggcgccatcaacgaggtgatgatcccgcacagcaccagcgccagtgagctaaacgcgccttcctgatagtccagctcggcgcagcgggcggtgccgagggcgtgcgaggcggtgcccattgacaggccgcgcgacgctttggtgcgaatgcgcatcaggttaagcaacgtatgcccaaataccgcgccgaggatgccgacaaaaattacgcacacggcgctgatggccggaatgccgccgatgctgccgctaaccgccatagcaatcggcgtagtgactgacttaggcagaatagaggcggcgatttgcggcgtggcgcccatcagcagagcgacggtggtgccggtgatcatcgccacgcagctgccgataaagcagatggtaatgatagatttccagcgggcgcggatctggtgcagctgttcatacagcgggaacgcaagggccactaccgccggctgcagcagatcgttcaggactttgctgccggcaaaataacgctcataggagatcccggtcagcagaagaaatggaataatcaccaccatcgccaccagcagcgggttgagcagcgggaacttaaagcgggccgccagtttgcgggcgagaaaaaagacgatcagggttagcggtagcgaccaccagatttcatgcatcattcttcttttcctttttggccaatcactttacgttcgccatgcaccaaatgggagctccagctcaccactacaaacaccaccagcgtactgatggcgcaggagataacgacaggccccagctgggcgcgcagcagatcccagtactgcatcaccccaacgccgatcggcacgaacagcagcgccatatagcggatcaggatattgcagccggggttgacccattgcggcggcataatttgcagcgccagcagtacgaagaggatcagcatgccgatgatgctgccggggatagtgataggcagcagcccggcgataaaaattccggcgtacaggcaggcgtaaatcaggacgaaagcccgcaggtactgccagataatagtcagcgatttactcatggtaataacccttgatgaagtgcattcatcatacaattaatccctaaaatgtgctaccgatcacatcatgaattctatgcatagcgctgatagcttacgggaaccatagtctcacccgtcagggcccgacaccttgcggctcaggcgggagcgctcaccacgctatcttgctggatgaggcgcggcaaataaaggcgaatgggacgccacagacccctgtaaagcatagagattatctcgccgctttgccgcatcgagcgtgcggggtacggcgtgcgtctggtccgacgcattgagcgctttcaaccagcgcccggaggcgctaccatagcgcctctttttattccgggtaacgatatgcgtgttctactggcgccgatggaaggcgtgctcgattcgctggtgcgcgagctgctgaccgaggttaacgattacgatctctgcatcaccgaatttctgcgcgtggtggatcaactgctgccggtaaaatcgttctacaggctatgcccggaactgcatcaccagagccgcacgccgtccggaacccgcgtacgcgtccagctgctgggacaatatcccgagtggctggcggaaaatgccgcccgcgcggtggcgctgggttcatggggggtggatttaaactgcggctgtccgtcgaagctggtaaacggcagcggcggcggggcaacgctgctgaaagatccggagttgatctatcgcggcgcgaaagccatgcgagaggcggttcccgagcatctgccggtgacggtgaaagttcgtcttggctgggacagcggtgaacggcgctttgaaatcgccgacgcggtgcagcaggcgggggccagcgaactggtggttcacggccgtaccaaagaagatggctacaaagccgaacgcatcaactggcaggcgatcggcgagatccgccagcgcctgactatcccggtggtcgccaacggtgaaatctgggactggcaaagcgcccaggattgtatggctgtcaccggctgcgattcggtgatgattggccgcggggcgctcaatgtgccgaacctcagccgggtgatcaaatacaatgaaccgcgcatgccgtggccgcaggtggtccagctgttgcaaaaatatacccgcctggaaaagcagggtgataccggtctgtatcatgtggcgagaattaagcagtggttaggctatttacgcaaggaatataccgaggcgctgaccctgtttaatgaaattcgcgccctgcaaacgtctgctgaaatagcggcggcgatcggccgctattaaccgccatactgttattcgcttcacatattattacttgcatgcctattgatgataggcatgggttgaataaagtgataatgtgcggtcaatcaattcaggattgctactgaactcaggcaaaacctaagcactttcgtcattcgtggcgcaaagtgcttaggtttttttttggtaaaaattcagggtggataaaatgatgatgtaaaacaatgagatgtgataacgatttctctggcattgtcgcggttttattaccgacggacgctttttgccattcatttttaaaaaaagaaaacgggtaaataaatagcctggggatcccctttgtttttattcagtcacggtggatatcacaatgcataacaaaaaaataaatcagcttttgatcggcgctatgctggcggccatggcgcctgccgtgagcgccgcggacatcccggcgtggaacggcagcgcgctggggtttgaagccgggcagcaagggctgctgggcgatatgctaggcattcgtccgatccttgaagaaaacggctttcattataatctcggctatcttaacgagatggcctacaacgccggcggcggttatgaccatgataaacacctggcctatattgaccaggtggcgctgacctttacccaggatctggagcgctggaccggcataccggatgcgcgtctcgaaggcaacatcgtcaaccgcaaccacgatgataatctcaccacgaaacggctgcaggatccgcgggtgagtttcaacgatctatcgcaggagagctggggcggcgggtcgattacccgccttggctggctcacctttgcccgcagctttgacgaccgccgcctgacctggcgcatcggcatgatgaacaaggtgcaaaccttcgaccagatcataccctgcgattttcagctgctgacccagtgcggtgggaaatcggccaactcgctgacctggaataactggaacattcatacctggggcaccaccctggagtacaagctgacgccgacggtcaccctgaaaggcggagtgatggagcaaaacccgcaggctaccgcgcgcagccacgcgtggagctggtcgacgaagggtagcaaaggcatcttactgccgatggagatcgaaacccgtccgctgattaatggcctgccgggagcctataaccttggcgtggtctggactaacgcgccgcagagcgacctctacagcggtaaatccggcggcgccggggcgaccgatccgcaaggttacgccgagcacgacagcacctggtttatgtacgccggcctgaaccagcagatcacccgccacgccgacgacccgctgcgggggatgagcgtctcactgagcggcagcctcagcgaccagcgcagcaactatatccactccgccgtcgccgcctccatgcgctaccgcggtctgtttgacgcccgcccggaggactggattggcttcggcctgacgtggatcgacatgagcagccactacgcacgtaatcagcgctatatgaatcagataagcggcgccaccgactataacgatccggcttacctgccggtggccggtcattcgctgaacggtgagctctattatcgcttccgcccggtctcctggctggagctgcagccgggcctgcagtactggcaccgtccgggcggcgtcgcgcagacccaggacgcgtgggtagtggagtggaaaaccgtcgtgaccttctgatagtcgcgatcttaatcacgttttttcacttgtcaggttgagcgcgcagcagaagttgttacagtgcgggtgttggattgcaactgctgcggcaggcaaaacctgatcacctggcgtttcgtcgggggtcaggtttttttgtttctggggtctatatgcaaatcgccaaagtactcaataacaatgtggtggtggttctcgacgagcaccggcgcgaacaggtggtgatggggcgagggctggcctttcagaaacgcccgggcgacgtgctggacgacagtaaaattgaaaaagttttcgccttacaaagcgatgagctggtcggccgcttaggcgagctgctcagtcaaataccgttagaagtgatgaccacctgcgatcgcattatcgacctggcacgcggacggctgggcaagttacaggaaagtttgtacatcacgttaacggatcactgtcattttgctatcgagcggcagaaaaagggcatcgcactgcgtaacgtgctgctgtgggagattaagcggctgtatccgaaggagttcgcgctgggccaggaggcaagggccatcattgccaaaaggctcggcgtggagttggcggaggacgaagccggatttatcgccctgcatctggtgacggcgcagctcaacagcgaaatgccggaggtcatgcacgtgacccgggtgatgcaggagatcctgcagctggtgaagtatcagctgcagcttaactacgatgaagagtcgctgagctatcagcgtttcgtcacccacctgaagtttttcgcccagcggatgctgacgcgcacggtggtggaagatgacgacgtctcgctgcacagcgcggtgaaagataactacgccaaagcgtggaagtgtgcggaaacggtggcgacgcatctgcaaaagcagtatcagcggtcgctgaccaccgaagaaattatgtttcttgccattcatatcgaacgggtaagaaaagaggggcgttaattctccccaacaaaactggattgttactgcatgatgcaggcaaaacctgagcgcgacgcccaccggcgtggttctcgggtttttttattttttactactcagtcgccggttgtctgcgggcagcggcagtaaggaaaagagcatggaatataaagcactcgcgcaggatattctcaaccgcgtcggcggcaaagagaacattgtgagtctggttcactgtgcgacacgtctgcgttttaaactgaaggataacggcaaagccgatgccgaagggctgaaggccaatccgggcgtgattatggtggtggagagcggcggccagtttcaggtggtgattggcaaccacgttcacgacgtctggctggcggtgcgccaggaggcggggttaagcgatgacaacgaaccggttgccgaggaaaaagcggccaaaggatcggtgttaagccagcttatcgacatcatctccggcatctttacaccgtttatcggcgtgatggcggcaaccggtctgctgaaaggcctgctggcgctggcggtgacctgcggctggcttacgccggagcaggggacttataaaatctggtttgccgccagcgacgcgctgttctttttcttcccgctgtttcttggctataccgccgggaagaagtttggcggcaacccgtttatctcgatggtgattggcggggcgttaacccacccgctgatgattcaggcctttgaggccagccaggcgccgggcgcggcggtggagcactttctcggcattccggtgacctttatcaactacagctcatcagtgatcccgattattctcgcctcatgggtctcctgctggttggagcgcaagagcaatgcgctgttgccgtcatcgatgaaaaacttcttcagcccggcgatctgcctggcggtggtggtcccgctcaccttcctggtgattggcccggtcgccacctggctgagccatctgctggccaacggctaccagttcatttatgcgtttgccccatggctggcgggcgcggtactgggcgccatgtggcaggtgtgcgttattttcggcctgcactgggggctggtgccgttgatgatcaacaacatgacggtacttggtcacgactccatgctgccgattattcttccggcggtgattgcccaggtgggggcggttctggggattttgctggccacccgcgatgcgcgtcagcggatgctggccggttccgccttctctgcggggctgtttggcatcaccgagccggctatctatggtctgaccctgccgctgcgtcgtccgtttatcttcggctgtatcgccggcgccatcggcggggcgatcaccgccttcagtaatagtcatgcttactcgttcggcgtgccgaatatctttttcccggcgcagatgatcccgcccggcgggattgacgccagcgtctggggcgggcttatcggcaccggcgtggctttcgtgctcgcctgcgtgctgaccttcttcgccggcctgccgcgcgccagcgctgcaccgggcgccgtgacggtagccccggcctcggcaaacgatattctggcgccgatgagcggcagcgttatcgccctcgagcaggtgccggatagcaccttcgccagcggcctgctgggtaaaggggtcgccattatcccggcggtgggccaagtgattgccccgttcccgggcgaagtggcctccctgtttcagactaaacacgccatcggcctgcaaagcgacagcggcattgagctgctgatccacgtcggcatcgacacggtcaaactcgacggcgtgccctttaccgcgcatgtgaaagagggcgacagggtacaggccggcgatctgctgattgagtttgatcgccaggcgattctggacgccggctacgacctggcgaccccgatcattatcagcaacagcgacgactaccgggagattgacacggtggcgtccagcgccgtcgaagccggtcagccgctgttgtcagtcagccattaatcacaggagaaagagatgaaaacattcccggcggattttttgtggggcggcgcgaccgcggccaatcaggtggaaggtgcttatctggaagatggcaaaggcttatccacctccgatgtacagccgcacggcgtgttcggcgaagtggtcgagcgcgtacccggcgacagcggcataaaagatgtggcgatcgatttttaccatcgctatccggaagatattgccctgtttgccgagatgggctttaactgcctgcgagtctccatcgcctggacccgcatctaccccaacggcgacgacgccgagccgaacgaagccggcctcgcgttctacgacaagctgttcgacgagatggcgaagcacaacatcaccccgctggtgacgctgtcgcattatgaaatgccatgggcgctggtaaaaaactacggcggctggggcagccgggaggtgattggcttctttgagcgctacgcccggacggtgttcagccgctataaaaataaggtcaaactgtggctgacctttaacgaaatcaatatgtcgctacatgccccgatgaccggcgtcggcctgccggccggcagcagcaaaggcgaagtgtatcaggcgattcaccaccagctggtggccagcgcgctggcggtcaaagcctgtcatgagctggtgcctgagggcaaaatcggcaatatgctgctcggcgggctgatgtatcccctgagctgcaaaccggaggatgtgtttgagacgctgcaggagaaccgcagctggcagttcttcggcgacgtacaggcgcgcggcgcgtacccgggctatatgcagcgctatttccgtgacaacggcatcacgctcaccatcaccgacgccgatcgtgaagcgctaaaaaccaccgtcgactttatctccttcagctactacatgaccggctgcgtcaccgccgacgaggcgctgaaccagcaggctcgcggcaatattctcagcatggtgccgaacccgcacctggcgagctcggagtggggctggcagatagacccgctgggcctgcgcacgctgctgaacatgctgtgggatcgctaccagaagccgctgtttatcgtggaaaatggtctgggcgccaaagataaggtggaagccgacggcagcattaacgatgactaccgcatcagttacctgaacgaccacctggtgcaggcgcgggaagccattgacgatggcgttgagctgatgggctttaccagctggggaccgattgacctggtgagcgcctcaaaggcggagctgtcgaagcgctacggctttatctatgtcgaccgccatgatgacggtaccggcaccctggcgcgcagtaagaagaagagctttggctggtataaagaggtgattgccagccgcggcgccagcctgaaagcctaaaggatgcccgcccggccatcgccgggcgggagattagccggtttacgcgcgcgcagtaaaaaggtcatcggaggttctttctcttcatccagagcgggcagggtggaaaagaggtgcggctcgttaaaagatgccggcttatattcatcccttgaattgataaggttgtttatttttagcaaactaataatttagtcacacgctttactaaacgcgtttaattcaattaacttatgataaccaacctgattaagttatctgacctgtccaatgaaattgatattaaataaaagcgtgctggcggcattgcccctggccatcgcgctggctggctgcgcgccatctcatgaggttgctaatccgccgcagcagcaaattccagcctcccatgtttccatggatctccctgccgccgtgaaaaatggctggccgcagactgactggtggaaagattaccatgacccacagcttaataatctgattcagcgagcgttggccaacgcgccggatatgcagattgccgaacagcgcatcaggcttgccgaagcgcaggcgcgaatgtcgcaggcgaatcttggcccggagatggatttctccgccgatattgaacgccagcgcatgtcggccgaaggcctgatgggaccgtttgctaccgacaccgacggcaataccggcccgtggtacaccaacggtacctttggcctgaccgctggttgggatctggacctgtggggcaaaaaccgtgcgctggtgaaagcgcgtatcggcgagctgaaagcccaggttgctgaacaggcccagacccgtgagctgctctccggcagcgtggcgcgtctgtactggcagtggcagacggaagcggcgatcaaagcggtgctgcagcaggtgaaaaacgagcaaaataatatcgtgacggtcgacaaggccctgtatcagcgcgggatcactaactccgccgaaggggcggagaacgatattaacgtcagcaaaaccgaccagcagctggcggacgtgacgggcacgatgaaagagattgaagcgcggctgatggccctgaccaacagccagagccagtcgctaaacctcaaacccgcaagcctgccaacggtcagcgcgcagctgccagataccctcggctatgagctgctggcgcgccgcccggatctgcaggtcgcccactggtatattgaagcgtccctgagcgaagtggacgcggcgaaagcggcgttttatccggacatcaatctgatggcgttcctgcagcaggatgccctgcacttaagcgatcttttccgccattcggcgcagcagatgggcgttactgccgggctgacgctgccgatctttgacagcggccgccttaacgccaacctggatatcgccagcgcgcagaatagcctgtcgatcgcccaggacaacaaagcggtggtggatgccgttaaccaggtggcgaaaaccgccagccaggtcgaaacattaatggccaaaagccagcagcagcagcaggttgaaaaagacgctcagcgggtagtggatctggcgcaggcccgaatggcggcggggatcttacctggctccagagtcagtatggcgaagctcccggcgctgcaggagcggatcaccgcattgcgcctgcacggccagtggattgacgccagcattcaactgacctcggccctcggcggcggctaccaccagacggtgaagtaaccgccaaccacggtgcgcccgcgggcgcgccgcttaatctttcttcttactctcgcgccgcctgagccaccagtgggcggccaccaccaccaccactgcgaggatcagccagatccagtgcttcagatgggcgtccagatggtgcagccacgggccaaccacctcgccgccgagatagccaatggtggtaaacagcagggcccacaccagcgctccgacaatattcagcggcaggaaaatgcgcggcggcaggcggctggcgccgatcagcagggggccgattacccggaagccatacataaagcgggtgccgatgacaaacagccacggccggtgctggatcatacgctgcgctttacggatccgcgctttctgactggcgaaacggcgcaggatgcgtcccccgaagcggcgaccgaccagatagagcagctgatcgccaatcatcccgccgagggcgacggcgatcaccaccaggggaaatttcagtagcccctgatgcgccgcgacgccgcccagcagggtaatggtctcaccttccgccatgctgccgacgatcagcgccgcgtagccatactgggaaatcaggtgattgatatccataaaaagcttttctccttacctcatcacctcttaatcatacaccctgctgaccaaaacgcggcgacgcagaattttctgtgctgtacataaaataatctacagggtgaattatacttggatcagtgcagtacgaagccgtgacaagggggacgctatgaaccatgtctgggggctcttcgctcatcccaaccgggaaatgagcgtgattaagagcgagaatgaaaccatttctcatcactatacgcatcatgtgctgctgatggcggcggttccggtaatctgcgcctttatcggcaccacgcagctgggctggaacttcggcgatggcaccgtgattaaactgtcgatgctgaccggactggcgctggcggtgctgttttacgccgtgatgctcgccggggtggcgatcatggggcgggtcatctggtggatggcgaggcagtatccgcagcagccttccctgaaacgctgcatggtgtttgccggctacgtcgccaccccgctgtttctgagcgggattgtggcgctctatccgctggtctggctgtgcgcgctggtcggtactattgcgctgttctataccgggtatctgctgtatctcggcattccgaccttcctgagcattaatcgggaagaggggttaagctttgccagctcgacgctagctattggggtactggtgctggaagtgctgctggccatcaccgtggtgctctgggggtatggctaccgactcttctgatcgggcggcacgggtaaatatgcattgccggcaaatatgtattttatgtcggcaatgcagcatttcttcacgattcttattaggcacagggccttacggcgcggtatgatggcgtttgccagcgaagttgcccacttaacctcgcggcgtacgttccataacgtgcaaaaatacttttcagaatgcccatgatgccgaaatttcgagtctctttgctcagcctgaccttgctgctggctgtgccttttgcgccccaggcgttagcaaaaaccccgacggcggtgaccgcctcgcagccggaaattgcctccggcagcgccatgatcgtcgatctggccacgaaaaaaatcatttatgccagccagcctgatctggtgcgcccgatggcgtcgatcaccaaagtgatgaccgccatggtggtgctcgatgcccatctgccgctggatgagatgctgacggtggatatcagccatacgccggaaatgaaggggatctactcccgcgtgcgcctcaacagccagattagtcgccgcgatatgctgctgctggcgctgatgtcttccgagaaccgcgcggccgccagcctggcgcatcactatccgggcggctacgacgcttttattcgcgcgatgaacgccaaagcccaggcgctgggcatgacccatacccgctacgtggagcccaccggcctgtcggtgcataacgtctccaccgcccgcgatctgaccaaactgctgatcgccagcgagcagtatccgctgatcggccagctgagcaccaccaaagaagagaccgccaccttcgcccatccggcctacagcctgccgttccgcaacaccaaccatctggtgtatcgcgataactggaacattcagctgaccaaaaccggcttcaccaacgctgccggccactgcctgattatgcgcacggtgattaaccaacgtccggtggcgctggtggtgatggatgccttcggcaaatatacccacttcgctgacgccagccgcttgcggacctggattgaaaccgggaaggtgatgccggtacccgcctcggcgctgagctataaaaagcagcgcgaagcgcagatggcggaggcgatgctgaaaggcggcgcgcagaccgcgcagaacgattaatctgcatgtctcccggatggcggcgcattgcgccttatccgggctacgtgatttggcgccgggttcgcccctttcgcaggcccggcaagcgcagaggccgagtgccggtgtttgtgcaggatggcggctgacgcttctacggaaccgcgctgaacggtagcccggctaaggcgtttacgccgcgagccggggatttggcgccggatatcactccggcagcgtccagtcgccgtcacccagcgcgcgctgcataatcaacgtatcccgccagtcgcccatcttgtagccgacgctgcgcagctgacccgccacggtaaagccgaactttttatggatcgccagcgagccggcattgttatggccatcgccgatgatcgccagcatctgccgccacgggcctttctcgcactcagcgattagcctggacagcagcgcgctgccgatgccgcgtccgcccattccggattccacgtatatcgattcctcgagggtgtagcgataggccggacgcgggcgatagaaggtggcatagcagtagccgacgatagccccgcgccacagcgctaccagccacggcagcccgttgtcgcgcacggtctggatccgtttacgcatttcgtcaacggtgggggggatctcttcgaaggaggcgcggccattaagcacgtgccagacatacagcgcggcgatggcgtgcgcatcgtcgggcagcgcttcgcgaatttctaaatcactgtcgagtaacggggcctctgcgggcatggcggcgctcctgaatctgccggagaaacattctccggcgtgcagcgtaatacagaagcgccaggctgaatagtcctgccgtcgattattgcggatccgccggagaggctggcgtcggggccgcttcaccccagtatttctgcttgctggttttaccaatccccgggttcatgctgttggtgggatcgttctggcgatagaactgctgcaggctctccggggcctcatacagatgacccacgttatgctccgccgggtactgggcgccgcgcgctttcagtaactccagcattttttccttcagcgcgtgggcgtcgacccctttcctgacgatgtaatcctgatggaacacatggcacataaagtggccatagtagagcttatgcaccagctggctgtcgatttcgggcggcagatgttcgaaccactcggtatcgttacggcgcagggcgatatccagcgccagaatatcttcgacttcgtcggcatgcaccgcctgatagcggattgccgcgccggcggcggcaaagcgatggaggaacgccttgctgccttcctccggcgtacaggcgaagaaatccccctcggcctgctggaagtactccgtcaaccaacgctgcgcttcttcgatgccgtcgccagccatcttcagcagcagatgatgttcatatttatcacgccaggttttcatccgctccggtaaatgcgccgggaagacgtggccgagcttctgcataaagcggtcggtaaagtgcggcttaaacagcgagactttctccagcatcgcgtcggtgcgccccttcatggtgaagaagaacggcattttgtcggtgccgagcttgtcgatcatcaggaaggtgtctttgccatacttctcggcgatatcgtaaatatcgcggtgcatatattcccccgccaccggcagatgctggaactcggcgaggatatggcggcggatctcggtcaatacctgcggctggttggtgccaatgtaaaacacctgctggcgcttttccgccgggaaagtatcgagacgcacggcgaaaaccgccagcttgccggcgcagccggaggattcgaacaggcggtccgggtcggcgttatagcgcgccggggtgtcggcatcgacatcgcgcacgcgggtgacatagtcgtgatcgtgggcgtggcggccgtcgtgcaggacatcgctatcgctaatccgttcgtcatcgaggcggctgaggatctgctccggcgtgctgccgagatcgatgcccagatgattgaccagcttcagcttgccgtcggcgtcaatctgcgcgaacagcgacatctcagtgtaggccggcccgcgctgcaccagcgagccgccggagttgttgcagatcccgccgatgaccgacgcgccgatgcatgacgaaccgatcaccgagtgcggttcgcgtcccagcggtttgagcgctttttccagcgaatagagggtggtgccgggccaggccagcacctgctcgcctttgtccagcagatgcagtttgtccaggcgcagggtgctgataatcacgatctcgcgatcgtaatcattgccgttgggggtcgaaccttcggtcaggccggtgttggccgcctgcatcagaataattttatcggcgtctacgcaggcgttgagcacgcgccagagctccagcagggtaccgggaaagacaaccgccagggcctcgccctgaccggagcggaagcctttgcggtagcgctgggtttttgccgggtcggtcagcagatgcgaagggccaaccaggcgcgccaggtcagccagaaacgttttatgggtgtcagtgggtgcagatgacatgttccactccttgtggtggtgcgcgaaatatcgaggataagcatagcgctttgtatgacaatttgatgcatgaatgtttcgcaaaaatcagagaagaaccttagcattctgcgggcgcgttgtttatatatatggcaaactgcggtttttattatgttttaccgagtccccgtctgagataaagcgagataacaatgaaatggctctgcactgtaggcgtcgccgtgagtctggcgctgcaacccgcgctggcggatgaactgtttggtaaccaccccctgaccccgcaggcgcgggatgcctttgtcaccgacctgctgaaaaaaatgacggtggacgagaaaatcggccagctgcgtctgataagcgttggcccggataacccgaaagaggcgatccgtgaaatgatcaagaacggtcaggtgggggcgatttttaacaccgttacccgcccggatatccgtgtgatgcaggatcaggtgatgcagcttagccgcctgaagatcccgctgttctttgcctacgatgtgctgcacggtcagcgcaccgtgtttccgataagcctcggcctggcctcgtcgtttaaccttgatgcggtgaagaccgtgggccgcgtgtcagcttatgaagccgccgatgacggcttgaacatgacctgggcgccgatggtcgacgtctcccgcgacccgcgctggggacgcgcttccgaagggttcggggaagacacctatctgaccacgatgatgggccaggcgatggtggagtcgatgcagggcaagagcccggcggaccgctattcggtgatgaccagcgtcaagcatttcgccgcctacggcgcggtggagggcgggaaagagtacaatacggtcgacatgagcccgcagcgcctgttcaacgactatatgccgccgtataaagccgggcttgatgccggcagcggcgcggtgatggtagccctgaactcgctgaacggcaccccggcgacctctgattcctggctgctgaaagacgtcctgcgcgaccagtggggctttaaaggcatcaccgtttccgaccacggcgccatcaaagagttgattaagcacggcgtggcctccgacccggaagacgcggtgcgcgtagcgctgaagtccggcatcaacatgagcatgagcgacgagtattacagcaagtacctgccggggctggtgaagtccggcaaggtgaccatggccgagctggatgatgccacccgacacgtgctcaacgtgaaatatgatatgggactgttcaacgatccctacagccacctgggaccgaaagattctgacccgcaggacaccaatgcggaaagtcgtctgcatcgtaaagaggcgcgcgaagtggctcgcgagagcctggtgctgctgaagaaccgtcttgatacgctgccgctgaaaaaatccggcactatcgcggtggtgggcgcgctggcggacagcaagcgcgacatgatgggcagctggtccgcggccggggtggccgaccagtcggtgaccgtcctgaccggcatcaaagaagcgctgggcgataacggcaaagtgatttacgccaaaggggcgaacgttaccgatgacaaaggcattgtcgatttcctcaatttgtatgagaacgcggtgcaggttgacccacgctcgccgcaggaaatgatcgacgaagcggtcgcggcggcgaagcaatccgatgtggtggtcgccgtggtgggcgaggcgcagggcatggcgcatgaggcctccagccggaccgatatcaccctgccgcagagccagcgcaatctgattgccgctcttaaagccaccggcaaaccgctggtgctggtgctgatgaacgggcgtccgctggcgctggtgaaagaggatcagcaagccgatgcgctgctggagacctggtttgctggcaccgaaggcggccacgccatcgccgacgtgctgtttggcgactacaacccgtcgggcaagctgccgatgtctttcccgcgctcggtggggcagatcccaacctactacagccacctgaataccggccggccgtataatccggagaagccgaacaagtacacctcgcgttacttcgatgaagccaatggcccgctgtatccgtttggttacggtctgagctacaccacctttagcgtctccgatgtcaacatgtcgtcggccaccatgccgcgcgatggcagcgtgaccgccagcgtgcaggtgaccaacaccggcaatcgcgaaggggcgacggtgatccagctctacctgcaggacgtcaccgcctccatgagccggccggtgaaaatgctgcgcggctttaaaaaggtcaccctcaaaccgggcgaaacgcaaaccgttagcttcccaatcgacgtcgacgcgctgaagttctggaatcagcaaatgaaatacgttgctgagccgggcaaattcaatgtctttatcggcgtggactcagcccgcgtgaagcagagcgagtttgagctgctgtaaggcatcgctcttaagtccaacgtcacgctttaaaggccgattaatcggccttttctttttcgcatcgctggcaaatgggctacgcttttctcttaagcttctgtaagcgaagcgcaaaagaactgagggaagcgggatgaagatggcaacgacatggtccggcgcgctggcgctggccgccctgataagtttaccgctgcaggcggcggagccggtgaaggtcggctcgaaaattgataccgaaggcgcgctgctgggcaatatgatccagcaggtgctggaaagccacggcgtaaaaacgattaataaaatccagctcggcaccacgccggtggtgcgcggggcgattgtcgccggcgagctggatatctacccggaatataccggcaatggcgccttcttcttcaaagatgaaaacgacccggcgtggaagaatgcccaacagggctatgagaaggtgaagcgcctcgatcaggagaaacatcagctggtatggctcaccccggcgccggccaacaacacctggactatcgccgtgcgccaggacctggcggagaaaaataagctgacctcgctggccgacctcagtcgctacctgaagcagggcggcgaatttaagctggcggcttcggcggaatttattgagcgcccggacgcgctgccggcgtttgaaaaagcgtatggcttcaacctcaaccagaaccagctgctgtcgctggccgggggcgatacggcggtgaccatcaaagcggcggcgcaacagacctccggcgttaacgcggcgatggcctacggcaccgatggcccggtggcggccctggggttacagacgctgagcgacccgcagggcgtgcagccgatatatgccccgacgccggtggtgcgcgaggcggtgctcaaggcctacccgcagatcgccgactggctgcagccggtcttcgccagcctcgatgaaaaaacgctgcagcagctgaacgctcgcattgcggtggagggccaggatgcgaagcgcgtggcggcagattatctgcagcagaaaggcctgctgaagtaagccaccggtgaccattcgctgtactcaccgcgtcggcctgctgctgacaggtctgctgctggttacgctggcgctgccgtttattacttacgcgccgaatcgcttactctccggggaagggcgcgggctgtggcaggtaatgccctggctcgccggcgttcagctggcggcggcccttgccgggatgctgctttgctggctgccaggcagggccgcgccgcttcttcacctgctgctggccgaactgctcttcccgctgcttatctggggcagcggccaggcggcgcttgagctctcccgccacggctcgccgctggcgcgcacctcgcccggcagcggcctgtggttgtcgctggcgctttgtctgctgctggccagcgaggccatccgtcatcttaccgtccggccgctctggcgctggctgctcaatgcgcaagtctggctgttgcccatcatcctgctcgctatcggggcgctcgatcagctctcattgctgaaggagtatgccaaccgtcaggaggtatttgatgacgccctgcgccagcatctgcttctgctgttcggcaccctgctgccgggcctgctgattggcctgccgctgggggtatggctgtggcggcgtccgcgctggcaggcgccggctttcaccgcgctcaatgtgatccagactattccgtcggtagcgctttttggcctgctgattgcgccgcttgccggtctggcgcgttatttcccgacgctgggcgagctgggcgtctccgggaccggcgtggcgccagccctgatcgctctcactctctatgcgctgctgccgctggtgcgcggggtggtgaccggcctgcagcaggtgccgcaggatgccctggaaagcgcgacggcaatgggcatgagcgccgggcagcgctttcgtcaggtgcagcttccgctggcgatgccggtactgctgcgcagcctgcgggtggtcagcgtgcaaaccgtcggcatggcggtagtggccgcgctgatcggcgccggcggctttggcgcgctggtttttcaggggctgctgagcagtgcgctggatctggtgctgctgggcgtggtgccgaccattgccctggcggtggtggtggatgccctgttcgccctgtggggcgcctggctaaaaggagaggccaatgattgaatttcaaggggtcagcaaagtgtttgccggccacccggcggtgaaggacctgaccctggagctgcgcgaaggcgctttctcggtgctggtggggacttccggctcgggcaagtcgacgacgctgaagatgatcaaccgtctgctggagccggaccggggcactattcgctttgccggcgaggacatccgcctgcagccggtcctgaccctgcggcggcggatgggttatgccatccagtccatcggcctgtttccccactggacggtggcgcagaatatcgccaccgtgccgcagctgcaaagatggccgcgggcaaggatcgccgaccggatcgacgagctgatggcgctgctggggctggaggcgacgctgcgcgaccgttacccgcatcagctctccggcggtcagcagcagcgggtgggggtggcgcgggcgctggcggcagatccggaggtgctgttgatggatgagcccttcggcgccctcgacccggtgacccgcgaggcgctgcagcaggagatgctgcgcatccaccgtctgctgggacggacaattgtgctggtgacccatgatattgacgaagcgctgcgtctggcggaccacctggtgctgatggacgggggcgaggtggtccagcagggggcgccgctggagatgctcctgcgaccgaaaaatagctttgtacagaccttttttggccgcagcgagctgggtgtgcgcctgctgtcgctgcgcgaggtgggggactatttgcgtcccgacgaacggctggcgggcgaggggctgaccgtcaccatgaccctgcgggaagcgctgtcgcagtttgtcgcccggcgctgcgagacgctgccggtggtcgatgccgaaggcaggccctgcggtacgctgcattttgccgatctgctgcgccaggagatgagccatgaaggcgcttcgtgagccgctgtggtggcttatcgcgctgtttatcggcttgctggcagggctgccctacagcgcgccgctgttcagtcggctgttcccggaactgccgcggccggtctaccagcaggagagcttctgggcgctcactctcgatcacggctggctggtggtggcgtccagcctcgcggcaacggcaatcgggctgggggcaggggtggcggtcacccggcccgccggcagcgcgtttcgtccgctggtggagaccatcgccgctatcggtcagacctttccgccggtggcggtgctggcgatggcggtgccggtgctgggctttggctggctgcccgcgctcatcgccctcgcgctgtatggcatactgccggtgctgcaggggacgctggccgggctgggttcgataccgcctggggtgtcaggtgtggctgaagggatgggaatgaccggctggcagcgtctgtataaggtggagcttccgctggcggccccggtgatcctggcggggatccgcacctcggtcatcgtcaatattggtaccgcgaccattgcctcgacggtgggggccagtacgctcgggacgccgatcatcatcggcctgagcggctttaataccgcctatattgttcagggggcgctgctggtggccctggcggcgattatcgtcgaccgcgcgtttgagcgtctgacccgctggatcagccgacaccgccacgcacaataaaggaatagccggccagcattacgccgctgatcccgccgatggccataagtaagaagagggtgacgaccgcgattttcgctggcttcataataggctcctgatgttaacaaggggattatacggtgaagcgcaggtgttaatgaaacattaattgcggtttagcgccgcgccggggtttttgccgcgtttgctgcgcaacgcgccgcaaaaaagtgtgatcctggccgtcgtttttcatttttatgcagggcttcaaagaaagttttcgccaggcagggtatggtacgcgctttcaggcatgtgtggtttgcgggtatgtacgagtttgatctggtgttgctgctgcttcagcagatgtgcgtatttttggtcatcgcgtggttgatgagcaaaacccgactgtttatccccctgatgcaagtcaccgttcgcctgccgcacaagctgctgtgctacgtcactttctccattttctgcattatggggacctatttcggtctgcatatcgaagactccatcgccaacacccgcgccatcggcgccgtgatgggcggcctgctcggcgggccggtggtcggcgggctggtagggctcaccggcggcctgcaccgctactcgctggggggaatgaccgccttaagctgcatggtttccaccatcgttgaggggctgctgggcggtctggtgcacagcgtgctggtcaaacgcggccggccggacaaagtctttagcccgctgaccgccggggcgatcaccttcgtggccgagctggtgcagatgatgatcattctgctgattgcccgcccgttccaggacgccctgcatctggtgcagagcattgccgcgccgatgatggtcaccaataccgtcggagcggcgctgtttatgcgcattctgctggataaacgggcgatgttcgagaagtacacctccgccttttccgccacggcgctgaaggtggcggcgtccaccgaggggatcctgcgtcaggggttcaacgaagagaacagcatgaaggtggcccaggtgctgatccaggagctggacatcggcgcggtggcgatcaccgatcgcgacaagctgctggcgtttaccggcatcggcgacgaccaccatctgccgggcaagcctatttcctcctcgtatacgcaacgggcgattgagaccggggaggtggtctacgccgacggcaacgaggtgccttatcgctgctcgattcatccgcactgtaagctggggtcgacgctggtgatccccctgcgcggcgagaaccaacgggtgataggcaccattaaactgtatgaggcgaaaaatcgcctgttcagttcgatcaaccgcaccctcggggaggggattgcccagctgctgtcggcgcagatcctcgccggacagtacgagcggcagaaggcgctgctgacgcaatccgaaatcaagctcctgcacgcccaggtcaacccgcacttcctgtttaacgcgcttaacacgctgaaggcggtgatccgccgcgacagcgatcaggcaggccagctggtgcagtatctgtcgaccttctttcgcaagaacctgaaacggccgacggaaattgtcactcttgccgatgagatcgagcatgttaacgcctatctgcagattgagaaggctcgctttcaggctaacctgcagatccagatggcggtgccggaagggctggcgcatcaccagctgccggcttttaccctgcagccgatcgtggagaacgccattaagcatggtacatcgcagcatctaggcgtcggcgaaattaccattcgcgccagccaggacgatcgctggctgcagctggatatcgaagataacgccgggctgtaccgggccaacccccaggccagcgggctggggatgaatctggtggacaggcggctgcgggcgcgttttggcgccgactgcggcatcagcgtcacctgcgagccggagcgctttacccgtgtcaccctacgtctgcccctggaggagaatgcatgctgagagtattgatcgtcgatgatgagccgctggcgcgggaaaacctgcgcattttgctggagacacagcgcgatatcgagatcgtcggcgagtgcggcaacgcggtggaggccattggcgcggtgcataagctgcgtcccgacgtgctgtttctcgacatccagatgccgcgcatcagcggtctggagatggtcgggatgctcgacccggagcaccgcccctatatcgtgtttctcaccgcctttgatgaatacgcggtgaaagcctttgaggagcatgcctttgactatctgctgaagccgattgaagctgcccggctggagaaaaccctcgcccgcctgcgccaggagcgtaatctgcaggatgtgtcgctgctggatgatgctcagcagacgctgaaatacattccctgtaccggccacagtcgtatctggctgctgcagatggaggatgtggccttcgtcagcagccggatgagcggcatctacgtgaccgaccgcgagggaaaagagggctttaccgaactcaccctgcgcaccctcgagagccgcacgccgttgctgcgctgccatcgccagtatctggtgaatatggcgcacctgaaggagattcgcctggaggagaatggccaggcggagctgctgatgcgcgccgggcaaacggtgccggtgagccgacgctatttaaaaagcctgaaagaggcgattggcctgtaaagctggtacactgcgccccattgcatcatcgacagtaaaaggccctcatgctcagtaatgatattcttcgtagcctgcgctacaccctgaaagtcaataataacgatatggtgcgcattctcgcgctctccgctatggaatccaccgccgccagcttcgacacctggacgacgaaagaggatgaagagggctttgttcgctgcccggacattatcctgtcgggtttccttaacggccttatctatgacaagcgcggcaaagatgattcggccccggagctggcgctggagcgtcgggtgaataacaacacggtgctgaaaaagctgcggatcgccttctcgctgaaaacggacgatatccaggcgattatgagcgagcagaaataccgggtgtcggtgccggagatcaccgccatgatgcgctcgcctgaccacaaaaactaccgcgagtgcggcgaccagtttctgcgcaatttcctgcgcggactgacccagcgggtgcataacccgaaggcatgattttttgccgggtggcggcttcgcctgacccggcctacaacgactgcccccgggcgcgtgctagcatagcgccgccgggcaaaaaaaagccggagatactctccggcttttttgctatttcacctgctgacccggcttggcgccgtcgtcagggcttaacaggaagatatccttcccgccagggccggcggccatcaccatgccctcggagatgccgaagcgcattttgcgcggcgccaggttggcgaccatcaccgtcaggcggccaatcagcggctgcggatccgggtaagcggagcggatgccggagaagacattgcgtttttcgccgccgagatccagcgtcaggcgcagcagcttgtcggagccctcgacgaattccgcgttttcaatcagcgccacgcgcagatcgactttggcgaaatcgtcaaaggtgatggtctcctgaatcggatcgtccgccagcggaccggtgaccggcgccgcggtggctttcacctcttctttagaggcttccaccagggcttccacctgtttcatctcgatgcggttgtacagcgccttgaacggattcaccttatgcgccagcagcggctgctgaatggcatcccagctcagttcgctgttgaggaatgcctccgcacgcgcggccaactgcggcaggaccggcttcagccaggtcatcagcacgcggaacatattcaggcccatagtgcagatggcctgcaggtcggcgtcgcggccttcctgtttcgccaccacccacggcgcctgctcatcgacatagcggttggccacgtcggcgagggccatgatttcgcggatggccttaccgaactcgcggctgtcccacgcttcgccgatgctttccgccgcgtcggtgaaggttttgtacagcgccgggtcggccagctcagcggccagcacgccgtcgaaacgcttgctgataaagccggcgttgcgtgaggcgaggttaaccaccttgttgacgatgtcggcgttcacgcgctgcacgaaatcttccaggttcaggtcgatgtcatcgatgcgtgaagagagcttggcggtgtagtagtagcgcaggctgtcggcatcgaaatgatttaaccaggtgctggccttgataaaggtgccgcgcgacttggacatcttggcgccgttaaccgtcacgtagccgtgcacgaacaggttagtcggcttacggaagttgctgccttccagcatcgccggccagaacaggctgtggaagtagacaatgtctttgccgataaagtgatacagctcggccgtggaatctttcttccagtattcgtcgaagctggtggtgtcgccgcgcttgtcgcacaggttcttgaaggagcccatgtagccgatcggcgcgtccagccagacgtagaaatatttgcccggcgcgttgggaatttcgaagccgaagtacggcgcatcgcgggagatgtcccactgctgcaggccggattcgaaccactcctgcatcttgttcgcgacctgctcctgcagggcgccgctgcgggtccacgcctgcagcatttcgctgaacgacggcaggtcgaagaaaaagtgctcggagtcacgcatcaccggcgtggcgccggagaccaccgatttcgggtcgataagctcggtagggctgtaggtcgcgccgcacacttcgcagttatcgccatactggtccggagatttgcacttcggacaggtgcctttcacaaaacggtccggcaggaacatgcctttttccggatcgtagagctgagagatggtgcggtttttaataaaaccgttctctttcaggcgggtgtagataagctccgacagctcgcggttctcgtcgctgtgcgtcgagtgatagttatcatagctgatgtcgaagccggcgaaatcggtctgatgctcctgactcatttcgccaatcatctgctccggtgtgataccgagctgctgcgctttgagcatgatcggcgtgccgtgggcgtcgtcggcgcagatgaagttgacctcgtggccgcgcattcgctggtaacggacccagacatcagcctggatgtgctccagcatgtggccgaggtggatggagccgttggcgtacggcagggcgcacgttaccagaattttcttcgcgacttgagtcatagtgagcattacatcttctgttgtaaaaagggcttccgatattaccaaaagggctgtgggtgcgccataaatggctgcccatatatggataatcgttacctgtgataaactctgtgattactgaaagcatctcaaaacaacaaaggagtcgggatgaattcgcaatcccaggccaaatcccctgagcgcctacgtgcgatggtcgccgggacgctggccaatttccagcacccaaccctgaagcataatctcaccgcccttaaggcgctgcaccatgtcgcctggctggacgataccgtccatattgaactgcaaatgccgttcgtctggagcagcgctttcgaagcgctgaaagagcagtgcagtgccgaactgctgcgcatcaccggcgcgaaggccatcgactggaagctgacccacagcatcgcgaccctcaagcgggtgaaaaaccagcccggggtcaacggcgtgaaaaacattatcgccatcagctccggcaaaggcggcgtcggtaaatcttctactgccgtaaacctggcgctggccctggcggcggaaggggcgaaggtgggcattctggatgccgatatctatggtccgtcgattccgaccatgctgggtgcggaagacagccgcccgacctcgccggacggcactcatatggcgccgatcatgaaatatggtctggcaaccaactccatcggctacctggtgaccgacgacaacgccatggtctggcgtgggccgatggccagcaaggcgctgatgcagatgctgcaggagacgctgtggccggatcttgattacctggtgctggatatgccgccgggcaccggcgacatccagctgaccctggcgcagaacattccggtgaccggcgcggtggtggtcaccacgccgcaggacatcgcgctgatcgacgccaaaaaaggcatcgtgatgttcgagaaagtggaagtgccggtgctggggatcgtggaaaacatgagcatgcatatctgcagcaactgcgggcaccacgagcctatcttcggcaccggcggtgcgcaaaaactggccgagaaataccacacccagctgctgggccagctgccgctgcatattacgctgcgggaagatctggataacggcacgccgacggtggtggcgcgtccggacagcgaatttaccgacatctaccgccagctggcgggccgggtggcggcccagatgtactggcagggagaagtgatcccgggtgagattgccttccgcgccgtttaaggccgcggcgagcgcatcagccagtatctgcccttgggcgacgcgccctgtgcttcgatggtccagccatgacgctggtagaagcgcagggcgtttttattttccatcaggcacttcagcgttccgctggcggtaaaggtccgttcgacctgcgccagcagcgcgctgccgatatgtttgccctgccagtcggggtcgacaaacagatggtgaaggaaattatcggcggtccatacggcggcaaagcccaccggctggccgtcgcattccgcgacccacagctgttcatccgcggtggcggcatcgaaatcctccagccgccacgccgcggcgggaagccaggtccacgataaactgcgcgcccgcaggaagatctggcgcagcgccggagagtccgctggctcgctggggcggacgtggagattgcgcggatcagcggtgatagaagatctcgccatcgtacactttgaggattttgccttcggtatcggtgatcagcacgtagttaccgcccatataggtccagtggctgccggcgtccggcgcaggcaggttacgctgctgccactgtttgatgttgtattccggggtgagatacatcgccggaacggtgtcgccgatgtgaaactgggtgaaatcggcggtgaactctttcagcgcatactgatcgatccccgcggcagtagccgtccagctggcgccagcggtggcaagaagtacgcccagaagcatcatttttgttttacgcatagtttcctcaatattacctggactcaaaatagcagcctcgtatcattcctgatgcgttgctgaaatggcaagcactggatttttaaaaagtgtaagcaaaacgcggcgcaagtcttgtgccgcttgcgttgcagcgacggtgatgcgtattttgggagcaatctgaagcaggggagaatcggcatgttcaggctggaagatctgaccttatttgtccgcgccgcggcgctgggcagttttagcgacgcggcgcgcgaggccgggcagcagccggcgcaggtcagcgcggcaattaagcgtctggagacgatcctcaatattcgcctgtttgcccgttcgacccgcagcctgcgcctgacgccggagggggagacctggctgccctacgccacccagatgctcgataccctcgaggccggtctgcagaagatccagaccccggatgatgaagttcgcggcatgttgcagattgccgtgccgtcggacctcgggcgtaacctgctcctgaccctgttccgcgatttccgccaacgccacccggcgctgcgcctgcggctgctcttttccgatcagctgaccgacgtgtttaaagatccggtggacgttgcgtttcgctatggcaataacgacgatgcctcgtttatctcgctgccggtggcgccggaaaatcgtcgggtgctggtggcctcgcctgagtggatcgcccgccatggcgaaccgcagaccctcgaggaactcagccagcacaatgcgttgatctacattttgcgcggccgtccgttcgaccgctggtcgctgagcctcgacggcgtggttcagcagcagaaggtttccggcacggtgatgagcgacgacgccgaggtgatccgtcggctggcgatcgccggggagggcattgcctataaatcgatgctcgacgtcagcgacgatctgcgggcggggcgcctgcggcgcctgctgccgcgttatcagggggatgtagtgccgttgaatctgatttgtccgcaccgcaaacagctctctgccgcggtgcgtttgttatatgaagaggtgaaatcacattgtgaagggcttaatgcctgactaaggtcgcgaagtaatacaccagcgggacggccaatacccacaggccaatcgggatctcccgccacttaccggcgatagccttgatcacaatgtaaaacagcagcccgccggcaatcccggtgccaaagctgttggcgataagggtgatcatcaccatcatcagcaccggcagcccgtcggtgaagttggcaagatccactttgcgcaggccgctgaacatgttcaggccaatcaggatcagcgccggggcggtggcttctttcgggatcatcaacgccaccggcgtgaacagcagcatcagcaggaacattaccgccgccgacagcgcggtgaggccggttttgccgcccgcttccgctgccgccgaagattcaatcagcgccgtcgccgccggaatgcccacccacgggccgagcgcggcggcaatcgaatcgaccatgaacgggcgattaatctgcggcatgttgccttcttcatccagcagacccgcctcgccgcccaccgccagcgttgtccccatagtggagaaaaactcagatgcgaaaaagacgaacaggaacggcaggaaggcgatgtttaacgcccccagcaggtcaacctgtcccagcaccggcgccagcgagtggggggcatcgataaaatgcgtcggcagtttagtcacgccgaacgggatacccaccagggtagcgcacagaatggcccacaaaatggcgcccggaaccttacgcgcctgcagggctatcgccaggaacaggccgcacagcgccaccagcgcgccgggggcgagaaagtcgccgagcatcagcgcgttggttttcgcattggccagcaccagcccggcattgcgaaaaccgagcacggcgacaaacaggccgatggaggccgtcaatcccagcttgatcgactgcggcaccgagcgggtgaccacttcgcgcaggccaaagcgggtcagcaggaagaagaggatccccgaccagcaggcaattccgaggccagtctgccagccaatcccttcgctaccggccagcgtcacacccaccagcaccgagccgccaatgcccgggccgacgataaacggcaggttggcataaaacgccatcagcagcgaaccgacgacgaagaccagaatggtgccggtggtggcggcgcctttatccatcccgccgatcgccagcagccccgggataaccaccagtaaataggcggcggcgagaaagccggtgatcccggccaggcattcggtgcgtagcgtgccgccgcgcgagcgcagcgcaaagcggcgctccagccagttagcgcgggcggaagagtgaagtgtgttatcggccatgctcaggctccctgaggattattgttgtgatcggttggctccgggatctcccggcaggctatcaacgggtcgactatctggcggctgccgccgtcggtcagacccaaatcggttaaatgcggcccggcgttacaggcaaggcaggtgccttcaatggccttgaagacccggtacggcggctcccagtcggcgacttggctgctcagatcgcgcagctcgcggaactgacgcgccagttccgcggccgggagatccgacagcatgccggcaatcggcatcgccacatgggcgaggatctcgccctgttgcgccagcgccatcccgccgccggaggcgataagctggttggccgccagcgccatatcattagcgtcgcgcccgagcaccaccagattatgcgagtcgtgggagtagctggtggcgatggcgccgcgcagctcaccccagccttcaagcagggcgatttgcggcgtcgcctgatggcggccgtggcggtgcttgacccagatcagactgaagccggcgggtagctggactttcccgtcacgaacctgcacttccacttcgccccactgggtgaagcgcgcgccgcggatatggcgcaggcgggcgatgccgtgacgaatgccctggacgcgcagaataaagtcatcggcgcggaggggagcgatctgcaaagtatcgcgcggcggcgtgacgcccgcggcgggcgcgatcggtctcagcaggttgcccgcgcgggccagcagcttaccgcctacgtagacttcgcgggccaccagtttctccagggaatcaaacaccaccagatcggcgcgccgcccggcggcaatcagcccgagatcgtggcgctgcaggcgaatagcggcgttgagggtggcgaatcgcagcgcatcgaccgccggtaaaccgtgctcgatcagcagattaagcagggcgatgatgccgcctttctccagcagcatatccggcggcacgtcatcggtgcagacggtgatctgcgaggagaggtgcggcagcgtttttaacgccgcgacgatatccggcagcagataggggtgcgagccgcggatctcgatcgtcagcccggcgcgcagtttttccagcgcgtcgtccgccgaggtcagttcgtgatcggaggtgacgccggcggcgaggtaggcctgcaggtcagcgccgctcaggccgcgggcgtggccttcaatcagtttgccgctgttgagaccggcctggacaatctcctgcatccgctcgctaccgtgcagcacgccgtgcatatccatcacctccgccacgccgcgcacttccggccagccgagcatggtctccatctccgcgccggcgaaatcggcgccggacatttcgagacccggcgtggaggggacgctggacggggcggcgaccatcacctgcagcggcagatggcggctggcgtccaccgcatagcgcacgccagcgacgccgaggacgttggccagctcatgcggatcccagaacaccgcggtggtgccctgggtgaggacgatttccgcatagcgctccggtggcaggtgcgagctttcgaggtgcacgtgggtgtccatcaggccgggggacaggtagccaccggccagggaacgcacttcatgggcgtcttcgcgactgccgcgcgggtggacgctggcgatcatctcgccgacgataccgacgtcagcggggcgaatttcgcccgtggccatatcgacgatctgcgcatcgatcagcagcagatcaaacggggattcaccgcgcgcggcctgcacggcgcgacggcggacttgagcattgctggacataaccactccggcacaaggataatgcggatactctaggggcacagcaaacgtttgcccagatgaataaatttatcacccgataagctcgggttattgtgcaggaccaccgtagcgaacccgatgatgaacgaaccctggcagcggctgcccgcgctctctcttaaacagcttcagtattttgtcaccctggcccagctgcgccattttaccgataccgccagtcgcctggcgattagccagccggcgctgagcagcgccctgcggcagattgaaacggtactcggcggcaaactggtcaaccgtaccgctgcgacggtcactctgactgaactgggggcggcgattttaccccacgcccagcggatcctcagcgtggcgcaggcggccttttccgatatgcagcagattgtcgaggcgggtggcgacgggacggtgcgtatcggtctggtgccgtcggtcagttcgctgctgtttccgctgctgccgcagaccctggctgaggcctttccgcgtctgcgcattgaatttcacgatcagaccaacgatgcgcttatccaggcgctgcagcgcggcgagattgatttcggcatcggggcgatcgacagctcactgcccgcagaactgctggtctatccgctgcgcgaagatcccttcgtggcggtgctgcaccgcgacgatccgctggccgcgcaggcgcatctgccgtggaaacagctggtggggcgggatattgctgtgttctcgaagggcaatatccagcggctggtggcggcattagtggagagccatcgcctgacgctgaccacccgctaccaggtggactatatcgaaaccctgtatggtctggtgcgctcgcgcttagcggtggcgattctgccggcgctgtacaccacccatctgcaggacccggcgctcagggtcgcccagctgcagcagccggcgcttgcccgcacagtggccctgatgcgcggcccgcaggcgctgcccccgcttattgaagactgtttttctctgctgcaggccgccttgcgctagggcaggtgcttgatcagcacgtccaggtttaagtggttgatgtactccagcgagtgtgaggagaggacgcccagcagccggttatggtgcccggcaataattaaatcgatctgccgctgccgaacgcaggtttccacgtcttcaaaccggcgggtggtcaccagcgagagggtatccaccggcagggagacggtgcaggccagctcgttgagcagggctttggcctggatcacctcctgcgagacctgatcgtcgcgcaggctgtcggaaacatagttcagcgcccggtaatcggtgctgatgtgggcgatggtgatgcgcatgccgttctcttctgccattctggcggcatgctggagcagcgggacgccgtcctgactgctgttaatcagtaccagcgcatggtgataaacggccatggcgtatatcctcggtaggctaaatagcgcatgatgtcattattttccgcccgccagcagcggaatgcaatcccgcccggtcgcctgatgagcatgatggccgcgaaggtgtcgtatccagggctaaaggcttgttgtatgaaccggtgagttgcggtaaattccacaacgcttaacaatttcactattttgactcggggtgcccttcttcgttgaaggctgagaaatacccgtaccacctgatctggataatgccagcgtagggaagtcagagaccgcagggtcattgcttctacctcgtctggcgggagcaaactatgcctgagctgttgaatcccgcgcctgtcgcgcacctgcgccatctgctgcgcgcccattccccccttgtgcactgcatgaccaatgacgtggtgcagacctttaccgccaacgttctgctggccgtcggcgcctcgccggcgatggtgatcgatccccgcgaagcggcgcagtttgccgctatcgccgatgcgctgttaattaacgtcggtaccctgaccgaagatcgcgccgtggcgatgcgcgccgcggtggagcacgcccgtcaggccggcaagccctggacgctggatccggtggcggtcggcgccctgaccgtgcgcacggccttttgtcacgagctgctggccttccagccggcggccattcgcggcaatgcctctgaaattctggcgctggccgggatgagcgccggcgggcgcggggtggataccaccgatacggccgccgcggcgctgccggcggcccaggcgctggctcgtcggctggctaccgtggtggcggtcactggcgaggtggattacgtcaccgacggcgagcgggtgctcagcgtggcgggaggcaatccgctgatgacccgggtggtgggcaccggctgcgcgctgtcggcggtggtggcggcgagcgcggcgctgccgggagaccggctggaaaacgtggccgccgcctgcgggctgatgaagcaggccggggagatcgccgcccgtcagggaggcccaggcagctttattccggcgtttctcgacgcgctgtatcaggaggtgcagggatgaaacgcatcaacgccctgaccatcgccggcaccgatcccagcggcggggccggtatccaggccgatctgaaaaccttctccgcgctgggggcctatggctgctcggcgatcaccgccctggtggcgcagaatacccgcggcgtacagtcggtctatcgcatcgaaccggattttgtggccgcgcagctcgactcggtgttcagcgatgtgcgtatcgataccaccaaaatcggcatgctggcggagaccgatattgtggaagccgtggccgagcggctggcgcgctaccgggtggccaacgtggtgctggataccgtcatgctggcgaaaagcggcgatccgctgctgtcggcctcggcggtggagaccctgcgtcaacgattgttgccgcaggtgtcattgatcaccccgaacctgccggaagcggccgcgctactcgatgccccccatgcgcgtaacgaacgagaaatgctggagcaggggcgggcgctgctggcgctgggctgcggcgcggtattgatgaagggcggccatctcgacgatgccgaaagcccggactggctcttcacccgcgaaggggaacagcggttcaccgcgccgcgagtgcagaccaaaaatacccacggcaccggctgtacgctctccgccgcgctggcggcgctgcgcccgcgtcacgcggactgggcggccaccgttaccgaggcgaaggcctggctgtcggcggctctggcgcaggccgactctctggaggtgggccacggtatcgggccggtgcaccatttccacgcctggtggtaaatggcagcgcaacgggacagcagaatctcctgaaaaaatggccccccggctggaaaataggctaagtcggtaccaggcttaacctgcccaaaaaaattgggttgggataatgcatgccggcttcggccggccttacgggagattgctatgactgatattacgcagttgctgggcaaagatgccgagagcctgttgcagcaccgttgtataaccattccgtccgaccagctgtatctgcctggcgcagattatgttgatcgggtgatggtggataacaaccgaccaccggcggtgctacgcaatatgcagaccctgtacaataccggacgcctggggggaaccggctacctttccattctgccggttgaccagggcgtggagcactcggcgggcgcctcctttgccgccaacccgctgtactttgatccgaaaaatatcgtcgagctggcgatcgaagccggctgtaactgcgtggcgtcgacctacggcgtgctggcctcggtgtcgcgccgctacgcgcatcgcatccctttcctggtgaagctcaaccataacgaaacgctgagctaccccaccgaatacgaccagaccctctacgccagcgttgagcaggcgtttaatatgggggcggtggccgtgggagcgacgatctatttcggctcagaacaatcgcgtcgtcagatagaagagatttccgccgcctttgagcgggcccatgagctgggcctggtcaccgtgctgtgggcctatctgcgcaattcggcgttcaagaaagacggcgtcgactatcatgtttccgctgacctgaccggtcaggccaaccacctggcggccaccatcggcgccgatatcgttaagcaaaagatggcggagaataacggcggctacaaagcggttaacttcggctataccgacgaccgggtgtacagcaaactgaccagcgataaccccatcgatctggtgcgctaccagctggccaactgctatatgggccgcgccgggctgatcaactccggcggcgcggcgggcggggagaccgaccttgccgacgcggtgcgcacggcggtgatcaataaacgcgccggcggcatggggctgatccttggccgcaaagcgtttaagaaatcgatggccgacggcgtgaagctgatcaatgccgtgcaggatgtttatctggatggcaaagtgactatcgcataaggcaaaaatccgggcggcaccgcccggattgctcgttgtttgtaccagatgcggtttattaagactctgccgcgttggcggtaaacggtttcgcatgctgatcgctggtaaagccaggctgttcaacgcggattaacgggcacaggaagaaggccagaatatataaggcggtataggctattaccacgccgatagtgctgaaatagggcagcagtaccacggcaatcgccggcgccagaaagttcgacagcccggctgacaggttatagaccgaaatcgcagcgcctttatgcttcggctccagcgccgggaacaccgccgccatcggcacaaacgcggcgacaaaaatccccagggcaatagccggtaccagcgccatggcaaaattatggccgaagtgctggggtaggtaatagaacgccagggtggaaagcgccatcccgatgcagccgaaccagcggataaccttcatccagcccattttctccgccacaatcccccagaaaacgttcgaaaagatcgtggtgaagaagaatgccgcccatacctgcagccattccgaggtggtaaatcccagctcatcaacaaacatcatcggcatgatcaccgcaaaaccaaacagcgacagggtgttgataatgcgcacaatgctcgagaacagaatgctgcggttggtatagagcagcgtcgccgcgcgccccagttcggcgaatttttcacgagtggtcaggttctgcatatggcgcggcgtttcggtatgacgcatcgacaccagcgcaataatgccgccggtggcgcaaaagagcagcgccagccacagggtgcccatttcgccaatgtggggaatggtaaagctcggaatatagctgccgaacacgccgatacccaccgagtagaccgcccagaaccagcccagcgcggagctggaactgtcgctgcggacgttgtggataatggcgacgataaaggagtagaggaacagtgggtaggccaggccgcggatgccataaaacagcaggatcagcgcatagttggcgcgaccgaggccgaagacgaggaacagtacgtggaacacacaccacagcacgaagccaatcagcatggctttacgtggggtaatgatttccgccaccacgccggagacccacgccgacagggcggcagccagaccgtagagagtaaaggcaaaggaagcctgcgccggggtgaatccgagtgctttgatgtagtgcgacagaaaagccagctcaaagccgtcgccggtcataaacacggcgatggcgacatatccccagatgaggttgagcggtagaccgtaccactgtttgttattaacggacatgttgacctcgatttcagagtgcagatgagtgtctccgctgcacagcagcggagcattattgttataaaataaggaggtatgttattcgcgaatcagcctgccggcctgttgtagcgccttataggccgcatacctgcgctgatgaagcgggctaaacgcagtctcgctgtgataggtggcatccacctgagtaaactgcttcatggcctccggcagcgaagccgcgactctgcccgccaccgcgccgaggatggcggaacctaacagcaccggctcgcggctggcggtgctcacgacgctaacgccgcaggcgtcggccaacagctgacgcaccagcggatgctgcccggcgccgccgctgatgacgatattttcactctcaattccgcaggcgcgctgggcgtcaatgatctgtcgcagaccatagccaatcccgcatagcccggcaacgtacagcgcggtcaggttatccaggtcccgctccatccccagcccggcaatcagcgctttcgcgtggggatcggcaagcggcgcgcgattaccgagaaactccggaacgacgtgcagaccggcggccagcgttaccgcctcagaaggggaagcaacttgcgtcagaacgcgatccgccagccagaccggtagagggacgcctgcggctttcgcttgctcgcgcgcttccgccgccgccggatggaagctcagcagctggtcgatagccgcgccggcggcgctttgcccgccttcacttagccagtagcccggcaccatcgccgaatagtaagggccccagacgcccgggacgaataccgcttcctgagtggtggtcatggtgcaggaagaagtgccgaagacataggccatattgttgaccgcgccgttaagcacgccgacggtaccgatgccgcccgcgtgggcgtcaatcatccccaccgccaccggcgtgccgatcggcaggcccatctcctctgccgccgtggcgcaaaggccctcgccgcagggggtgcctggatcgacaatccgctggccgatgcggacaaaatcttcatccgccagctcttcgaggccaatctggcggaagtaaccggcatcccagcgttgttcatgcgccagataggtccatttacaggtcaccgtgcagaccgagcgggcttcatcgccggttgagcgccaggtgaggtaatcggcgaggtcgaagaagtggcgcgcctgctgatagatgtgcgggcgattctccttcagccacaaaattttcggcgtttgcatctccggcgagattttgccgccaacgtaccgtagtaccgggtggcccgtggcattgatcttttccgcctgcccggtggcgcgatgatccatccagacaataatgttgcggtccgcatcgtccgaaggcccgaccgccagcggcgcatcgttatcgccaatcaccaccagcgagcaggtggcatcgaagccgatcccggcgatcgacgacggcgaaacgccggcgctggccaccgccgttttaatgcagtagcacaccgcctgccagatctcacggctcgactgctcgaccttgtttccggcgctgcgaaacagggttatttcccgggtcgcgtgggcgaggagctcgccccgcagattgaataccccggcgcgcacgctgcccgaaccgacatccacgccaataatgttttgcgtatcgttttgcatcacatcctctcataggctggccagggtcagagatccacgctgttcggcaggatcacaatgtcgcgcacggtgacgtttttcgaacgcgtcaccataaacagcaccgactccgccacttcaatcggctgcatcaggctgccgttggccagcgcttcgtccattttggcttttggccagtcgtccagcagagcggtaaccaccgggcccggcagtacggcgccgacgcgcacgccatactgcgccacctggcgacgagtggtgtgtacaaatgcctgcaccgcgaatttcgacgcggtatagacaggctcccagatcaccggcaccacgcccgcgatcgagctggtgaagataatatccccggatttttgcgcgatcagatgcggcaggacgctgcgcacgcagcggaaggcggcgttgatattaaggtgcagcacgcggtcccagacgtccgggtcgccctcggccaccggcccgccgatataggcgccggcgttggcgtggaagatatcgagacgcccggtaagctgcaaaatgccctgcagtaggttatcgacctggtccgcctgcatcaggtcgacctgcagggcgaaggcgttttcgccaagttcggcgaccagtttgttgagcttttcgccttcgcggtcgatcagtaccacttttgcgccagctcccagcagggtcctcgcgcactcgaggccgataccggacgccgcgccggtgatcgcggcgactttaccgctgagggaagtattcatagaggagacagagtggttcattttataatcctttgccgtgtctggttaaaactatcgaacgcgagggcatcacgttcgaggtgatagactaaacctggtaacatattgaatatcagcatcttaattcaggcttgctggcatgttgaggcggtatgcgcgcgtacttcctggcgtgaaaaggatgctcaatcgatgaagctatgttgctctcgcttcatcgattgagcaagtggggaaattaacagcgacatgattttgtgacgcaagttggaaaaatgaagaagataacgatttacgacctggcggaactttccggcgtttcggcgagcgcggtgagcgctatcctcaacggtaactggaaaaagcgccgcatcagcgccaagcttgcggaaaaggtgacgcggattgccgaggagcagggctatgcgattaaccgtcaggccagcatgctgcgcagtaaaaaatcacacgtcatcggtatgattatccccaaatatgataaccgctacttcggttccatcgccgaacgctttgaggagatggcccgcgagcgcggcctgctgccgattatcacctgtacgcgccggcgtccggaactggagatcgaggcggtaaaggcgatgctctcctggcaggttgactgggtggtcgcgaccggggcgaccaatccggataaaatttccgcgctatgccagcaggcgggcgtgccaacggtcaatctcgacctgccgggctctctctcgccgtcggtgatttcggataactacggcggcgcgaaagcgctgactcataagatcctggctaatagcgcccgccgccgcggagagctggcgccgctgacctttatcggcgggcgcagcagcgaccataacaccagcgagcgtttacgcggcttccacgatgcgcatcgcgagctggggcttagcgtgccgcaggagaatattctggctcccggctattcgaaaggccacgttgaggactgcctgcaggagcggtttggcagcgcgaagacgttgttgcaggggatatttgttaactcgacgatatccctggaaggggttgtgcgctggctgtcgcaggtgggtctgaccggcagcgagcagccgccgatgggctgcttcgactgggatccgtttgtctatctgctggggcacgatatcgacatggtgcagcaggacgtgccggcgatgctggacgctgttttttcgattattgacgccggcgaagccagccagcagcggattgaaattcccccgcgactgatgagcagcagctgagtcgctgtctggctgttcgacgttaccgcgtcagcagccagcgggcggtatgctcatcggtcaccaggccattaatccagccgcctttaagggcggccaggatcgccggtcgtttatgttctccacaggcagcggcaatccgcgggcagtggctctggcggatatcatagctggtgatcatgcggttgatctcgctgtctaccacgtcgccttgcgcatcaataaaccgcccgaggatctccccgatgccgccgcgggcggtcagctcatccatctgcgcctgattgataaacccgtctttaaagatcggactttgcgtgcccagcggaccaatgccgacaaaaatcacgtccgcctcgcgggcgacgctggagacgctgcggaataggcgattggtgcaccacatttcatactcatccgcgctttgggcgtagcgcggcgccggccactgatagtacttggccttaattttgcgggtcagcagcaggggcacgtcatcgtaataattgcactgcccgtcggcgttcatggcactgatcagcgccacgcagcgggtattcaggctgtcaaaatcgatgcgctgcagcgcttttttcagggtcaggcccgagcccagaccgataattttctctttatcatcctgcagatagcgagccatcagctgatagcagccaaatgacacactgtcgagggtgctttcttcgctaaaggcggggaccacattgcactcgatcaagcggtatttttcctgcagcaactgcgcataatcgaggcagttcgctaccggatggtgcagattaatcgacacaatcccttcttctttcgcggcggcaatcagccgttgcaccaccggtctggaggtgcccagctggctggcaatctcgctctgattctggccggcgatgtagtacatccatgcggcacgcaccttctgatccaaccggatatcgtcttctttactcatggtttcccgccctaagttgctggccagggcacgcaattggcccggcgaatacccgcattctcgccgtggttggcataactggcaagcttttgctctttgttggtcatttgtaatttaattgggtaattgctcttttgtgatctatggctcttatttcggtcaaatgatcaattacagtggcgccatcaactcaaggagagcagaacatgaacaatcaattcacatggcttcatatcggtctgggttcttttcatcgcgcgcatcaggcgtggtatctgcatcgtctgattgcttccggggataatcgctggcgcatcgcggcggggaatattcgcaacgacgccgagcaggtggtacaggcgctggcggcgcagggaggacgttacgtcctcgagaccgtcagcccggaaggggagcgcaaatatgaagagatcacctcaatccagaaactgctgccgtggcaggccgggctacagccgctgattaacgaaggggcaaacccgcagaccaaagttatcgcctttaccgtgacggaaggggggtactacctgaacactcgccatcggctggaaaccagcaaccccgatctgcaggccgacctgcaaggcgagtgcaaaaccatttacggcaccctcgcgcggatcctggaaaagcgcatggccgacaacgccgggccgctgaccctgctcaactgcgataacgtgcgccataacggcgagcgtttccacgacggcatggtcgagttcctgcagctcaccggcaaacaggcggtgattgactggatggcggccaacaccacctgtccgaacaccatggtggaccgcatcaccccgcgtccggcggccgatctgccggcccgcatcaaagcgcaaaccggaattgatgacaaagcgccggtgatgggggagacctttatccagtgggtagtggagaacaacttccgggttgcccgcccgaatctggaggcggtcggcgtggagatggtggagtcggtcatcccgtatgaagaggcgaaaatccgtattttgaactcgtcgcacagctgcattgcctgggcgggaaccttaatcggccagcagtatattcatgaaagcacgctgaccgatgttatctacgccattgccgaccgctacgttacggaggacgttattccgtgtctcggcgacaacggcattgatctgccgacctaccgggatgtggtgcttaagcgctttaccaacccctatatccaggacaccaaccagcgcgtcgccgccgacggcttctcgaaaattccggcgatgatcgcgccaaccttgcaggagtgctaccaacgcggcgtccgccctgaggcgaccgccatgctgccggcgctgttcttcgtctttatggagcagtggcacaagggaactctgccgtatcagtaccaggacggcatcctggatgcgcaggcggtgcatgagatgttcgaggctcaggatccggtggctgtcttcgcccgtgataaagccctgtttggtgatctcgccaacaacgcggatttcctggcgctgatgcgcgagaaagtcgccgccgtttacacgctgattaactaagaggtggctatgtatctgggtatcgatctcggcacatcggaagtcaaagcgctggtcattgatgagaaccatgaggttatcgccagccatagcgcgccgctgagtattcagcggcctcatccgcactggtcagaacaagcgccggagctatggtgggaggcaacggagtacctgatggccacgctacgggaaaaatgcgcgcagcattggccggccattaaggcgattggcctctccgggcagatgcacggcgcggtgttgctggatgcagagggggaggcgatccgtccggccattctgtggaacgacacccgctgcgccgcagagtgcgccgagctggaggcgatggcgccggagctgcatcaggtggcgggaaacctggcgatgccgggctttaccgcgccgaagctgttgtgggtgcgccgtcatgagccgcagcactttcagcgcaccgccacggtgctgttgcccaaggattatctgcgctaccggatgaccgggaagaaagtctccgatatgtcggacgccgccgggacgctgtggctggacgtggcgaagcgcgactggtccgacgctctgctggacaagtgcggcctgtcgcgtagccaaatgccgacgctggtcgaaggctgcgaggtttccgccacccttgacccgcaggtggctgcgcgctgggggctgaacgcctcggtggtggtggccgggggcgggggggataacgcggtcagcgccattggcgtcggcgcggtctcgccgggggatgcgtttatttcgctcggcacctccggggtgctgtttgtggtgaccgatgcctatcgtccggcgccgcagtcggcggtacatgcgttttgtcacgtgctgccgaacctgtggcaccagatgagcgtcatgctgagcgccgccagctgtttgcagtggttctgccgcctgaccggcaccacggaggtggcgctgctggcggagattgccgagctaagcgaggaggataaagccaacgccccgttcttcctgccctatctctccggggaacgaaccccgcataacgatcctgacgcgcgcggcatcttctggggcatgacccatgccagcctgcgcgcgcagctaggctacgcggtgctggagggggtgagctttgggatcaacgacggcctgcaggcgttaaaagagagcgggacgccgatcgcgcagtgctcgctggtgggcggcggcgcccgcagcccgttctgggcccagctgctggccgatattctcgctatgccggtggtgacccacaaaggcggagagaccggcggcgcgctgggcgcggcgcggctggcctgcctggcggcgggcaaaccggttgccgcggtgtgtgaaaaaccggaagtctggcagacctggcgtgcggatcctgttcgccaccacaccctgatgcaacgctacgcgcagtttaaagccctgtatttaaacgatcttaaatatcgacagcactgattttcatcataaccgccgcttcgttgcacgtcgcggagcggccaccctgtaccctgaaaacgaggtcattatgtctatcaataataaacagtggctcggtttacccctgaacctgctctggggatacatcgccattgccgtatttatgaccggcgacggttttgaattagcctttctgtcgcactatatcaaagccctcggcttctctccggcggaggcctcctttgcctttaccctctacggcctggccgccgcgctgtcggcgtggatttccggggtggtggcggaaattatcaccccgctgaaaacgatgatgattggcttcgtgctgtggtgcgtattccacgtgctgttcctcgttttcggcctcggtcacgccaactatgcgctgatcctgcttttctacggcatccgcggcttcgcctatccgctgttcctctactcgtttatcgtggcgattgtccataacgtcaaaagcgacaacgccagctcggccatcggctggttctgggcggtgtattccatcggcatcggggtcttcggcagctatattccgagctttaccattccgcacattggcgaaatgggcaccctgtggctggcgctggccttctgccttaccgggggcgtgattgccctggtttccctgcgccatattcaaacgccgcagcatatgcagaatctcaccacccgtgagaagttttccgagctgggacgcgccgcgacgctgctctataccaaccgcaatattctgctgtcgagcatggtgaggatcatcaataccctctcgctgttcggctttgcggtgattatgccgatgatgtttgtcgatgagctgggcttcagcacttcagaatggctccaggtatgggcagtcttcttcttcaccaccattttctctaacgtgctgtgggggatcctcggggaaaaacttggctggatgaaggtggtgcgctggttcggctgcatcgggatggcgctctccagcctggcgttttactacattcctcagcactttggccatagctttgcgatggcgctgatccccgccatcgccctcgggatctttgtcgccgccttcgtgccgctggcggccgtgttcccggcgctggagccgaagcataaaggtgcggccatttcggtctataacctgtcggcggggatgtcgaactttctcgcgccggctattgccgtggtgctgctgccgttcttcagcaccatcggggtggtgatcgcctataccgcattgtacgtggtggcctttttcctctgcgcctttatccgcgtggagcagccggggttctcccacaaggaagcaaccgcccgcgagcaggttgaattctcataggtactgcggctggcatgcgcttcatgccagccttaatgaggtgaacgaatgagtatgcaggcggttatttttgacatggatggcgtgattattgattccgaggcgctgtggcgtcaggcgcagattgacgccctcgcgcagtggggggcaacggcgagcgttgctgaatgtgaaaccctgaccaagggcaagcgcctcgacgacattgccggcacctggtgccgctattttcagcttgatctcgctccgcagcggcttgaagacgccatcctgcagcgcatcacccgcctgattgccgcgaaaggcgaaccgatgcgcggggtgcaggaggcgttacgctattttcgcgaagcgggttataagattgcgctcgccacgtcatcatctcgtcaggttattgccgctgtgctgaacaagctttcgctctggcacttttttgacgcgatctccagcgcggatgatgaaccacgcggcaaaccgcacccggcggtgtacctcacgacgctgcggaagctcaatctcaacgccagccagtgtctggtgattgaggatagctttaccggcttttgcgcggcccagtcggcggggattgccacgatagtgattgcagaagatagccagcacgcgcgttttcaggccgccgctggccgctatcaaaccttacctgaactgctggaagcgcttagcgcggagccagcggcggcggtttaagtcagccatttgtgggcgcagacattcccgggatgtagctggtcggttaatcttttctctgcgctcacgcccttttttctcctggtcgatctgcctcacatttcgctcatcttttgtgaaaacagtcacgtcttgttgtgccaatgcccaaatttatggccttgcttagcggtgtttgtccgaggcactactacgaagttgtgcttagattatatattgaaacgtactttcaataatgtgaaaccgctttgccgattttcttatgtcgatcggatttggccgtgataaggaccgagcatgaaaattgaatctgtgaatgtcaccgttttccaatatcccactcgtcgggtttccgacagcgccgggcactcccatccgggggttgaaagcatggccaaaatggcgatgctgaccatcaccgctgatgatggggcgcagggcttttcgtttgcgcctccggaagtcgtgcgcccgttcgtggtgaatactttttttcgcaaagtgctggtgggacaggacccgtttaaccgtgagcgtatctggcaggatcttaaccactggcagcgcggcagcgcacatcagctaacggagcgcgcgctgtcgtttgttgaacaggcgctgtgggacctgatcggccgcagccttaagatgccggtttataagctgctcggcggctatcgcgacactgtcccggcttacggtagcaccatgtgcggcgacgatctgccgggcggcctgtcgaccccggaagagtatgccgcttttgctgagaagctggtcgcccgcggctacaaggccatcaaactgcacacctggatgccgccaatctcttttgcgcccaatcccaaaatggacattaaagcctgcgcggcggtgcgcgaagccgtagggccggatattgacctgatgattgatggctatcactggtacagccgcgccgaggcgctgtggatcggcaaagagctggaaaaactcaatttcgcctggtttgaagagccgatggaggaggattcgatgtcttcctatgcgtggctggcggaaaacctgtcgattcccatcgtcgggccggagagcttcggcggcaagcaccacatgcgcgccgaatgggtgaaagccggggcctgcgacattctgcgcgccggcgctaacggcgtgggggggattacaccgaccatgaaggtggcggcgctggcggaatctttcggcatggattgcgaagtccacggcaacggagcggcaagcctggcggtggtgggcgcgatccgcaactgccgctggtacgagcgcggcctgctgcatccgttcctcgactacgatgaaccggcggcctatctcaacagcattgtcgacccgatggatgaccagggatttgtgcatttgtcacaacgtccgggtctcggtgaagacattaattttgcgtatatcgaagccaataccgttagccacgactgatttaaaaaaataaatacccgatggcgctgcgcttatcgagcctgcggcccggtagaccggataagccgaaaatgccgccatccggcaacatgtaccctacagtacaggcaaacagagatatgaaacaaacctccttactgggagcgtgtattctcgcgctcgccatatcgatggggagcggggaggcggtggcgaaaacgccgcccgaccagctgatcatcggcatgaatatgaataacctgctcacccttgacccggcggcgatgaccggtaacgaagtggtggggatcgtggtcaacctctacgactcgctggtggagcttgaccctgagcagctcaccaccgtcaggcccgcgctggcgaaatcctgggatatcagccccgacggcaaaaccctgacctttcatctgcgcgatgacgttaagtttcactccggcaacccgctgaccgccgccgacgtcgtgtggtcaatgcggcgcatcctgcacctcaacctggcccaggcctcagtatggaaatcctatggcttcagtaagaaaaatatcgacagccaggtcagcgcgccggaccgcttcacggtgcaaatcgtattacccaaagataacgatccgcagctggtgatttactcgctggcggcgctgggcaacctcggagtgctggacagtaaaacggtgcaaagccatcagcaggataacgactggggtaaccgctggctaaccacccatgaagccggttccgggccgtttatcctcgaaacctggcaggcgaaagatgtgctgcgcatgaagcgcaaccctgactactggcgcggcgaggcgaaaatgagccgcgtggtactgcgtcatttccaggagtcgcaaactctgcgcctgatgatcgaaaaaggcgaccttgatattgccaacaatatggcggtttccgatatcaacgccatgcgcagcgatccgcagctgaccgtcgatgcggtgcagcgcggcaccatgtactacgtggcgatgagcatgaaagaggcgcacttcgccaatccgaaagtgcgcgaggcggtgcgctatctgattgattaccagggtatcaataaagcgctgatgccgggctacggcgtgctgcaccagcggcctatcaaagcgggaatgccgtccacgctacccgatcccggctacaggctggatgtggcgcgggcgaaaaagctgctggcggaagcgggatatcccaacggctttgataccacgctgcgggtactctccgatcagccatttcttaacatcgctatcgccgtgcagtcgacgctgatgcaggcggggattaacgccaaaatcatcaccggcactggtaaccagatctacggcgcaatgcgcgagcgtaaatttgacctgctggtaggtcgcggcggcagcgggatggagccgcatccgcactccagcctgcgcgcgctggtctataacccggataacagcgataaggcgcgcctgaccaacttccagggctggcgtaccggtttttacgacccgcaactgaatacgatgattgaccaggccctgctggaacgcgatccgcaaaaacaggtggctgactaccaggccatccagacacgctacgaccagctggttccggctttaattccgctttcgcagatggttgattcggtcgtcgtgcgcaacgaggtacgggagtatcagccgcacccctccgccaccacttttctgcgtgacgtctataaagtccgcgaaggagagaaaggatgagtaccgcaatccttgcgcccggctcacgcggccggcgcttatcaaaacggctactgcaggtggtgattacactgttcggcctgctgctgctgacctttaccattggccgcgtcatgcccatcgacccggtgctggcgattgtcggcccggatgctgaccagagtacctatcagcaggtttaccagcagctggggtttgataaatcgctgaccacccagtttggcatctatttcgtcaacctgttgcacggcgatctgggcaacgcgctgctgaccgggaaaccggtagtggacgatattatccgcgtcttcccggccaccatggagctggcaacgatggcgattattgtcggcgcgggtcttggtattccgctgggcgtgttggcggcggcgcggcgcaatagcgtctccgattatgtggtacgcattatcagcctggcgggctactcgacgccgatcttttgggtcgggatgatggggctgctggtgttctatgcctggcttggctgggtaggcggcgccgggagggtagatctcgggctggatggtgtggtgtcgcgccgcaccgggctgatgaccgttgatgcgctgctggccggcaacggccaggtgttctggaacgccattaatcatctgattcttcccgcctcgctgctgggttttcactcgctggcttatatcagccgtatgacccgcagctttatgctggcccagctgtcgcaggagttcattattaccgcccgggtgaaagggctgaccgagcgccaggttatctggaaccatgcgtttcgtaacatcctcgtgcaactgctgacggtggtggcgctggcctacggcgcgctgctggaaggcgcggtgctgattgaaactgtcttctcatggccggggtttggctcctaccttaccggaagcttgctgctgggcgatatgaatgcggtgatgggctgcgtgctgctggtgggggtgatcttcgtgatgctcaacctgctctccgacatgctgtatcaattctttgacccgaggacaaaatcatgaccgtttctctggattcgccgctttcgggtggtgcgggcgaaggccgtcagcggctgcaacgcgcggcggcgcgggccgtcgggtttatcggcaaaatggcgcgcaatccgctcacggccatcggcggaggaattatctttatgctgctggtggtggcgattttcgcgccgctgattgcgccttataacccgctggtacaggacctgaatagtgcgctggtcgcgccgaatgcgcagcactggttcggcaccgatgagtttggccgggatatctttagtcgcctggtgtacggctcccgcatcacgctctatatcgtgctgctggtctcagtgaccgtcggtccgctcggactgctgctgggcgtcagtgccggctatttcggcggtaaagtcgatatggtgctgatgcgcgtcaccgatattttcatctccttcccgagtctggtcctggcgctggcgtttgtcgccgctttaggaccggggctggagcacgtggttatcgccatcacgctgaccgcctggccgccgattgcccgtctggcgcgcgccgaaacgctctctctgcgccaggctgattttatctccgccgtgcgtctgcagggcgcttcatcggcccgcgtcctctggcgccatatcgtgccgctgtgtctgccctcggtcattatccgtatcaccatgaatatggccgggatcattctgaccgcggccggcctaggctttctcggcctcggcgcgcagccgccagagccggagtggggagcgatgatctccagcgggcgcacttatatgatggagtgctggtgggtcgtaaccattccggggctggcgattctgatcaatagcttagcgttcaacttcttaggagatggcctacgtgacatcctcgatccccgtagtgaataatgcaccgctgctcgacgtgcgcgatttgtgcgtcgactttgttaacggtagcgcggtgacccacgccgtgcgcggcgtctccttccagctggggcatgagaagctggctattgtcggcgagtccggttcgggtaagtccaccgttgggcgcgcgctgctgcagctgcatccgaaaaaggcccgcgtcagcgccagccggatgcagtttgccgacctcgatctgcagcatcttagcgaagcgcagatgcgcggcgtacgcggcaaacgtatctcgatgattatgcaggatccgaaatattcgctgaatccggtggtctgcgtgggtaagcaaatcgccgaggcctggcttactcatcatcccgggcgcaaagatgaggcgaaagccagggcgctggagatgctggaggtggtgcgtattcgccagccggagcgcgtttatcagctttatccgcatgaaatatccggcggacagggacagcgcatcatgatcgccatgatgctgattaccgacccggaactgatcattgccgatgagcccacctccgcgctggacgtgtcggtgcgcctgcaggtgctgggcctgctggatgacctggttcagtcgcgcgggctggggctgatttttatcagccacgatatcaacctggtgcgcagcttctgcgaccgggtgctggtgatgtacgccggacgggtagtggagtccatcgccgctaaagatctcgatcacgcccgtcacccctacactcagggattgattaactcgctgccggatatgcagcatcgtcgcccgatactgccggtgctgcagcgtcaggccagctggttaacggattaaggagcggataatgattgaagttcaacatctcaacctcgcgtttggcgagggggagaagcgtaaccaggtgctgtatgacgtcagtttccacgttaagcccggcgagatctacggtctggtaggagagtccggttccggtaaaacgacggtgctcaagtgcctggcggggctgtttacccactggcagggggaactgaccatcgatgctcagcccttagggcatgaaattagccgcgagcgctgccgtcaggtgcagatggtatttcaggacccctacggatcgctgcatccccgtcacaccattggcgatatcctcgaagagccgctgcagatccatcgtatcaacgaccgcgaccggcggatcaatgcgctgctggataaagttggcctcaaccgcgcctttcgcgagcgctatccgcatcagctctccggcgggcagcggcagcgcgtggcgatagccagagcgctgattcttgagcctcaggtgctgctgctggatgagccgacgtcggcgctggatgtgtcggtgcaggctgagatccttaacctgctggcagaattgcagcgggaggctaagctcacttacctgatggtcacccacgatcttggggttattgcccacttatgccagaaagtggcggtgatgcagtacgggaagatcctcgaaaccctgacggtcgatgcgctggtcagcggccaggcgcagatggcctatacgcagatggcctatacgcagatgctggttaacgccagtcggcaatatacgcgcgaaatggcgcgcgaggtggcggaatactaagctttatggcgcattgtctcacggcagatgcgcccattttaatagataactatttgatgttataggttttttgtggttgtgggtatcgtctattaatgtaagcgcggtgtttggatcgatatcctgcccaggttttttccctgcagccgcaggtgccgttttaccttaacattcagaggctcaatcaacgaacccggctgctgtataccagccgggcgccgtctttgctttgcgaagcctgatcagcgtagcagcgggcagtcgggcggcagccggcagcgcagggccgccggtaacagctccatacggaaggttttgccgctgagcggctcgccgtcgaggttaaaggtcatctcatggggcgcggttatttcaaaccacgaggagacaccgtcaacaatattaggcgagttttccggattcgccagggtgctgaacagggcagggatcagctcttcgccggtgaaaatgcgcagatgcagcagaccatcgttaatcaacgcctccggacacagctgctggccgccgccggcctggcggccgttgccgatgccgatgaccagcgcatcgccctgccagtgaaagttctccccgcggatctcgcagcggtccggcttcagggtatccatgcgcatcagaccgtggattaaataagagacaccgccgagcgcggccttgagtttttccggcgtttcggtggtgatccgggtgccgaacccgccggtcgccatattaataaagccggttttatcattcacccgggcgatatctatcggcacatcgcggccgacgatcgccagcttgagggcgctggccagatcctgcggaataccgacgctggtggcaaagtcgttagccgtgcccagcggtaaaatccctagcgccatcttgccgccgcgctccaccagcgcggtcgccacttcattaatggtgccatcgccaccgccggcgatcaccgtttcaacgttcagctgcagggcttcatcgataaaccgagcggcatcgcccttttcccaggtcacgcggacgtgaatatcaatcccttcatcgcgtaacaggttaaccgcttcgcgtagctgcggttcattggcacctttgccgttaaggatcagtaagctggcaggaaacgtagacatcatcaagggaacctttattgctcaatgttgcataaagtgtaccgcatgacgaaagcgaagaccggaggagaggcaaaaaaataagcccgcgtaagggagattacgcaggctaaggaggtggttcctggtacaactagcatttatgggttatgtttttcagcgaaatggatgatacctgtttcgatcgaaacggtatgtgatccgattctaatatccttacatcgtgaaaaaataacgcaaattaactagttaccgtgcggatttctggttgtttgaccagtaaagttgcgcatcagcagggcatactgcaggggcaggtcgtccggcacaggcaaccagacggtatagccatcgcccggggccaccggcatggtttcgcctttgccattctccatatgctcaagggtgaagttgacgttaccctgcggggtcatcagctcaaggctgtcgccgacgctgaacttatttttgaccgccacggccgccagcgggccgttacgctctccggtgaattcgccgacaaactgctggcgctcggagacggagtagccgtactcgtagttctgataatcgtcatgggtatggcggcgcaggaagccttcggtgtacccgcggtgggccagcccctccagggtctccagcaggctggtatcgaacggtttgccggcggcggcatcgtcgatcgccttgcggtaaacctgagcggtgcgcgcgcagtagtagaaagatttggtgcggccttcgatcttcagcgagtgaacgcccatctgggtcagacgctcaacgtgggcgatagcccgcagatctttcgagttcatgatgtaggtgccgtgttcgtcctcaaaggcggtcatgtattcgcccggacgtttggcttcctcaatcataaagactttatcggtcggcgcgccgatgccgagggtaggctccacggtctgcaccgggatcggctcatatttgtggacgatgttgccgacgtcgtcctctttgccttccgccacgttgtattcccagcggcaggcgttggtgcaggtcccctggttcgggtcgcgcttgttgatatacccggagagcaggcagcggccggagtaggccatacacagcgcgccgtggacgaaaatctcaatctccatctccggcacctggcggcgaatctcttcgatttcatccagcgacagttcacgcgacaggatcacgcgggtgagccccatctgctgccagaatttgaccgtcgcccagttgacggcgttggcctgcactgaaagatggatcggcatctccgggaagtgttcccgcaccagcatgattaaacccggatcggacatgatcagcgcgtccggacccatctccaccaccggcttcagatcgcgaataaacgttttcagcttggcgttatgcggggcgatgttgaccaccacatagaattttttacccagcgcgtgggcttcattgatgccgagctgcagattttcgtgattgaattcgttgttacgcacgcgcagcgagtagcgcggctggccggcatagacggcatcggcgccataggcgaaagcgtaacgcatattcttcagcgttcccgccggggagaggagttctggtttaaacatggtgttctcgttctgatgacaggtcagattcgccgcacctggtgcggcgagttggggagtgtccccacattaagggcgggcattgtagcgccgcggcgaaggggagtaaatatcagataggtatctttcagtatggctaatttgtttgccattttgaacctgggcagtactcacactgacagcgttaataacgcctggtgggataggctctagggagttccccgggttgcggcgtaaacgccttacccgggctacggattgcagatggcggtgaacgtgtagcccggcgaagcgcagcgcgagccgggaaaaggctaactacgccagccggcaggcgtccgcttcccagcggtagccaacgccatacaccgcgcggataaacgactgctcggcgtccagcgcctccagcttgcgccgcaggttcttgatgtggctgtcgatggtgcgatcggtgactacccgataatcgtcatacagatggttgagtagctgttcacgggagaacactttgcccggctcctgggagagggttttcagcagccggaactcggcgggagtgaggtccagcagcttgtcgcgccaggaggcctgaaaacgaccttcgtcgacaatcagcgggctctgggcgtccagcgcctgcagatcgcgctgcggcttgcagcggcggaggatggtttttacccgggcgaccacttcccgcgggctgtagggcttgcagatatagtcgtcggcgcctatttccagccccagcaaacggtcgatctcttcgattttcgccgtcaccatcaccaccggaacatcggagaagcggcgaatttcccggcacagcgtcagaccgtcggtaccgggcagcatcagatccagcaggatcaggtgcggcggcgtctgccggacgtagggcaggaccttgtcgccgtggttaatcaacgcaggcgcatagccggcggcctgcagataatcaatcagcagttggccgagcttcggttcatcttccacgataaggatgcgtggggtgttttcatctacaggcaattcagtcatacgtctctcggtaaatcatgttccagaggtaactcaactttaatgctaaccccgccaaaaggcgaatggtcggcacgcagggtgccgccgtgggccgctacgatattgaggcaaatcgccagcccgaggccggagccgccgctggcgcggttgcgcgatccttccgcccggtaaaagcgttcgcacaggcgggccagctgctcatcgctgacgccgggggcgctgtcggcgaagtcaatcaccagcatccggccgctgcggcgggcggtgatgtgcaggctgccgccgctgtcggtatagcgcaggctgttctccagcagattgttgaagagctgcatcaggcggtcgcggtcgccgaagatcatcgcctgctccgggagcgacacctgaatgcttagctgccggctggcgaagcgctcgcgaaaagcgcccgcggccacttccagcagggtgatgatatccagtgaggttttctggtaggccagcgccccctcgtcggacatcgacagctgatggaggtcgtccaccagcttggtgagagtagccacctcggcctgcagagagggaatcgactcgggggtaaagcgccggaccccatcctgaatcgcctccagctcgccgcgcagcaccgccagcggggtacgcagctcatgggaaatatcggccatcagatcgcgacgcatctgctggttgcgctccagggtgctggcgagctggttaaaatcctgcgccaggcggccgagctcatcgccgccggtcaccgtcacgcgggtggaaaagtcgcccgccgccagcttatgggtgccttccaccagccgcttcaccggcgccagcagaccgcgggccaacgggaaagtggccagcgcggcaagcagggtggcaagggcgacaatcagccagctggtgcgcttttgctgccggtcgaagttaatgtcggtattgcgcgtcagccgctctaccggcgaggcgatcactttgcccacctccgcgccgttgaccacgatgctgcgctgggtgccgtcctccgggacgcgctcacgcggccccaccagcacgcgccccgactgatccaccacccagaacatggtgcgccagccgtggggcggcatttccggcctcgggcgcgggccgtcaggggggccatccggcggcggcccgtccggggcggcgtccggcttcatggcgtgccccggcggcgagcggtcgtcgttatcccgttcgaaggtgcgcagtagctggaagataaagcggtcattattgcgcagaaacgcccagctgccatgctgggcatactgctcgctcagcgcgtcgctgagcatggttaagcgttgctcattgccgcgcttgatatagtcgataaacccgcgttcaaaactaatgcgcaccgcccagtgcatgctgatcagcagcacgatgcaggtggcgaatatagcgaggaaaagcttgccggtaatacccgggcgccaaaatttcacgatccactcctgttgcgtcgacggaggacggtattgctgccgacgtcatccggtacccgggaaaagatgagcgccggcagggcgatgatcgccgccatgctcagataggtgtagagaaagacctgatgggtgctggcggcgtcgaggctcatatgctgctggccatacagccccagcagcagcccggcgatggtcacgccgatactcatcgacagctgcatcaccatcgacagcaggctgttgccgctgctggccagatcgtccgggagatctttcagcgtcagggtattcatcgaggagaagcggctggcgttgatcatcccctgcagaaacaggaccagcggcagcacgtaataccagccggccagggcgctaaacataaacagcaggctgaccgccgccaggcccagggtgctggcgaccagcacccgacggtagccaaagcggttgaccacctggaccacgatccgcttcatgcccatgctgccgagcaccatcgggatcatcatcagcccggcgtgaaagggggagaagccgaggccgatctgcagaaacaccggggtcataaacggcagcatgccgctgccgatgcgtccggcgaagctgccgccgaggccgagagagaaggtgcggttgcgaaacaggttaaggctaaacaacgcccgggcgttaccgcgggcgtgccacaggtagagcagcagggcgcagaggccgacggccaccagccccgccagccaggcaggggaaatgccgagccctttctggccgtcgagcgccagggtcagggtcgccatcccggcggccagcagcagaaagccggagagatcgaagcgccgggtctgcatggtgtagttgggcatcagacagagggtggcgatcgcgccgacgatccccaccgggatattgataaggaagatccagtgccaggaggcgtactccaccagcaccccgcccagcgccgggccgagcagcggaccgacctggcccggcagggtgacgaaggtcatcgccgccatatactgatcgcgcgggacgatcttcatcaccgtcaggcggccgaccggcaccatcatcgcgccgccgaccccctgcagcacccgcgccatcaccagctggtcgagggtgctggcctgagcgcaaaacagcgatccggcggtaaacagcacgatggcggtgaagaagatattgcgcaccccgacccggtcggccagccagccgctggccggcagcatcaccgccaccgttaacacataggagacgataatcatatgcatatgcagcggactctccccgaggcttttggccatcgaggggagggcggtgttaacgatggtggtgtccagcgactgcataaagaagccgaacgccactatccatagctgccagcgcacgctggccgggaggtctgtcatgttattcgcttaccggttgagaggagtgacgcgaaaaacgcagccgcagacggtcaaagaaaagatagaccaccggcgtggtgtagagcgttaacagctggctcatcaccagaccgccgacgatggtgatccccagcggctggcgcagctcagagccatcgcccccggagagcaccagcggcagggcgccgaacagcgcagcgagggtggtcatcataatcggccggaaacgcagcaggcaggcctggaaaatcgcctcttccggcgtcaggttgccgttacgctgcgcctccagggcaaaatcaaccatcatgatggcgtttttcttaacgatgccaattaataacataatcccaatcagggcgattaggctgaacggggcatcgaagatctccagcgccagcagagcgcccaccccggcggagggcagcgtcgagaggatggtcaagggatgcacatagctctcatatagcacccccagcacgatatagaccgtggcgatagccgcgaggatcaggatcacctgcgcgttcatggtctgctggaacacctgagcggtaccggcaaaggagccgcgcacgctcgacggcaccccgagctgggtcatcgcgcggtcaatggcctcgctggcttccgacagcgagcggccggtgggcaggttaaaggagatagtgaatgccgccgacagcccctggtggttcaccgacagcggggcattggccggctgccatttggcgaagtaggccagcgggatcggcttgccgtcgctgttaatgacgaacatcttatccagggcgctgacgtcctgggtgtaggccggatccacctccatcaccaccttatactggttgagcggctggtagatggtagagatctgccgctggccaaaggcgttgttcagcaggttgttggcgtcctggacgctgatgccgaggcgcgacatggtatcccggtcatagaccaggtccatttcggcgccattgtcctgctgatccgagttgacgtccgccagctccggcagcgccgccagcgctttgcggatcttcggctcccactcgcgcagcgccgacaggtcgtcggacagcagggtgtactgatagctggcgttcgactgccggccgccgacgcggatatcctgcaccgccatcaggaacaggttggccccgggctcgttggccagctttttgcgcagccggtcgatcacctgctgcgccgtctcgtggcgctggtcgcgcggcttgagggtgataaacatcatcccgctgttgacccgcgagccgccggtaaagccggtgacgttatccaccgccggatcttcgcgaatgatcttcataaagtcctgcagcttgccgcgcatcgcctggaaggagatgctctggtcggcctgaatgccgcccatcagcaccccggtgtcctgctccgggaagaaggttttcgggatcgaaatgtagagccaaacgctgagggcgatggtgcccagcaccaccaggccggtcagccggctatgcttcagcacccattttaacgatttaccatagccgccctgcacggccaccagcaggcggccaaagccgcggttgcgcgtcggctggtggggcttgccgcttttcagcagccagccgcacatcatcggcgtcagggtgagggagaccgccagcgagatgccgatcgccaccgacagggtgacggcgaactcgcgcagcaggcggccgggcaggccgcccatcagcagcagcggcaggaacaccgccaccagcgacagactcatcgacagcacggtaaagccgacctcgcggctcccctgcagcgccgcctgcagcggtttcatccccgcctccagatggcgggagatattctccagcaccacgatagcgtcatccaccacgaagccggtggcgatggtcagggccatcagcgacaggttattgaggctgaagccgcacaaatacatcgcggcgaaggtgccgattaaggataccgggacggcgacggccgggatcagcgtggcgcgccccgagcgcaggaacaggaacaccacgaggatcaccagcgccaccgaaatcaccagcgtctgctccacctcctccagcgaggcgcggatggtcggcgagcggtcctgggcgatctgcaggtcgatagccgccggaatggtctgctgcagctccggcaggcgggcgcggatgctgtccaccgtctggataatattggcttccggcagtttgcggatcatcagcaggatcgccggtttggcgttggtcatcccggcgttgcgtacgtcctgcaccgaatccgagacggtggcgacatctcccagccgcaccgcggcgccattttgatagtggacgatcagtggctgatagtcggcggcggtcttcagctcatcgttggtctgcacctgccagcggtgcgcgctgtcctccagcgccccctgcggtttgcgcacgttggcgtcgctgatggcggtgcgcaccgcgtccagcgacacgccctggttaaacagcgcctgcgggttgaggtcgacgcgcaccgccggcagggagctgccgccgacgtcgacatcgcccacgccgtcgatctgcgcgatggtctgcgccagctgggtggaggcgaaatcatacagctcaccctgggagtaggtgtccgaggtcagcgtcaggatcatgatcggcgcatccgacggattggctttgcgataggtcggccggctgggcattccgctcggcagcaggctttgcgcggcgttgatcgccgcctgaacgtcgcgcgccgcgccgttgatatcgcggtcgaagttaaactcgagaatgatgcgggtgctgccgagcgagctggaggaggtcatctcattgaccccggcaatccgccccagggagcgctccagcggggtggccaccgacgaggccatggtctccggcgaggctcccggcagcgaggcgctaaccatgatcaccgggaagtccacctgcggcagcggggccaccggcagcagccggaagccgagaatgccgcacagggtgatggccagcgagatgaggatcgtcgccaccgggcggtaaatgaagagggcgaaaaacttcacttacgcctcctcttcctgacgcgggaagcggcgcttcaggtgcagcgacaggcggtcgaacagcagatagatcaccggggtggtgaacagggtcagcacctggctgagcatcagaccgccgaccatgccgatccccagcggacgccgcagctcggcgccgacgccggtgctcagcatcagcggcagggcgccgagcagggcggcgagggtagtcatcaggatcggccgaaaacgcagcagacaggcctggtagatcgcctcccgcggcggcatgccctgctcgcgctcagcggccagcgcgaagtcgatcatcatgatggcgttcttcttcacgatgccgatcagcagaatgatgccgatgatggcgatcacgtccagctcgctgcccgccagccacagcgccagcagcgccccgaccccggcggtgggcagggtggagagaatcgtgatcgggtggataaagctctcgtacagcacccccagcacgatatacatcgccaccaccgcggcgaccaccagccagacggtgctgccgagcgccgactggaaggccagcgagctgccctggaactgggtgcgaatatcggtcgggaaatccagcgactgttcggcggcgaggatcgcctccaccgcttcgcccagcgagtagttgtccgggacgttaaacgagatggtggtcaccgggaactgatcgaggtggttcaccgacagcggggtaaagcgctgctccaccgtggcgatggcggtcaacggcacgatgccgccgtcgctgctggtgagacggatattctccagcgccgcgaggcccggcgtcgcctcggtatcctgctcgagcaccacgcgatactgattcgcctgagtgtaaatagtggagatcagccgctggccgaaggcgttgtacagcgcgttatcgacatcggccattgagatgccgaggcggctggcgctgtcgcgatccaccttgatataggcggccaggcctttgtcctgccagtcgctgctgacgtcggccagctgcggctgggcctgcagacggctgagcagcggcggtacccaggtgctcagcgcctcgagggagtttgcctgcagggtgaactggtactgggtgcggctcaccgtagtgtcgatggtcaggtcctgggtcggctgcaggtagagcgccacgccggggacgccgtccaccgcctgctgcaggcggctaatcaccgtctggacgcggtcgtcgcgttcgtccagcggcttgaggttgatctgcagacgggcgctgttcagcgccgggttggtgccgtcgacgccgacgaaggaggtcagactctccaccgccggatccttaaggataatactggccacctgccgctggcgctcggccatgctggcgaaggagaccgactgcggcgcctggagggtgccctggataatgccgttatcctggatcgggaaaaagcctttcgggataaagacccacaggataatcgacagcgccagggtgctcagggcgacgccgagcgtcagccacggatgattcagcacccggctcagccagcggccatagacggcgatcacccgttcgaagaaacgctcgctggcccgcgagaatcggttctgcttacgcagcgattcgtggcttaacatgcgggcgcacatcatcggcgtcagggtcagggagaccaccgccgagataagaatagcgacggcaagggtgacggcgaattcgcggaacaggcggccgacgatatcgcccataaacagcagcgggatcagcaccgcgatcagcgagaaggtgagggagatgatggtgaagccgatctcccccgcgcccttcagcgcggcggccagcggcttctcgcctttttcgatatagcgcgagatgttctcgatcaccacgatggcgtcatccaccacgaagccggtggcgatggtcagggccatcagcgtcaggttattgatcgaaaagtcgaggaacaccatcaccgcgaaagtgcccaccagcgacagcggcaccgcgacgccgggaataatggtcgccggcacgttgcgcagaaacaggtagatgatcatcaccaccagggcgatggccagcatcagctcaaactgggtgtcgcgcaccgaggcgcggatgttggtggtccggtcggagaggacctgcaccttcaccgatttcggcaggctctcggtgagctgcggcagcatctggcgaatgctgtcggcggtgtcgatgatgttggcccccggctggcgctggacgttcatcacgatggcccgctgctggttggcccacgccccgagccagctgttttcggccccttgttcgacgctggcgacatcgccgagccggatcggtgccccgttctgataagcgataatcagccggcgataatcctcagcggactgcatctgatcgttagcggaaagcgtcaccgcgcgggccggaccgtcgaggctgcctttcgcggagttaacgttggcgctggtgatagcggtgcgcacggtttcgctggtcaggccgagggcggcgatggcctgggcgttaagcttcacccgcaccgccgggcgctggccgccggcgagggtcaccagaccgacgccggaaacctgggagatcttctgcgccacccgggtctccaccatgtcctcaacctgggtcatcgggatggcggaggaggtgacggcgagagtcatgatcggcggatccgccgggttcaccttgctgtagaccggcgggttgggcagatcgctcggcagcaggttggtggcggcgttaatggccgcctgcacttcctgctcggcgacgtccagcggcagggtcagctggaactgcagcgtgactaccgaggcgccgccggagctttgcgacgacatctgcttaaggccggacatctggccgaactggcgctccagcggggcggtgatggcggaggtcaccacgtccgggctggcacccggatagagggtgactacctgaatggtcgggtaatcgacctccggcagggcggagaccggcagaaagcgatagccgatgatcccggccagcaggatagccaccatcagcagagtggtggccaccggacgcataataaacagccgggacgggccgccggtgcggcctgggggtaacacctgcatcaggaacgcgctccgtgtttaccgctctggcgcggggcgggctgcgcctgctcgccgctgctggcggtgacaacttccaccttcgccccctcggtcaggcggtcaatcccgtcggtgaccacgcgatctccggcggaaagcccggcgctgatgactactttctggctgtcctggatgccgggcgtcacgctgtgtttgctgaccttattctcatcgttcagcacccatacgaaatgcccttcgttgcccatctgcagcgcggcggcagggatcaccaccgcgttctgctgggtgtccaccagcaggcgggcgttaacgaactgattggggaacagcgcgtcgtccagattgctaaagcgcgccttcagcttgatggtcccggtggtcgcatcgatctggttgtcgaggctcagcagctcgccgacgctgattttctgcttattggtgcgatcccaggcttcgacgctgagcgctttgcccgctttttgcgcctgcaccaccgtggcgatgctgctttccggcagggtaaagaccacgtcgatcgggtgcgtctgggtaaggaccacgatcccggtggtatccccgctggagatctggttgccgatatcgacctgctttaagccgacgcggccgtcaattggcgcggtaatgcgggtccagtcgagctgcagctgggcgctggcgacggccgcttcatcagctttcaccgtgccggcggattccaccaccagcgactgctgagtgtcgagctcctggcgggagacgaggttggtcttcaccagctgctggtaacgagcgagatcgcggcgggcgttggcaagggtggcctgatctttcgccagctgaccctgcgcctgggcgagagcgactttaaactggctggggtcgatctgcgccagcaggtcgccggctttgacctgctgaccctcctggaagtgaaggctcagcagttggccgtcgacccggctgcggacggtgacggtgttggccgccgtcaccgtacccagcccggtgagatagcgcgggaccgcttcttcggtggcggtggccgcctgcaccggcgccagcgcggcgccaaagcggccatggcgtgcgccgcccggcccctgcgggccctgtccggcggcgggagccccgctgccgctcgtcccgcgatcgtgccagaaccagtaggcggccccggcgataatcactaccgccagcgcggcgccccaacgacgtatgttactgcctttcattagtttacggtctcatcctgaagcgtttcgctgaatgatactagtttagtgagggaaggggccgtaaaaatggaggaattatgaaaagaaggttgagaaatgtctggataaccgccgcgacgccgggcgctcccgcggccgatatccggggtgatatcaacttttagtttaaaaaagcaaaaaatagttgtatccgcgggggctttaattagatttatgcggtgaataaatcagtgcattctcataataataaaatatgcacttaaaaatcaacgtgttaaataatcaggggtcattgctgtggcaaacgcaaacaaactcacgctcttcatcgtcatttttatgctgatggggatcctctccggcgcggctatccatgcctacgcgacgccaaccaccgtctccgcctgggcggacaacattacgctgctcaccgatctgtttctgcggttgatcaaaatggtcatcgcgccgttggtgttcagcaccctgacggtcggcattatgcgcctcggcgagacggcgaccatcggccgggtaggcggcaaggcgatggtctggttcatcacctcctcggtattatccattctcgtcgggctggtgatcgtcaccttccagcacccgggcgccgggttaaacctggcggtgccgaaagaggcggtggataccggcctggcggtcagcggcatgagcctgaaagggttcctgtcgcacaccatccccaccagcatcaccgaggcgatggccaacaacgagatcctgcagatcgtggtgttctcgatgttcttcggcatcgccggcgcgtcgctgggggagaagtttaatgctccgctggtggcggcccttaacgtggtgtcgcacattatgctgaaggtgacgggctatgtgatgtacgttgcgccgctggccatcttcgccgccatctcgtcggtgattgcctcccaggggctggggatcctgctcaactatgcttcgttcatcggcggctactacctggcggtgctgttgaccagctcggtgctgattgccgtcggctatatggtgctgaaaaaagaggttttccgcctgctgaacatgctgaaagatccggtgctggtggccttcaccaccagcagctcggaagcggcctatccgaagaccctcgagcgactggtgaagtttggctgctcgcgcaatatcgtctcgttcgtcctgccgattggctactcgttcaacctcgtgggctcgatggtctactgctccttcgccgcgatgtttatcgcccaggcctataacgtgccgctgagctttagcgagattacggtcatgatgctgaccctgatgctggcctcgaaaggtatcgccggggtgccgcgttcggcgctggtggtgctggcggcgacgatccccagcttcaatataccggtcgccgggatcctgctgctgatgggtatcgaccatttcctcgacatggggcgctccgccatcaacgtgctgggtaatggcatcgccaccgcgatgctgtcgaaaaatgaagggttgctgaccgacgaggaagcgcagccggactgggaagtggagaaagcggaagcctgatcctgccgcgccctttcactgagggcgctattccacacggaaaaaaagacccctgacaggcacgtcaggggcaatgtgacgaagtatcagttttcctcgtgtagcgtgttttttattatataaagacgggcggtaacgtctttataccgaggaagcgtcagagtttaacgttatgtccgccagcgctggatattttttagcatcctgcgactattttcggatttacgacaatatagccaggtcaatatcttatttttttgtgctgctgtttgcctaccagcgctcacgtaaaagattcataaactggaaaaattcatgattattattcaggctgtatttttccatgatcttattcttatgataggcggcggtgcggggactcacacgctgcagggcggcgattttactcatatccagcccttcgagaataccgtgcactacggcggtctgcgatcgcgataacacgcgatgcggacagctggcgcagctgagttcccggcctgcggcgtcggtagccgtgggggtcatacaatgctgaagctcgcttttaatgatcgtcagcaattgcggaatactggccgtttttagcgaaacaaaaatgacccctttcaggcagttaatcatgaactcatcttccggcagctggtcatagctatggagaataatcagcgagctacctctttttctgttcttaatcagggtattacacaggtatatttccccggggatcacttcgcagataatgatatcttcagctgacagatcggtgttacgccaggaaaaacgcgcccgcagatcgccccgggtgaggtcattgaccatggccaccagcgattcacggacaaaggcgttgcgggtgttgatggtgacattaatgtttctcatggcgttatttccttacgcaaaacataacgccatgctgtgacaaatcctccgggcgtatgcggtgtgttgaagatataaaagcacctacaataattttttattattttaaagtgaattatttacgacgcatcgaacgcttatcgttaaaagtaaatttctgccgcctcctgtctttcagataggaaataaaactgtatacagagatgctgaagaaaaaaatgcatagcaataaaactaaccacgtttgcatggccatcgtttttaccctgattgtgttgcatggtgtcagaatttgccgcgaacggctaatacgttttgttatatgcttttctgtcccgtgaaaatcttacgccatcatcctgatgtgctagcactataagaaagttcttaaggtcatcgtcagtctcattcctctcatttctctcagaaaatgagaaaaattaacacttacgagttttttatatcccgcgcggccgccgacgagccccgtcgttcaggaaataaaggccagtcccttaccaaagattgcgcgaacgggcaggtggatcccctgctggcgtgccttgtgacgcaggcggctaaccaccacgtcgatccggtgcaggtcaggctcgctttcatgggaaaacaggcaggcatggagatccagtttgctgcacacttcgttgcgattgcgcatcaggagctccaccaggcgatattcctgctgggttaactccagcgtccgggcgtcgggtgaaatcagtttatcctcttgcagacgccagctgccgggggagacggccggcggcgtgccgatcgcctccgcaggcggagccgccggacggtcctggcgcaggcgcgcgccgagggcggtgagggtctcggcaagatgggcgaagtttaccggtttgatcagataggcatcggccccaaggctcagcgcctgcaatttatcctgttgctgaccgcgggcgctgaccaccaccagaccgtagtgccccagctcatgcagatagttcagtacgctgaagccatcctcgccgggcaggccgatatcaaccagcacgatatccaccggatggctgtgcagttgccgccagaaggcttcggcgctacgcgtcccccacacctcgaagccgcgatagcccagccaggccagcagttcatccagcagatcggcgttatcttcaattatcgccagccgtaaagccatacgtcgttctcctcttaagcaaccgtggggagggtgagaataaaggtgcagccgtccgggccatgctcggccagccacagtttgccatcatgagcctgcactatctgacgcgcaacatacagtccgagaccggtgccgcctggcaccggcgatgtgtgctcgccgcggcggtagcgctcaaagatcagttccgcctgtccggcggggagtcccgggccgtggtcgcgaatgcgtagctccgtttgcccggcatcggaatgaatatcgatggcgatttcaccggggggcgaatacttgacggcgttatccagcagattagcgatggcgatgcacagcaggccggcatcggcctgcagctgcgggctttccaccgcgccgtgctggcggatgttcaggtagtgatcatgggagatggccaccaccgaggcggccatgttgatcaccgttagcagggcggtctgctggcgctcgacgtgcagatcgtgggaggcgagccgggcgtcggcaaggcagttatcggtgagctgcaccaggcgggtggcggcgcggccgatgcgatcgaagcgcgcctcctggctggtcgaggccgccgagaggcgaagattctccagcgcagcctggatcaccgccagcggggtgcggaattcgtgcgccaccatgcccataaactgccgctggtggaagctggcttcacgctcaatctgcagttcgcgcgccaggcgctgcttctgctccagctggcggttttcagcacgcacccgcaggatggcaatgatcagcaccgtaatgatgtggacgatcagcgcgtactgccagagggaatagatcgccatatggaacgggataatcccatggatcgacaactgcaccagcaccgcggcgacgacatagaacggcggcagcagacccagcagcagggtggtacggtcgatagcttttttgcgccacagccaccaggaggtgaacagcagcaccggggtgataatgatgaatactaccccttcaatctgcatcgcgaagccgtaaaacccgagcggaatactgacctgcagcaccaggttgagtatcacggcggcgatcagcagctgatgaagtcgcggcatattcttcttcagatcaaaaatctcgctatgcagccagagggcggtggcatagctgaacagcgagaggctactgatcataaaatcctggaacggcagcgcggcgtggccgaagaaccactccgggaagccgtgcagagcggccaccagcggataattgagcgagaaaagacagatgccccatagcaaacgccggcgcagggccagcgccagccaaagcgccacaccgctggcgacagcggccaggccgaagtagaagctccagaaagcggtgtcagcggtggcccgctgcacaaacgcctgcgcagaggagagcgaggccagcaggatcagggtgctggtgctctgcaggcgaaagaccagctcatagccggcggcggttggcggcgggggcagtatcagcaccctttcccgataatgcagatcgcttccgcgggcgccgtcgcgatcgccaaagatgcgctgcgtccacgggccatcgctgcccagtggccggtagtaaatggtcagatggtcgacgaaagtggggcccagctgcagccaacgcggctccccggcaaaccacgtgcccggcagctcgctgcgcagccaccaggtttttcgcgaataaccaaaggaggggatctgccgggtggtggcgagctggtctgcgggcagggcggcaaaacgatcgagggtcatctggccgctgtcgtcggcgtaccactgaaccggaatatcaatccccacctggcgcgtcgccgcctgcgcctgcggggcgaccagcagcaagagtaatccacagctgagcagccagcctgccaggagccgcggccggcaacgccggaccgccgcgaagatcgcagacacccttttcaatcacgcccccttgcggcatgcaaagattactgaccgcagacgtctggctacggtatggataatacgcccccggaagcgggggagagtggacaggcctgtccggacgaacaggccattttgcgtgggagaccaggaatattccagcgtaatctgcagcgccaggatcaggacagacctgctgcgcggcagcgccgggcgagggctagcggaaaactacctgcgcccagcgggccagcccggcggtcaccgagccaaaatcatcgccgccggccagcggaatacccggcagctgagcggccagcgcctttttgatcagcggcgaacgggcgctgccgccggtaagatagatcacatccggggtggtctggctgctgtcgagcgcgagccgcacctgttccataatgcgggtcaggggctgatccagcgcggcttccagaccctgctgggcgatggcggtggccagatcgtcctgaataaacggcagcgcggtttcgacgctggcggcgctggagagggcgattttgctctcttcggcgctgcgcaccagacgatagctgagacgctggcgccagaccttcagcagtagagccaccttgtcggcatcccgggcgctgcgcagcagatcgttcagcaggcggccgttggcggtgctgtagaaatcgctctgcgccggcacgtcgttgatcgccaccgcgttccaccacgggaggatcggcagcgcggtgcctttctccgtttcgccacccatgccgagaaggggcatcaggcatttgaaggccagggcaatgtcgagatcgttaccgccgatgcggcagccgctgtggccgagcaggctctgctggcggtcggcgcgctcccgccattgcgggcccatcagcagcagggagcagtcggtggtcccgccgccgatatcgacgaccagcacccgcttttcttcactgagggtcgcttcgaaatcgagcccggcggccaccggttcaaactgaaagaccacatcgcggaaaccggcgcggtgggcggcccgctcaaggatcccctgcgcctgggcgttcgcctcatcgccgccgaggccctggaagttaatcggtcggccaatcaccgcctggtcgatctgctcgggcagctggctttcggcctgcaacttaatatgcagcatcatggcgcagaccaggtcttcaaacagggccacctgctgcggcttcagcccgctggcgccgaggaaggatttgggcgatttaacgaagtagacctcttgcggatcttcaacatactgctgcagcgaggcgagaccgaactgcacgctgttgcgcagcacctcgatgtcttcgtcgcggttggcggcgatggcccgacgcagcagcgcctggttttcgtcgctgtgggtggggacatcatgatggcgatagagccactcgctgaccgcttcgcgcgtcggcgcgcagagcatggagggcagcagggcgctgtcgttttccagcgttaacagctggggggtattttcccgcatcacggccaccgaacagttggcggtgccgtagtcaaaaccaataaacatcgtctgcaaaatccccatgccggtgaagaaggggggcgactttagcggatcgtcgccatgccgacaaccggaatttaaaagcaaggcgctgacggtcaagggcgactatcattgaaacgctatataaaggagagcttatggtgctgttaccctggaccccgccctatgactgggcgtggatggttggttttctgcaggcgcgcgcggttgccggcgtcgagcgttttcacgatgggggctacagccgcagctttggcgtggaaggccaccgcgggctgattcatctggcgccggacgaagaggcgcagggcctgcgggtgaccctttccccgggactgcagccggtagcggagatctgctatgcgcgaattggccagctgtttgatttagcctgcgacccgcggcaggtcgctcgcacgctgggcgatctggcgcaggcgcggccggggctgcgcctgccgggggcgctggatgccttcgagcaggcggtgcgcgcggtgctgggccagctggtgagcgtggcgatggccgcccggctcaccgccaaagtggcggctggctggggcgaaccgcttgcagaggcgcctggatacgtcttgttcccgacgccagaggccctgtcccgggccgatccgcaggcgctgaaggcgctggggatgccgctgcgccgcgcggaggcgctgatccacctcgcccgggcggcgctcagcggcgagctgcccctgacggcgccggcggatattgacgccgggctgcgtcaactgcagactctgcccgggattggccgctggacggcaaactactttgccctgcgcggctggcaggcgaaagatatctttttgccggatgattacctgattaaacagcgctttccgggaatgaccccggccgccatcgcccgctatgcccgccgctggcagccgatgcgatcctacgcgctgttgcatatctggtataccgatgactgggcgccggcggcggaatagccgcccggggcgcataccactggtatcgggacgctgaaatccctataattgccgcgtttggcggtccgccgccaccctccatctctatccaggttaatcaggtcgcaaaaatttatgactgatatgtcccatcagtgcgtcattgtaggcatcgccggcgcatcggcttctggcaaaagtcttatcgccagtactctctatcgcgaattgcgtgaacaagttggcgacgaacatattggcgtcattccggaagacagctattacaaagatcaaagccatctgtcgatggaagagcgcgtcaaaaccaactatgaccacccgagctcaatggaccacagtctgttgttccagcatttgcagatgctgaaaagcggccagccgattgaactgccggtctatagctacgtcgagcatacccgcacgccgaacaccattcacgtcgagccgaagaaggtgattatccttgaagggatcctgctgctgaccgacgcgcgcctgcgtaacgagctcaacttctctattttcgtcgacacccctctcgatatttgcctgatgcgccgtattaagcgcgacgttaacgagcgcggccgctccatggactcggtgatggcccagtatcagaaaaccgtgcgcccgatgttcctgcagtttattgaaccgtcgaagcagtatgccgacatcatcgtgccgcgcggcggcaaaaaccgcatcgctattgatattctgaaggccaaaatcagtcagttctttgaataacctggccgaattgtgtaacgtgcaaagagtagccctgttgccctctccgccgcgaagcgtgcgggaagcagccttataaggagaaagcccatgcgtctgtgtgaccgagatatcgaagcctggttggatgaagggcgactcgccatcaatccgcgtccgcccgttgagcgtattaatggcgcgacggttgatgtacggctgggtaataaattccgcaccttccgtggccacacggcgccgtttatcgatttaagcggcccgaaggccgaggtcagcgccgcgctggaccgcgtgatgagcgaagagatcgtcctgccggaaggggaggcctttttcctgcatccgggcgaactggcgctggcggtgacctacgagtctgtcaccctgcctgccgacctggtaggctggctggacggacgctcctcgctggcgcgcctggggctgatggtgcacgttaccgcgcaccgtatcgatccaggctggtccggctgcatcgtgcttgagttttacaactccggcaagctgccgctggcgctgcgcccggggatgcccatcggcgcgctgagctgtgaaccgttatcgggcccggcggcccggccgtataaccgccgtgaagacgccaaatatcgcgaccagcagggtgcggtggcgagccgaatcgacaaggattgataacgtcaacggggtgttgctgagggtgccatgagacgaatactgacaacgctgatgatcctgctggcggtcattgtcgccgggcttacctcgttggtattgctggtcaatcccaacgattttcgcgcctatatggtgcatgaggtggcagagcgcagcggttatcagcttgaccttgatggcccgctgcgctggcacgtctggccgcagctcagcattctcagcggacggatgacgctgaccgcccgaggcgccgaagagccggtgatccgcgccgacaatatgcgcctcgacgtggcgctgctgccgctgctctcgcatcagctgcaggtgaagcaggtgatgctcaagggcgcggtgatccagctgaccccgaaaaccgaggcggttcgcgacagctcagcgccggtggtgccgcatgacaacaccctgccgctggccccggaggatcgcggatggtcctacgatgtgcgtcagctgcaggtggccgacagcgtgctcttcttccagcatgagaacggcgagcaggtgaccgtgcgcgatatccgtctgcagatggagcaggatgagaatcaccgggccaccgtggatttctccggccgggtgaaccgcgaccagcgcgacctggcgctgaacttctccgccaccgtgcagggcggcgattatccgcactccttaaaagccgactttacccagcttagctggcagctgcgcggcgccgagctcccaccggacggcattaatggtcagggaagtctgcaggccagctggcaggaagatgacaagaccctgcgttttgacaacctgaatctgatggctaaccgcagcaccgttaccggcagcggcagcgtggtgctgggggatcgcccggactggtcattggatctgcacgccaccactctcgatctcgatagtctgctggcgcaaaggtcgccggcgacggacagtagcgccagtcagcagggccagagtcagacacggccgctgcgcccggtgatcgccgacagtgatgagcgcgaagattaccagagcctgcgcggcttcaacggccgaatggccctgagcgccgaccagctgcagtggcgcggtctgaacttcacccaggtgcagagcgaaatcagcaaccagcaggggctgctgacggtcagcaaaatgcagggcaatcttgacggcgggcagctctctctccctggcaccctggatgcccgcggcgacccgccgctggcgacgttccagccggcgctgcggaatgttgagatcggttcgctgatcaaagcctttaactattccttaaacctgaccggcaagctgtcgctgagcggcgaattttccggaacgcgcattgacgccgatgatttccgtcgccactggcagggacaggctcagctccagatggccgatacccgcaccgaagggctgaacttccagcagctggtgcagcaggccgtggagcgcagcaccaacgtgcgggcgcaggaaaattacgacaatgccacccgcctggattccgtgagcagccggctgacgctggataacgggctggtgacgctgaaccgcctgcaggggcagtccgacgtgatggcgatgaccggcgaaggacagctcgatctgcagaaagagaactgcgatatgcgcttcaacgtgcgcgtgctcggcggctggaaaggggagggcaagcttatcgaccgcctgaaacagaccgctatcccgctgcgcatctacggcgagtggcagtcgctgagctacagtctgcaggtcgatcagatcctgcgcaaacagctgcaggatgaagcgaagcagcgcctcaacgactgggttgagcgtaataaaggcagcaaagacggcaacgatgccaaaaagctgcttgataagctgtaattcctaccaccgcggcccggaagtttccgggctgtgtgcttatcgtcaacgtttgatgtcacgatgatgccgggtggcggctgcgcctgacccggcctggattatacggtgggagtcatcccccgattaattcgccatcccgtaggcctgataagcgaagcgccatcaggcagtgtggcggctacgcctgacccggcctggattatacggtgggtgtcatcccccgattagctcgccatcccgtaggcctggtaagcgcagcgccatcaggcagtgtggcagctacgcctgacccggcctggattatacggtgggtgtcataccccgattagttcgccatcccgtaggcctgataagcgaagcgccatcggcagtgtggcggctacgcctgacccggcctggattatacggtgggtgtcatcccccgattagttcgccatcccgtaggcctgataagcgaagcgccatcaggcattaaacaggatatctggctatcaattttacggcccgggataccccgggccgttttatgcctgacgattacacctcataatccagctcatcctgctttaccggcgggacgatctgcaccttctgcacccgatggctgtcgacctgcagcgtgcgcagggtatagccgtcaatctcaatggtttcccccacctgcggcacatgctgcaaatactccatcaacagaccggcaacggtgtgatactcacgtttatcatccagcggcagcggaacgtactgcaccaggtcctccagcggcatatggccattgaccgtccacgaaccgtcctgatgatgctgaatatcgtgccgggcatcgatctcctccacctcattgggcagattaccggcgatggtctccatcacgtcgctgagggtcacaatcccctcgacggagccaaactcatcgaccacaaaggcaaaatgggtgcgggcctggcggaactgctcgagcgccgagaggagcggcagcccctccgggaagaccagcggttgacgcaccagcgcctgcagatccagcggctcctgacgcagggactgctggagcaggtcaataacatgcaccacccccagcagatcttcattatccttcccgccggtgaccaccagccgggtatgctgatttttctccaccaggctgcggatctcttcctccggcgcgctaaggttgatgcgctcgatatcatggcgcgacgtcataatactgctgacgctgcgctgattaaggttcagcacccgctcaatcatcagtctttcctgcggattaaacagtggatgttgatcctgatcggcgaccagcgacgccgtgtcagcatccagttcagctttttctttctgcccgctcagcagattcatcaccgcttcggtagtgcgctgacgcagcgtcatattggcggagaggaagcgacggcggttaaactgcgccagctggttaagggcttcaatcattaccgagaagccaatggccgcatatagatagcctttcggaataataaagctgaagccttcagcaatcagactgaagccgatcatcagcaggaagctcagacagaggatcacgatggtcgggtggctgttaacgaagcgcgtcagcgccttgctggccatcagcatcaggctgatggcgataaccacggcggccatcatcaccgccaggtgatcgaccatgccgacggcggtgatcaccgagtcaagcgagaagatggcgtcgagcaccacgatctgcgccacgacggcccagaatttcgcccctttgcgctgggtggggttatcgctgtctttcccctccagccgctcattaagctcgacggtcgctttaaacagcagaaacaggccgccaaacagcataatcaaatcgcgagcgctaaagctgaagtcgtgaaaaacaatcagcggtttggtcagggtgaccagccaggagatagagaccagaagcaggagacgcatgaccatcgccagcatcaggccagtgatccgcgcgcggtcgcgctgggcgggagggagtttctcggcgaggatagcgataaagaccaggttatcgatacccaacaccagttcgataaccaccagcgtgacgagacctgcccagattgacggatcggcaatccattccatatgtattaaaacctgtacgactgcggtatgtgttaccacgatcatggataagatgagtctaaaatgcaataacgacgcggatatcgccctgccgtggatggatatatttccagtggattaagcgaaccgataagaattatgttccggaaaagaacagtgaaaaaataacaccatggcggcgaccatggaataagcttgccgatatcagaactttttccgctgcgtttcagcgagggcggcaaaagggcttcctcccgcggttcgtcacggtgagcgcggatgcgcagagcagaagcgaagcgcgaagcccgctcacaaaaccggcataattcatattatgaagtgagtgcagaatagggcggatcgcggttcaccgccgcggattcaggctaatatgtcgtcatatccggctgtttatgctgaaatatattgcctggcgaaatttattatctatatctattctttccgggcatacgcgcggtgcggcgggtccggcggccaacagactccgatggacgggcctctcagccacatcgcgcggcgcaaaggaacgagccgctgaataacctgaacgagaataagattattctcacttctaactgttgataaaagggagttgtgtgtattcttttacgtgacagtgaatttaagaatttggcgggcagatgcctgggcagtatccgtgtattatcagtttcaatggatttgtgacatgtacaattttgcaaaaccgcgtgttttgcaaccaaacaggtgaagatgaatatggcgaatttgaaagcggttattccggtcgcaggactaggcatgcatatgctgccggccacaaaggcaattccaaaggagatgctgccgatcgttgataagccaatgattcagtacatcgttgacgaaatcgtcgccgccgggatcaaagagattgttctggtgacgcactcctcgaagaacgcggtggaaaaccacttcgacacctcctacgagctggaagccctgcttgaacagcgcgtgaagcgccagctgctggcggaagtgcaggccatttgcccgccgggcgtgaccatcatgaacgtgcgtcaggcgcagccgctgggcctgggccactccatcctctgcgcccgcccggtagtcggcgacaacccgtttgtggtggtcctgccggatatcatccttgacggcggcaccgctgacccgctgcgctataacctcgccgctatgatcgcccgctttaacgagaccggccgcagccaggtgctggcgaaacgtatgccgggcgatctctccgaatactccgtcatccagaccaaagagccgatggtggctgaaggccaggtggcgcgtatcgtcgagtttattgaaaaaccggacgaaccgcagaccctggactccgatctgatggcggtggggcgctacgtgctgtcggcggatatctgggccgaactggaacgtaccgagccgggcgcatggggccgtatccagctgaccgacgccattgccgaactggcgaagaagcagtccgtcgacgcgatgctgatgaccggcgaaagctacgactgcgggaagaaaatgggctacatgcaggccttcgttacctacggaatgcgtaacctgaaagaaggcgccaaattccgcgaaagcattaaaaaactgctggcctgagcgccagcctgaaaccgagcggcaaggctgaagcattcgtcctgccgctcataacgttatgcagaaattattcataacgtgaatgttataacgattgtaaagaaacgtatggcttcggagacttctggtagtttgtctctggcctctgtggtgcaatggtcggagtagcggcaataatgctttatgaatagtcacttagtgcgacaattcctaaagcgaagggaaagcggtcaacgacagccaaaaataaaacttgactgcgatcatgtttccgctttaaacatctcacttgcatgcataaaaatgtgaaatgaattggcatgcgagctggtacagacattacggataatccctgagcacggcagtggacatcatcgaaggatcacaggtatatgaactggcaactcatctcattttttggcgatagcaccgttttgctgcccagcgcagcggcgctgtttattgtcctgatgctgcgtaaaacgtcgcggttgctggcgtggcagtggagtttgctgttcggcatcaccggcgctatcgtctgcgcctccaaactggcctttatgggctggggtctgggtattcgcgagctggattacaccggcttcagcggccactccgcgctctccgcggccttctggcctatcttcctgtggctgctcagcgcccgtttctccgccggtctgcgtaaagcggccattattaccggctatgttctggccgccgtggtgggctattcgcggctggtcatccatgcgcattccgtctcggaagtgatcgccggcctgctgctgggcgctgccggcagcgctttgttcctgctgctgcaaaaacgcacttctgactgcgattataagacagtaccctggggtggaattgcatgcctagtaatggtcccactgatactgttgcatagcggcagtaaagcgccgacacagaccctgctggggcaaatcgccaccgcaattgggccgctggataaaccttttaccagagaggacctgcataagcaggcctggtaatcgccatttgttttacaggggaaattaagttttcgccggttaattagacaaataagaaaataatctactatatacccggtaattgataattcatatttatgaaataatgaagtgctactacattgttaatgcatatttgtctggatatagctttgatcagacgtttcttaaatgcgctgagacgttacctgatgcacattcaatgaatatccagatactggaaactattagaaattgtagttgactataacgccatcatctgatttttgcatgaagatgagctatgggaaaagacgtttttttacagtcagttagctacatatgtgatgatgtagcagtaccgggaagatttctaaccctggaagtcagtgaataatcttaattggtgacccgcttattttttgtcagtagaacgacaggcggcattaattggcagatattcggtaacaacactcccaattgtgaccgaaatcccgtaaacttaacgccgccaaaaataatggcctgaccaattattcatccacaggtcgataaaaaattaagtcgttcaggtagtcagtgcgctggtagctgttaagccaggggcggtagcgtcgctgaagccgcttgctgctgcacagaggttctcttcaacggctgtaaaatcgtcccggtcaggatgatcgccctcaatagatatctatcaattttctacggatatcctcagaagttggccaggagcggctgctgatatcgcctggacattaactttcctgtctcatcgatagcctgtagggtaaaattcgcctacattgtgagctgagtggatgttataaggctaacaagcagcttagggtaaatgtacttgcctcgccggtgttgcacagcgaagtcagctggtgccgcgagcgctttctatcttggtattcccctcattctcattgagatacgacagcggggctgaaaatggatcttgtacaatgataaaaattgcgcgcattgccgtgacgttgggtttgctttcctcactgggagcccaggcttacgcggccgggttagtggtaaatgacaacgacttgcgtaacgacctggcctggctttccgatcgcggggtcatccatctgagcctgtcgacgtggccgctgagccaggaagagatcgcccgggcgctgaaaaaggccaaaccttcctactcttctgagcaagtggtgctggcgcgtatcaaccagcgactgtctgccttaaaagcggatttccgggtcaccggctacacttcaaccgatcagccgggcactccgcaggggtttggtcagacgcagccagcggataactcgttaggcctggcattcaacaacagcggcgagtggtgggatatccatctccagggcaacgttgaagggggagagcggatcagcaacggatcgcgcttcaacgccaacggcgcatacggcgcggtgaagttctggaaccagtggctctcttttggccaggtaccacagtggtgggggcctggctatgaaggtagcctgattcgcggggatgcaatgcgaccgatgaccggtttcctgatgcagcgagccgagcaggcggcgccagagacctggtggctgcgctgggtggggccatggcagtatcagatctctgccagccagatgaatcaatataccgcagtgccccatgccaaaattatcggcggtcgtttcactttctcaccattccagtcactggaattaggtgcgtcgcgcattatgcaatggggggggcaagggcgccctgaatcactcagcaacttctgggatggtttaacaggcaaggataataccgccgcaaacgatcccaatgaaccggggaaccaacttgctgggttcgattttaagttcaaactcgagccgactcttggctggccggtgagcttctacgggcagatgatcggcgaggatgagtctggttttttgccttcagcaaatatgttccttggcggtgttgaaggacaccatgggtggggcaaagatgcggttaactggtacgtggaagcgcatgacacgcgtaccaatatgagccgaaccaattacagttatacccatcatatctataaggatggctactatcagcagggctatccgctgggtgacgcaatgggcggggatggtcagcttatcgcaggaaaagttgagcttattacggaggataaccagcgctggagctcgcgcttagtatacgcgaaggttaaccctgagaatcagtcgatcaacaaagcgttccctcatgcggatactctgaaaggtgtacagctgggctggagcggagatgtttatcggtcggttcgtttgaatacctccctctggtacaccaatgctaacaatagcgacagcgacgacgttggagccagcgcagggatagaaataccgtttagtttataaggctgaatgctgaaaacaggggagagagggtggtagccctgcaggacgcagtcagcttttatctctccacaagccggcagggaagtaacggctatgacagctgctcaggaattggcaaattttgatttactgatgatgtgacattatgaagaaaaaacttgttagattttcggcattagcattggcaattgggtttttatcgggttgtacgattatccctggtcaaggattaaacagtctgcgtaagaacgtagtcgaacttccggatagcgactacgacctggataaactcgttaacgtttatccgatgacacctgggttggttgatcaattacgacccgaagcagtgttagcaaaatcaaatcccgatttagatagactgcttggcaactatgagtatcgaattggtgtaggcgatgtgttaatggtgactgtttgggaccatcctgaattgactacgccagctgggcagtaccggagtgcaagtgatacaggcaactgggtgaactcagatggcacgatattttacccgtatataggtaagattaaagttgcaggtaaaactttatcacaagtacgtcaggaaatcgcaagtcgtctaactacttacatagaaagcccacaagtcgacgtaagcattgcagcgttccgttcacaaaaggtatacgtaacgggggaagttgcaaagtctggacaacaacctataacaaatattccccttacgataatggatgcaattaatgccgctggcggtttagcaccggaggcggattggcggaatgtagtattaacacataatggaaaagacataaaaatttcattatatgctttaatgcaaaaaggcgacctaacacagaaccatttattgtatccgggtgatatactttttattcctcgaaacgatgatttaaaagtatttgtcatgggggaagttggtaagcaaacaacactcaaaatggatcgcagtggtatgacccttatggaggctgtcggaagggctgagggaatatcacaggcgatgagtgatgcaactgggatatttgttatacgtcaattaaaaaataataatggcggtaaaatagctaatatctatcaactcaatgcgcaagacgcatcagccatggtattaggcactgaatttcaattagaaccttatgatatagtttatgttactgcagcgcctattgtaaggtggaatcgcgttatatcacaacttgttccaaccataacaggtgttcatgatatgactgaaactgtccgttatattaaaaattggaattgattatgtttgactcgattcttgttgtttgtactggtaatatttgtcgctctccaatgggagagcgatatttacaaagtttgctacctaacaaaaaaatagattcggcaggaactggagccttggtagggcatgaagctgatcctactgcttctcgtatagcacaaaattatggcatatccttatcaaatcattgtgcaaaacaattcacaagtactttaggaagaaaatacgatctcatattagctatggagaaggaacacatagagaaaataagtcaaattgcacctgaagttagagggaaaacgatgctgtttggccattgggcagaatataaggatatacctgacccgtatcgcaaaagtgaagaggtatttactttgatttttgaattaattaaacagtccggtgatatctgggccaaaaaactgagcgtataacaaccggggtttaatacatgtcatcacttaaaaataagccagaaaacaaagatgcagatgaaatagatttgagtcgtttatatggtgaacttatcgatcatcgtaaactaattatatcagtaactgctttttttactttgattgctttagtctattcattattttcaactccgatctatcaagctgattctctaatccaagttgaacaaaagcaggcgaatgccatattgagcaatttgagccaaatgcttccggatagtcagccacaatctgcacctgagatcactcttctccaatcaagaatgattttagggaaaacggttgacgatttgaatctgcaagccaaaattaaacaaaattattttccgattttggggagaggattttcacgtctctcaggagataaaccaggtattataaatgtatcaagattatatttacctaaaaccgatgatgacataccagaattaacgctaacagttattgacgcaaataaattcactattcagaccgattcatttgaagctgaagtaaaagttggagagttatttgagaaaaataacatttcgttaaaggtagatgaaattcaagcaaagccaggtacttcatttacggttgaatatctaagcaagctaaaagctattaatgatttaagggatgtgttgacagtaagcgatcaaggtaaagatactggaatgcttacattgtcattgacaggagatgatcctgtacagattaggaaaatattagatagcatcagtaataattatttgatgcaaaatattgacagacaagcagctcaagatgctaaaagcctagagtttttaaataggcagttaccacaagtacgtcatgatttagatatttcagaagataaattaaataaatacaggcaacagaaagattctgtagatttatcgcttgaagcaaaagcagttttggatcaaatagtcaatgttgataatcagcttaatgaactaaccatacgtgaatcagaggtatcacaacatttcacgaaagagcatcctacttataaggctcttatggagaaaagagtgacgcttcttgaagagaaagccaagctcaataaaagagtatcggccatgccagaaacacaacaagaggtgttacgactaagtcgtgatgttgattctggtcgcgctgtgtatatgcagttattaaatcgtcaacaagaattgaatattgctaagtcaagtgctattggaaatgtaagagttattgatgaagctgtaacacaaccaagaccagtagcacctaaaaaaatattaatagttataggtggtattatatttggcctgattgtttcagtggcaattattgctttgagagttttcttgcgccgtggaattgaatcgccagagcaattggaggtactaggcattaatgtatatgctagtattccagtttctgagacatttgcaaagaatatcacaaagggtttaaaatctaataagaaaaagagtctggagtatgacgagtttctggccatccaaaatccagctgacctcgcaattgaagccatcaggggattaagaacaagtttacattttgctatgatggaagcgaggaataatatacttatgatttcaggggctagcccaaatgcaggcaagactttcgtaagttcaaatttagcagcaattatttctcaaacaggtaaaaaagttctcttccttgatgctgacttaagaaaaggttatacgcataagttattcaatgtatctaacgaaaacggtctttcggattatttagcaggaaaagtagatataaaaaattgcgtgaaacaaattaaaacagctggctttgatttcatatccagagggatggtgccgcccaacccagcagaattattaatgcattcaagattccagaatcttctttcatgggcgagtgacaattatgatttagtaattgtagatactccgccgattttggcagtaacagatgcagctattattggcaattatgcaggtactactcttttagtcgcaagatttgaacaaaatacagtaaaagaaatagaagtcagtgcaaagcgctttgaacagagcggagtaatgattaaaggctgtatattaaatggagtggtaaagaaagcaagcagttattatgggtatggttatagccattatggctattcttactccaataaagagtaaagcacaaaccatcagtacagtattcacaaattgtactgatggttgattctaactttaatgaaagtgatttgtttatgagaataatgattttaaactctctttattatccttatagagtcggaggtgcagaaatatcagttcaattattagctgaacaattagttaaattagagaatgaagtaaaggtaataacacttcatgataaaaaagaaataaaaacagattttgtcaatggagttgaggtcacttatcttcctcttaagaatatttattggggtttccccaacacaacaacatcaaaatttaaaaaggccatctggcatttcattgattgttataattttgaaatgaaaaaaatggtaagcgtacagatcgcgcaatttaaaccagatatagttcacacaaataatatatgtgggttttcggtatcagcatgggatgctgtaaaaaaagcgaaggttaagcttgtacatacttctcgtgattattatttattccatccgaacagtacactgtttaaaagtggtaaagtaatgtcaccaagttctttatcagttctattttggagttggtttaaaaaaataaaaagtaacaaagtagataattatattggcattagtaaatatattactaatttacataaggattgtggcttttttaaaaaagccacttcggattttatatataactcagttactccgtatgtgccgaaaaaaaatgagagcgataaaataaggatcggttttattggtcgattgtcggttgaaaaagggtttgatgtatattgtaaagtagctagacaatataaagacgtaaatgaactgaagttttatgccgcagggaattttcaggctggaaatgatagcaatttacttaaaaaagatgccattgaaagctccgttgaggttttgggttatatggatttggcggaattcttggaactggttgacattgttattctaccgttgaagtggaatgaaccttttggccgtacagttgttgaatgtgcattggcaggaaagtttgttatcacaacttctatgggagcaatgattgaattggctcagataatgccaaatgtttccatcataaatgatatcgagcatgaattagatatctttcaaagatatacacttcatcaagatttagcagatgatgtcaaacagctatttgatccagataatattgccaaacaatatataaatcattataaaaaatagcctaaatgagagtttaatatgacattgcaatcatttgaatcaagattaataaacttctcattacttttatttttactatttgagtttttcgcaggaccattacgctggttgttccatttgttaggtgctgagcttttattttctatacctaaattgttaattttaattactatcctggtttctgttttaaatattatttacaaaagaaaaataacaaaaaacggattaatagcctcaatttccatcatatacatattattagtgagtatagtacatgttgaacttgcagcaggttttgttgctttttggggaattatacccatattccttgggtatcactcagctaggattatatttgaaagtgtacaaaataataaaactaataatataatttattttgttttttatgtttcatgtattggtgtattttgtaatattatattcaattatccttggtatgatgtttcatatgagattgcaggcatggatgtgtcatctgctcaaatgggaacgactggtggatatacaagatatgcgggtttttttaaaagttcgcttcaagcttcatcaaatattttaatattgttggtttatattgttgcatcaacaaaaaataaattctttattcttgtgtgttttattcttagtttgttggtgtcaataataacaatatcaaagacaacatttgcattgcatttgatattgctgttttacgtatttatgaaaattttacctgttaaacttttatggagaagtactcttatatttgcaattgttgtcacgtttttcaccattatgtccacgaactattcctttgaaatgaataatgatcctgcaactactatgttattaggatctttaaatgcacgtttaaccactacgtggccagatggtgtcgagtcaatattaaaatttggcagcttaacgttcggtgctggactaggtacaatcggggttggctcaaaactgggatcagggacttacaatcctggtgatagcatgtatctttatattattgctacaggaggatatatattaggtatatatttattgggatggttatattatcagtctaatattttaaataattctgctatttctcgattcctttctatgactcttattatactttgtttattcggaatttcgatgaccacgccagagtatcctcttatggggtttgcattgggtgtaatatttaacagcagagcaagtaatttacaatataaagaagctgagtgattatgaaaaaaatagttaattttgattctcgttggattggtgaacatggtatagggcgttttgcgaaggagattcaagatggtatacctgctttaaataggataaaagtagctattaaaccaacaagccctttcgatgttttttttgttactctatatcttatgtttaatagaggttattatttcacaccagggtataatgctccttttttccatcttaatcgtacagccataacaattcatgatcttaatcacatagacattgattttaactcaagtgttcttaaacggttgtattacaatttagtattaaaaagagcatgccggaaagcacgagttatattaaccgtttcagagttttcaaagaaacgaatatgtgaatgggctaaaattaatcaagataaagtaaaggtagtagggaatggtgtttcaaaagaatttaatttagaggttaacgggcttaaagaaaattatattttaagtgttggtaatcggaagaagcataaaaatgaaattgcagtgttgaatgctttctgttctgcaaatattccagaggctgtcatgctttattttactggcgagagaagtgaggaactattaaatcatgcaaaaaaattaaatatatcgaatcgaataaaattcatggggcgagttgataatgaaacattagctcaattatataaaggagcaaatatgcttcttttcccatctctgtatgaaggttttggtttacccgttatagaagcaatggcttgtggaactccggtaattacctctaatgtcacatctttacctgagattgctggtgatgctgcattattagttgatcctataaatcacggagatataagcttggcaattgaaaaaatttattatgacatagcgttgaggcaaaaattagttgaggaaggattaaaacaagttaagaaatttacttggcaaaaaaccataaataatgtcaagaacgaactagagacagcatttactattaaattataggtattacaatgctaaaaaatactatgaataagttattattttcagtatctataattctcagtttaaactctcctgttgcttcatcgttggaaattggaattggtactcattttcaatcatatagttcaactcccgaaacatatatttcattaatcaaagaattaggttttacatcttttcgcgatgattatccatggtcgaaaacagaaggcagtgaaggagtttattctgtttctaaatttttgaaaaaaacagattatgctttacttaatgctgacagggatggtttgaatccactcgttattcttgattatggtaataagttgtataataacggaggttatcctacaactgaacgtgacattcaagcatttgctaattatgcgggatgggtatcgcatcgttataaaggaaaagttaaatattatgagatatggaatgaatggacgatagctactggcatggttaaataccgaaatcaagttccttcggccaatgtctattataatttagtaaaaaaaactagtgaagtaataaaaaggaatgacccgaatgccatcattcttgcgggttctataaatcctctcgatttaagagcaagatatattgatgttaatgattggaaatggtttgagcaactagtaaacttaggaattttgaattatattgatggtgtatcattgcacacatattcatttatgaatggtaatccgctgttacgtacaccacagggtaatcttaatcgtatagatgcattccatacttactttactaaaaaaacagggaggagcatagatgtatatataactgaagcaggggtgacgaattatgatgggcctggaggaatggatttaatacagtctgcaaattttattaaagaatatactagcctagtcaaaaaacgatcttatattaaggggctttggtggtacgatcttattgatgatggaacagatattaaaaacaaagagcataattttggtttcttcaaaaataatttggaaccaaaagcttcagctgaatttatgatggcaaagtaataaggcacgattaaatgtattatataaaatgcattttttatatttcttaatgccgcatcactataacgagaacaaaaaataatgagatcaaaaaaaatgacttcattttgttgttttgcataaatttttgtaacaacactcattgttaaagaaaggttattgactcacaaagtttttttagtttatgaatgtaacatgtttatattgtaatagattgagttattgactttttagaataaaaattgaatattttcacaattaaggattaattcatgcataatttgaatattggaattgttgctgactggttggtcacgtacgcaggttcagaaaaagtaattaaagaatttttagaagtgtttcctgaaagtgaattgtattcaattgttgattttctatccgatgaggatagagttaatttcaagggaaagaaagcaactactagctttatacaaaaattccctttttctaaagttaaataccaaaagtatctaccattcatgccattagctatagagcaacttgatgtttcaaaacatgatattatattatctagcagtcatgctgttgcaaaaggtatcataacaggtcctgaccaattacatatatcttacatacattcgccaattagatatgcctgggatttacaacaccaatatattaaagaggcgggtttggataaaggtatgaaaggaatggttgctcgatggttattacataaaatacgtttatgggattgccgtacatcaaatggagtagatcatttcattgctaattctgagtttatatctagaagaatcagaaaagtatatggacgtgaatcaaaagtaatttatccaccggttgatgttaatagattcgggttatgtgaaaacaaggatgattattattttacagcatccagaatggttccttataaaagaatggatttgatagttgaggcgttctcacaaatgcctgataaaaagcttgtagtaataggtgatggttcagagatgtcaaagattaaggcaaaagcttcaagtaatattgaactattaggatatcaaccaaattcagtgatgcaagagtatatgcaaaaagcaaaagggttcgtatttgcagctgaagaagatttcggcattacgccagttgaagcgcaagcgtgtggaactcctgtaatagcttttggcaagggtggagcattggaaacagttcgtccatgcggggttaataaagctactggtgtatttttttataaacaagaaattaagtctcttgtaaatgctgttcaggaatttgaaaaaaatatcgatgtatttaatccacaacattgcagagaaaatgcaattcgcttttctgaggaaaggtttaagcaagaaataacccagttcgttgatcaaaaatggtccgcctttaaaaataacaaacaaattatatactagttactactatcattacttctgttattatttgtttttatacaaaaagagttgataagtaatattattttatattacttgggaaataatttactcggtgaggatatatgtctcgtctagctcgaaatttttggacaagtattttattagcgatatctgatttcactggttttacggttgctattgtattcgcaatcttttttgtgaaatcttttatgaatgatggcggacatattattgctaatagcaatattaatgattgggttattctccacacttgtttaggcatatgttgtgtggcgtggtattccattcgcctaaggcattatttttacaggaagacattctggttcgaattaaaagaaatattacgcaccttagttatttttgcaataattgaaattgcagtgttatcatttgcttattgggatttctcccgttatattttggcagttacatggattttcgtattattttttgtccctacatttcgtatgctcactaaaaagtgtttgaatttttttggattatggaagcgtgaaacaataataattggtgatggaaataacgcagtagaagcgtggaaagcaataaatagtgaatcaaacttaggttttaatgtaactagttttgtttcaagcacatcaaaagatcacctcaaaaatcacattaacgatattcctgtaatatctttaaatccaaaagaagtaacaaagcattttgataaaagaacacaattcattgtcgctttagaaactagtgaaagttcgatacgtaatgattggcttagagaatttcttattaatggttttagatatgtatcagttattcctacgttgcgtggtgtgccattggatagtactgatatgtcttttatttttagccatgaagttatgattttccgtgtacaacagaatttagcgaaattatcatcgcgtattcttaaacgtttgtttgatattataggttcactcaccataattcttgttagttcaccattattaatttacattgctttgaaagtaaaaaaagatcatgggcctgccatttatggtcacgagcgtataggtaatggcggaaggccttttaaatgtctaaaatttagatctatggttgtcaattctaaagaagtgcttgagcaacttttaaatactgatcctgctgcacgtaaagaatgggatgcgacttttaagttaaaagatgatcctcgaataacggatattggtaagtttttacgcaaaactagtttagatgagctaccccaactttttaatgtacttaaaggtgaaatgagtttggttggacctcgaccaattataaccgcagagcttgaacgttattctgacgaagtcgactattaccttcttagtaaaccaggtatgactggtctttggcaagttagtggaagaagcgatgttgactatgaaacccgtgtctatttggatgcatggtatgttaaaaactggtctatgtggaatgatatagctatcttatttaaaactataagtgttgttttaagaaaagatggagcctattaattgttttttgaatatttgatctaatttaattgtcgagggaataatgaaaatattactagttggaaatcatacttgcggtaatcgaggtgatggtgcaattctcagaggattagtggattctataaaacagatcaatccagatgtagaagttgatattttgagtcgttatgcaaggagttcagcctttttactaggaactgctattaagcaagatgtcctatattcatcaagaatgaataaaaatggtgggcttgttaaaaaagttatttggaagatcaagaatagtattcttcctgatatattagtttcgcatgcaaaaggcaaaggttttttaaagtattttcctttgccaaataatgttgttgaatttattaaagatcttgaaaaatatgatgctgtcattcaggtcggtggttctttctttgtcgatttatatggcactggacagtttgaacatatcttatgttcaaatatagcgggtaaaccaatatatttagttgggcacagtgttggtccttttgagaatcctaaattccagcatatcgcaaaatattgttttactaaagcagagaagataatactacgtgaagatgttagtttatctttgatggaaaaggataacttcaacttaaacaatgtaacattgggtgttgatacggcttttttggtggatacagaaaaagatgttaatgattatgctgtttctcattggaaaaagataattaaagaacagaaaacggtagctttaacagttaggaaactagctcctttcgataaacgtttaggtgtttctcaagatgactatgaggcttcaatcgcccgtattgttgattatttgaaccaattaggttatcaggttataatattttcaacatgcactggcattgaaagttatcatagtgatgaccgaatggtagccctttctgttaaaaataaagttcatgatagtcaatgttgccatgtcgtaatggatgaattcaatgattatcaattagggattttattatctaattgcgtctttacaataggtacaagattgcattctgctatcatttctatcaattttggaacacctgcaatagcaattaattatgagcataaatcgttgggtgttatgcgtggattaaaaatggatgtgctatcagctgatgttagcgatgtcattgatgggacattgattaataaaatagaagatttaattgctaatatggctgatattgaaaattccttaaaaaataacttacaagatgcaaaaataattgggcgcacaatgattgaaaacattctttctgagattgatagataatgaaaatactttttttttgtattcgattcccactcgcttctgaaacttttgttttaaatcaagttatttcctttattaaaaagggttatgatgtaaaagtattgtctttatatccgggagatactgaaaaagtacatggcgattttgaaaaatacaacataggtgctcttatagaaaatatttttgacgctgatgaaataccgggtaataaattatcccttatcttctcgagagcaaaaattgttttaaaatcaagttcatttagtattattaaagcattcaactttgagagatttaaatttttatcctactcattattattacctgcgatttttgcaaagttaaggaataataaaatttcaacggatgttataattgctcactttggtcattgtggtgtgcttgctaacgcaatcagggatatcgggttaattaatggtaagcttttgactgtattccatgggtatgatatttctacaattagccttcttaaaaaatataagattttatataaaaatttattttctcagggtgaatacttcttacctataagtaacttatggcgagataagttaatcagtatggggtgtgataaagataaaatatcggttataagaatgggaattaaaatagacgaatttaaatatgaatttcatgcacgtgatcaatcaactttaaacattatttccgtctgcagattaactgaaaaaaaagggctggtatatgctattgatgcttgtaatgcgcttaagaataaaggatgcaaatttaaatataaaataattggttatggagaattagagaatgtgctagccgaaaaaattaaagcactaggacttcaggattatgtctatcttttaggatttcagccacaatcagtagtaaaaacagctcttgctgagagcaatgtctttttgcttccatccgtaactgctagtaatggtgatatggaaggaatacctgttgcacttatggaagcaatggcgtcaggcttaccagttatttccacttatcatagtggtataccggagttaattgatgatcataagaatggttatctttgcccagagcgtaattctgaagctatagcaaaaattttatatgaaatatatgaaggaaaagataatctatcattaattgcttctgaagcgcgtgataagatttattctcagtttaacgaggaggttgagttcaacaaaatcgtcactttgctggagagcattaaatgagtggcattaaaaaacaagcaatttggttattaggatccaatacaatttctgccattcttcagattctacaaattagtttgctagctcaccatcttaaactaagtgagttaggagtactagctatagtcaatatggtattgatggttgcgatgatcttgcaggatatgggaatgagcagttatatagttcatatgcaagaaatgacaagaagagatcagagtactatttattggatcaacctgttacttagtttcctgacagggtgccttgttttcgttgcgtcttggcctatagcaactttttacaatatgcctgacttaacttttttagtaatgttggcaagctttaattttctttttctaggatctctatcgcaatatcaatcgcactacataaaagcaaaaaaagttatacttttggctaaaatagaaatcatttctaaaattatttcttttttattcgttttgttctcaattttaaagatggaactgagaactgaggctgtgatttatggtctgattattaattcttttgctcgtctttttttaatgtcattattaggtgataaatcttggcgacctacttttgagtttaattctgctatatgtaagccggtttttaaatatgggatctttcaattaggctcacagattctaaatcaatttcgcacacaattagatgttattgtaattggtaaaatgctaggtgcggattcacttgggttatattctttagctaaagatctcatcatgcaacctctaaagctgattagtcccgtaataaatagattggctttgcccagatttgcagaggttcaaaatcaatctgataaacttggtggtgcatatctgcgtggaacatctgtaattctgttgtttagcatgataacttttttctctatttatttgttggggccagttataatcaaaattttatatggttcaagtcgcatgggggtttttaatattctaccatatatgcttttgtttggtgttttaagacctatgggtgggttaacaggcgctgtggctcaagcaaatggcaagactaacattgagttcagatggaatgttatagcaacttcgattgttttgggtgttactactactgttttttttattcctcagttatggtatgtttcgttaagtctttcactttctcagttattgattagtttttttgtttttccttgttttataaaacctattgtagatgtgagttttaaatcatatttatataaatggtttccacaagctttatgctttatatgcttgatttatattgtcaagttttttgatctcgtgctttaccccttttggtgaatttcagaccaaaaattttaaaagcactaaacatctaaagatgtcctttgccatacgttgaccttacgttaatattatatgtactttaccctgcgagaatttcgcatagagcacacctgacaggagtatgtaatgtccaagcaacagatcggggttgtcggtatggctgtgatggggcgtaaccttgcgctgaacatcgaaagccgtggttataccgtctccgtttttaaccgctcccgtgaaaagaccgaagaagtgattgccgaaaatccaggcaagaagctggttccttactacacagtacaagagtttgttgaatccctcgaaacaccacgtcgtatcctgttgatggtgaaggctggagctggcaccgacagcgccatcgattccctgaagccttacctcgacaaaggcgacatcatcattgatggcggcaataccttcttccaggacaccatccgtcgtaaccgtgagctgtctgccgaaggttttaactttatcggtaccggtgtttccggtggtgaagagggggctctgaaagggccttccatcatgcctggtgggcagaaagaagcctatgagttagttgctccgattctgaagcagattgctgcggttgctgaagacggtgagccatgtgtcacctatatcggtgctgacggtgctggccattatgtgaagatggttcataacggcatcgagtatggtgacatgcagctgattgctgaagcttatgcgcttttgaaaggcggtctggcactttccaacgaagagctggcgcaaaccttcaccgaatggaacgaaggtgagttaagcagctacctgatcgacattaccaaagatatcttcaccaagaaggatgaagaaggtaagtacctcgttgatgtcattcttgatgaagcagcaaacaaaggtaccggtaagtggaccagccagagctcactggatctcggcgaacctctgtctctgatcaccgagtctgtatttgctcgttacatctcttcgcttaaagaccagcgtgtagctgcttcgaaagtgctgagtggtccgcaggctcaaccggccggcgataaagcggaatttatcgaaaaagttcgtcgcgcgttgtacctcggtaaaatcgtctcctatgctcagggcttctcccagctgcgagctgcttctgatgaatacaactgggatctgaactacggcgagatcgctaagattttccgcgctggctgcatcattcgtgcgcagttcctgcagaagatcactgatgcttatgcgcaaaacgctggcattgctaacctcctgctggcgccgtacttcaaacagatcgctgatgactatcagcaagcgctgcgtgatgtggtggcttatgccgtgcagaatggtattccggtaccgacgttctctgccgcgattgcctactacgatagttatcgttccgcagttctgccagctaacctgatccaggctcagcgtgattactttggtgcgcatacctataaacgtaccgataaagaaggtgtattccataccgagtggctggaataaatttattcaaacagtcaggccatttggcctgactgtttttaattttatatttaatgttgcaacctgaccttaagcattacctttctaaaaatatttctaatatctaattttaatctttttaagaatttgccatatttattatcttgtacgcctatattaatctacttctggcctcagtaaattactgggtgttaaataacagggttttaattaaaggaaattaatatgttacttcctgtgataatggctggcggtaccggcagtcgtctctggccgatgtctcgcgagctttacccgaaacagttcctccgcctgttcgggcagaactccatgctgcaggaaaccatcacccgactctcgggccttgaaatccatgaaccgatggtcatctgtaacgaagagcaccgcttcctggtggccgaacagttgcgccagctcaacaagctgtccagcaacattattcttgagccggtcgggcgcaacaccgccccggccatcgccctggcggccctccaggccacccgccacggcgacgacccgctgatgctggtcctcgccgccgaccatatcatcaataaccagccggtcttccacgacgccatccgcgtcgccgagcagtatgccgatgaaggccatctggtcaccttcggtatcgtgccgaatgccccggaaaccggctacggctacatccagcgcggcgtggccctcaccgacagcgcccatactccgtaccaggtggcccgtttcgtggagaaaccggaccgcgagcgcgccgaggcctacctcgcctccggggagtattactggaacagcggcatgtttatgttccgcgccaaaaaatacctctccgagctggccaaattccgcccggatatcctcgaagcctgccaggccgcggtcaatgccgccgataacggcagcgacttcatcagcatcccgcatgacattttctgtgagtgcccggacgagtccgtggactacgcggtgatggagaaaaccgccgacgcggtggtggtcggtctcgatgccgactggagcgacgtcggctcctggtccgccctgtgggaggtcagcccgaaagatgagcagggtaacgtcctcagcggcgacgcgtgggtgcacaacagcgaaaactgctacatcaacagcgacgagaagctggtggcggctatcggcgtggagaacctggtgattgtcagcaccaaggacgctgtgctggtgatgaaccgcgagcgttcccaggacgtgaagaaggcggtcgagttcctcaagcagaaccagcgcagcgagtacaagcgccaccgcgagatttaccgtccctggggccgctgcgacgtggtggtccagaccccgcgcttcaacgtcaaccgcattacggtgaaaccgggcggcgccttctcgatgcagatgcaccaccaccgcgccgagcactgggtcattctcgccggcaccggccaggtgacggtcaacggcaagcagttcctgctgaccgagaaccagtccacttttattccgattggcgccgagcacagcctggaaaacccgggccgcattccgctggaagtgctggagatccagtcggggtcgtacctcggcgaggacgacattattcgtattaaagaccagtatggtcgttgctaattttttcgggacaaaacgcagaatgacacagttaacatgctttaaggcttatgacatccgtggtgaactgggcgaggagctgaacgaggacatcgcctaccgtatcggccgcgcctacggcgaatttctgaaacccgggaagatagtggtggggggcgatgtgcgcctcaccagcgagtcgctgaagctggcgctggcccgcgggctgatggacgccggcaccgacgtgctggatatcggcctgagcggcacggaagagatttacttcgccactttccacctcggggtggacggcggcatcgaggtgacggcgagccataacccgatgaactacaacggcatgaagctggtgcgcgagaacgcgaagcccatcagcggcgacaccggcctgcgggatatccagcgcctggcggaggagaaccagtttccgccggtggacccggcgcgtcgcgggaccctgcgtcagatatcggtgctgaaggagtacgtcgaccacctgatgggctatgtggacctggcgaactttacccgtccgctgaagctggtggtgaactccggcaacggggcggcggggcacgtgattgatgaagtggagaaacgcttcgcggcggccggggcgccggtgacctttatcaaggtgcatcaccagccggacggccatttcccgaacggtatcccgaacccgctgctgccggagtgccgccaggacaccgccgacgcggtgcgtacgcatcaggcggacatggggatcgcctttgacggcgacttcgaccgctgtttcctgttcgatgacgaggcgtcgtttatcgaggggtactacattgtcggcctgctggcggaggcgttcctgcagaagcagccgggggcgaaaatcattcacgacccgcgtctgacgtggaacacggtggacatcgtgacccgcagcggcggccagccggtgatgtcgaagacggggcatgcgttcatcaaggagcggatgcgccaggaagacgccatctacggcggggagatgagcgcgcaccattacttccgcgacttcgcctactgcgacagcgggatgatcccgtggctgctggtggcggagctgctgtgcctgaagaacagttcgctgaaatcgctggtggcggaccgccaggcggcgttcccggcgtcgggggagatcaaccgcaagctgggaaatgcggcggaggcgatagcacgcatccgggcggagtatgagccggcggccgcacacatcgacacaacggacggtatcagtattgaataccctgagtggcgctttaacctgcgcacgtccaacacggagccggtggtgcgtctgagcgttgagtccagagcggatacggcgttaatgaatgcaaaaaccgaagagattttagccctcctcaagtaatgcattaaccataacggaagccatagggtcagattttaatcgtatttttgaccttatggcttattcttgacatcccacaggtcaaagcgtaaaaccgcccacagcattattaaaattcgtggctatccgccattacccagttaactgattaaagtgtaatcgaatgaaaattactatttccggtacaggttatgttggtttatcgaacggtatcctgattgcgcaaaaccacgaagtggtggccctggatatcgtacaggccaaagtggatatgcttaaccagaagatctctccgattgtggataaagagattcaggaatatctggcagaaaaaccgttaaatttccgtgccaccacggacaagcacgacgcctatcgtaatgccgactacgtgatcattgcgacgccgaccgattatgatcccaaaactaactacttcaacacctctacggtggaagcggttattcgcgatgtcacagagatcaacccgaacgcggtaatgatcattaaatcgaccatcccggtggggttcacccgcgacattaaagaacgtttagggattgataatgttattttctctcctgagttcctgcgtgaaggccgtgcgctgtacgacaacctgcacccgtcgcgtattgtcatcggtgagcgctctgcgcgtgccgaacgttttgctgatctgctgaaagaaggcgcgatcaagcaggatatcccaaccctgtttaccgactccaccgaagcggaagcgatcaaactgttcgctaacacctatctggcgctacgcgttgcctatttcaacgagcttgacagctatgctgaaagccaggggctgaacagcaagcagattatcgaaggggtatgcctggatccgcgtatcggcaaccattataacaacccgtcctttggctacggcggctactgtctgccgaaagataccaagcagctgctggcgaactacgaatcggtcccgaacaatatcatcgcggctatcgtcgatgccaaccgtacccgtaaagactttatcgcggattctattctcgctcgtaagccgaaagtggtgggtgtatatcgcctgatcatgaagagtggttcggacaacttccgtgcctcttctattcagggcattatgaagcgcatcaaggcgaaaggtattccggttattatctatgaaccggtgatgcaggaagatgagttcttcaactcccgcgtcgtgcgcgacctggatgccttcaaacaagaggcggatgtgatcatctctaaccgtatggcggaagagctggcggatgtcgcagataaggtttatacccgcgatctgtttggtaacgattaattctgcctgtctgacactggcggttccctgccgccagtgttcttctttatctccccgctatatctctcactacgcgtatttctcgcacattcagattaacctcaataaattgtgatggacattacgatcctgcgcaaaagccgttgcgggttgaaaacaggtccgataagttaaacttaccttgtgaagagctaccgtcactgtgatgtagatgccggagataagcgccgggaggtaaaacaaagcctgcaacgcaggcttttgttatttatgtcctatgaaaaaacgcggaatagggcgcgagtagcgttattttttttcttgccttaaggccatgccaaaacgcagaatgaatagtcattctgtcatatcatttttttatctcttaatattatcttaatctaattgtaatacggaacgggccttaccacttgcgtttattaaacgtcagtttcgttttctttctgtcttttaaataagaaattaagaaataaacggaaacagcaagtagtatggcagcgaccactaagaaaaataggttttccataatatctaccacagggcgtatgttgattgaattattagcttgataagcaatacatcagttttgtgctgttgcatggcttgctctaacatatcctggatttaggaaaattcctacagatagtaatgttttttatcaatcagcatataatgctgtttccgctaaccaaattggtctggataccagaaaagtttcagtgcctggtgcgcggatatttgcttttctgaaaaaggctggatgaaactggtctcaggcgggcgagtaaaaaggcaaaaatggcgtctatagcacaaaatattatataaaaaataatgaatgtgcattccgtcgacatatagtcaggataacggaggttacattgaaggggttgccgcaatcagacgattgcggcagggcagggggattagatctgatagtaatccttgtaccactccacgaagttcttcacgccgtccttcactgacgtttgcggcttaaagcccaccaggtcatacagcggttgggtgtctgcgctggtgtccagcacatctcccggctggatcggcatcatattcttctgcgcttccattcccagcgcctcttccagggcagtgatgtagtccatcagttccactggtgagctgttgccaatgttatataccctgtatggcgcggagctggtggccggggaaccgctctcaacggtccagtcggcattggcctgcgggatcacatcctgcacccgaaccaccgcctcgacgatgtcgtcgatataggtgaagtcgcgcttcattttgccgtagttgtaaacgtcgatactttttccttccagcatcgctttcgtgaacttgaacagcgccatatccgggcgaccccacggaccataaaccgtaaagaagcgcagcccggtggtcgggatgccgtacagatgggaataggtatgcgccatcagctcattggctttcttggtggcggcatacagggagaccggatggtcgacggaatcttcggtggagaacggcattttacggttaaggccgtaaaccgagctggaggaggcgtacaccaggtgtttcaccttggtatgacggcagccttccagaatgttcagataccccatcaggttagcgtctgcgtaggcatacgggttttccagcgagtagcgcacaccggcctgggcggccaggtggatcacgcgatcaaattgctctgtggcgaacagctttgccataccttcacggtcggccagatccagctgctggaaatggaatgccggagatgccaggcgatccagacgggcctgcttcaggctgacgtcataatagtcgttcatgttgtcgattccgacaacatcatgcccttcattcagcaggcgctgcgcgatatggaagccgataaaacctgcggcaccagtgaccaaaaacttcatatttttcctccggggtgtggatatcccgttctacataagtgccgattttacactggcttgcggttgggatcacttgctttgccgcgtcttacccgccaggtgagaggtgaaggacgttttttctggcaaaactgcggtggcaaaggctgataaataacaacatttctcatttgactgttagcctccgaataataaccttgtgaccggtcggtggtttagcgattcgtggcgataccctaaaggcagccaataccctccgggacggcataattttgcttaaagttatatttttcgtcagcggaacatttagtaaatgggcaaaaatcgcgccatgctttcctccgttttgtcttttatatcattgacttattgttgttttgtttgtttaatgaatgtttaagatgtgtattatttgagtaatccattaatcagtaggcttttttatttttattcccggcgtccagcgctataatctgcggacgattttctttgtggaatgtgcattgtagagcatgagtcgtttatcccacctgtcggaacatagcgccgccgccgtgtgcaaagggccatcaagcctgaacgcgcgctgtctccctggcggcgaagacgatgtctcttcttctctttccccgcatcgtgaacgctcccttttgctgctggctcacatcggcgggtcgcccgtttctctttcatcagtggcgaaaagcgcagacgttataccctgcgtaaatgagaaagtcctgatggttaattcggcggcaaatgaggaaagtgtggtgcgtttggcggccaggtgaggaacagatgcatattaaaagcagagatatgtctcaaggcatatctctgcttttaggttttcaggccccccgttctgtcagactggcttttcaggccgctgagtgaacgatctgccgatagcctgaagcgaaagcgggtggcgtttagcctggagcacgggagcagtacgcattttggttgcgacagccaatggcggtagcgtgcctgaaaaaggccgttccacccagacggtcgattgattgatagtaaaataaagcaattatttatttaaggatttcattatgttacttcctgtaattatggctggtggtaccggcagtcgtctctggccgatgtctcgcgagctttacccgaaacagttcctccgcctgttcgggcagaactccatgctgcaggaaaccatcacccgactctcgggccttgaaatccatgaaccgatggtcatctgtaacgaagagcaccgcttcctggtggccgaacagctgcgccagctcaacaagctgtcgaacaacattattcttgagccggtcgggcgcaacaccgccccggccatcgccctggcggccctccaggccacccgccacggcgacgacccgctgatgctggtcctcgccgccgaccatatcatcaataaccagccggtcttccacgacgccatccgcgtcgccgagcagtatgccgatgaaggccatctggtcaccttcggtatcgtgccgaatgccccggaaaccggctacggctacatccagcgcggcgtggccctcaccgacagcgcccatactccgtaccaggtggcccgtttcgtggagaaaccggaccgcgagcgcgccgaggcctacctcgcctccggggagtattactggaacagcggcatgtttatgttccgcgccaaaaaatacctctccgagctggccaaattccgcccggatatcctcgaagcctgccaggccgcggtcaatgccgccgataacggcagcgacttcatcagcatcccgcatgacattttctgtgagtgcccggacgagtccgtggactacgcggtgatggagaaaaccgccgacgcggtggtggtcggtctcgatgccgactggagcgacgtcggctcctggtccgccctgtgggaggtcagcccgaaagatgagcagggtaacgtcctcagcggcgacgcgtgggtgcacaacagcgaaaactgctacatcaacagcgacgagaagctggtggcggctatcggcgtggagaacctggtgattgtcagcaccaaggacgctgtgctggtgatgaaccgcgagcgttcccaggacgtgaagaaggcggtcgagttcctcaagcagaaccagcgcagcgagtacaagcgccaccgcgagatttaccgtccctggggccgctgcgacgtggtggtccagaccccgcgcttcaacgtcaaccgcattacggtgaaaccgggcggcgccttctcgatgcagatgcaccaccaccgcgccgagcactgggtcattctcgccggcaccggccaggtgacggtcaacggcaagcagttcctgctgaccgagaaccagtccacttttattccgattggcgccgagcacagcctggaaaacccgggccgcattccgctggaagtgctggagatccagtcggggtcgtacctcggcgaggacgacattattcgtattaaagaccagtatggtcgttgctaattttttcgggacaaaacgcagaatgacacagttaacatgctttaaggcttatgacatccgtggtgaactgggcgaggagctgaacgaggacatcgcctaccgtatcggccgcgcctacggcgaatttctgaaacccgggaagatagtggtggggggcgatgtgcgcctcaccagcgagtcgctgaagctggcgctggcccgcgggctgatggacgccggcaccgacgtgctggatatcggcctgagcggcacggaagagatttacttcgccactttccacctcggggtggacggcggcatcgaggtgacggcgagccataacccgatgaactacaacggcatgaagctggtgcgcgagaacgcgaagcccatcagcggcgacaccggcctgcgggatatccagcgcctggcggaggagaaccagtttccgccggtggacccggcgcgtcgcgggaccctgcgtcagatatcggtgctgaaggagtacgtcgaccacctgatgggctatgtggacctggcgaactttacccgtccgctgaagctggtggtgaactccggcaacggggcggcggggcacgtgattgatgaagtggagaaacgcttcgcggcggccggggcgccggtgacctttatcaaggtgcatcaccagccggacggccatttcccgaacggtatcccgaacccgctgctgccggagtgccgccaggacaccgccgacgcggtgcgtacgcatcaggcggacatggggatcgcctttgacggcgacttcgaccgctgtttcctgttcgatgacgaggcgtcgtttatcgaggggtactacattgtcggcctgctggcggaggcgttcctgcagaagcagccgggggcgaaaatcattcacgacccgcgtctgacgtggaacacggtggacatcgtgacccgcagcggcggccagccggtgatgtcgaagacggggcatgcgttcatcaaggagcggatgcgccaggaagacgccatctacggcggggagatgagcgcgcaccattacttccgcgacttcgcctactgcgacagcgggatgatcccgtggctgctggtggcggagctgctgtgcctgaagaacag

SEQ ID NO: 54 - DNA, 489171 bp, Unknown
  source: /note="Description of Unknown: KP2-Mcoc1 Bacteria Sequence"
acaacggcatctccatcgacggccacgttgaaggctggttcaccgacgacaccgccaaacgctttgaagcctacggctggcacgtggtgcgcggcgtggacggtcacgacgctgacgccatcaaacgtgcggtagaagaagcgcgggcggtcaccgacaaaccgtccctgctgatgtgcaaaaccatcatcggtttcggttcgccgaacaaagccggtacccacgactcccacggcgcgccgctgggcgacgccgaaatcgccctgacccgcgaagcgctgggctggaaacacgcgccgtttgacatcccgtctgacatctatgcccagtgggatgccaaagaagccggccaggcgaaagaagcggcgtggaatgagaagttcgctgcctacgccaaagccttcccgcaggaagcagccgaattcacccgccgtatgaaaggcgagatgccgtctgacttcgacgcgaaagctaacgagttcatcgcgaagctgcaggccaacccggcgaaaatcgccagccgtaaagcctcgcagaacgccatcgaagccttcggcccgctgctgccggaattcctcggcggctccgcagatctcgcgccgtccaacctgaccctgtggtctggctctaagccgatcaacgaagacgctgccgggaactacatccactacggcgtgcgcgagttcggtatgaccgctatcgccaacggtatcgcgctgcacggcggcttcctgccgtacacctccaccttcctgatgttcgtggaatacgcgcgtaacgcggtacgtatggccgcgctgatgaaacagcgtcaggtgatggtctacacccacgactccatcggtctgggcgaagacggcccgactcaccagccggtagagcaggtggcttccctgcgcgtgaccccgaacatgtccacctggcgtccgtgtgaccaggttgaatccgcgattgcgtggaaatatggcgtggagcgtcaggacggcccaaccgcgctgatcctctcccgtcagaacctggcgcagcaggagcgtaccgcagagcagctggcgaacgtggcccgcggcggttatgtgctgaaagattgcgccggccagccggagctgatcttcatcgccaccggttcagaagtggagctggcggttgccgcatgggacaaactgactgccgaaggcgtgaaggcgcgcgtggtttccatgccgtccaccgacgcgttcgacaagcaggatgcggcttatcgcgaatccgtactgccgaaagccgtgaccgcgcgcgttgccgtggaagcgggtatcgctgactactggttcaaatacgttggcctgaacggcgctatcgttggcatgaccaccttcggtgagtctgcgccggctgagcagctgttcgaggagttcggcttcaccgttgataacgtggtcgctaaagcgaaagcgctgctgtaatcgctggtacggtgcgggctgatgccctcaccccaaccctctcccacaggagagggtgcaaacaccaaaacggtaacccctgggttaccgttttgcttttatctcgccacccggcttttttgtatctgctattcctgaaccatgtaatacggttgtaaattattccagcaaaaatgtgatgtgagtcatatagctggtttattgcgctggacaaacattccttttattcctcatttcgcttattctagctgaagcgtttcagtcgtttaaatgttcgacaattaatcaatcagtcgcagtttgcagctggtaaggttcccctcagagcgttgctggattactctgtcagccacctcataacagggacagccttgcaggagatctatgaccattcgcatcgcgattaatggcttcggtcgcattggacgcaacgtggttcgtgctctatatgaatccgggcgtcgtgcggaaatcaccgtggtggcaatcaatgagctggcggatgccgcgggcatcgcgcatttattgaaatatgacaccagccatggccgtttcgcctgggatgtccgtcaggagcgcgagcagctgtttgttggcgacgatgccatccgtctgctgcatgagccgaccattgcggcgctgccctggcgcgaactggcggtggacgtcgtgcttgactgtaccggcgtatacgggagccgtgaacacggtgaagcccatcttcaggcgggggcgaaaaaagtgctcttttcccaccccggcggcaacgacctcgacgcgacggtggtgtacggcgtaaatcaggatgaacttcgcgccgggcatcgcattgtctccaacgcctcctgcaccaccaactgcattattccgatcattaaactgctcgatgacgcctatggcattgagtccggcaccgtcaccaccattcactcggcgatgcatgaccagcaggtgattgacgcttatcatccggatctgcggcgtacccgcgcggccagccagtcgatcattccggtggataccaaactggcggcagggatcacccgtatttttccgcaatttaacgaccgttttgaagcgattgccgtgcgggtgccgacgattaacgtgacggcaattgacctgagcgtgacggtgaaaaaaccggtaaaagcatgtgaagtcaaccagttgctgcaaaaagcagcacaaggtgcatttcatggtatagttgactatacggaattaccgttggtctcgacagattttaaccacgatccgcacagcgccatcgtcgatggtacgcaaacccgggtcagtggcgcgcatctgatcaaaacgctggtctggtgcgataacgaatggggctttgctaaccgaatgctcgacacgacgttagcgatggcggctattggtttcaggttcgacgcgtaaacgtcgacaaaactttatgaatcaacgagaggattcaccatgtctgtaattaagatgaccgatctggatctggctggtaaacgcgtttttatccgtgcggatctgaacgtaccagttaaagacgggaaagtaaccagcgacgcacgtatccgtgcatctctgccgaccattgaactggcgctgaagcagggcgcgaaagtcatggttacttctcacctgggtcgtccgaccgaaggcgagtacaacgaagaattctctctgctgccggttgttaattacctgaaagacaaactgtccaacccggtacgcctggttaaagactacctggacggcgtggaagtggctgccggtgaactggtggtgctggaaaacgttcgcttcaacaaaggcgagaaaaaagacgacgaagaactgtctaagaaatacgctgcgctgtgcgacgtgttcgtgatggacgctttcggtactgcgcaccgcgcgcaggcttccacccacggcatcggcaaatttgctgacgtggcgtgcgcaggcccgctgctggccgctgaactggacgcgctgggtaaagcgctgaaagagccagctcgtccgatggtcgctatcgttggtggttctaaagtgtccaccaaactgaccgttctggattccctgtctaaaatcgctgaccagctgatcgtgggcggcggtatcgctaacaccttcgttgccgctcagggccacaacgtcggtaaatccctgtacgaagcagatctggttgatgaagccaagcgcctgctgggcacctgcgatatcccggttccgaccgacgttcgcgtagcgaccgagttctccgaaaccgcaacggcaaccctgaaatctgttaacgacatcaaagatgacgagcagattctggaccttggcgacgtttccgcacagaaactggctgaaatcctgaagaacgccaaaaccatcctgtggaacggcccggttggcgtattcgaattccctaacttccgtaaagggactgaaatcgtggctaacgctatcgcggacagcgaaggtttctccatcgccggcggcggtgacaccctggcagcgatcgacctgttcggcatcgctgacaaaatttcctacatctccactggcggcggcgcattccttgaattcgtcgaaggcaaagtcctgccggcagtagcgatgctcgaagagcgcgctaagcagtaattcagttcaggcggggaaacccgcctgtttttcagcgcgcttaagggctcgcgaaccttcttcaacggtcgaagatacagatacaggactaagtaacatgtctaaaatttttgatttcgtaaaaccgggcgtcatcactggcgacgacgttcagaaagtgttccaggtagcgaaagaaaacaactttgcactgccggcggtaaactgcgtaggtactgattccatcaacgccgttctggaagctgcagcgaaagttcgctctccggttatcgttcagttctctaacggcggcgcagcgttcatcgcaggtaaaggcgtgaaaactgacgttcctcagggtgctgctatcctcggcgctatctctggcgcccaccacgtgcaccagatggctgaacactacggcgtgccggttatcctgcacactgaccactgcgcgaagaaactgctgccgtggatcgacggcctgctggacgccggtgaaaaacacttcgccgctactggcaaaccgctgttctcttcccacatgatcgacctgtctgaagagtccctgcacgaaaacatcgagatctgctctaagtacctggcgcgcatggccaaaatgggcatgaccctggaaatcgaactgggctgcaccggcggtgaagaagacggcgtggataacagccacatggacgcttccgccctgtacacccagccggaagacgtggattacgcctacaccgagctgagcaaaatcagcccgcgtttcaccatcgccgcttccttcggtaacgtacacggcgtgtacaaaccaggtaacgtagttctgaccccgaccatcctgcgcgactctcaggaatatgtttccaagaaacacaacctgccgcacaacagcctgaacttcgtgttccacggcggttccggttcttccgctcaggaaatcaaagactccgtcagctacggcgtggtgaaaatgaacattgataccgacacccaatgggcaacctgggacggtatcctgcagtattacaaagcgaacgaagcttacctgcagggccagctgggcaacccgaaaggcgaagaccagccgaacaagaaatactacgacccgcgcgtatggctgcgtgctgcccagacttccatggtgactcgtctggagcaggcatttaaagagctgaacgcgatcgacgttctgtaagaaaaatctgtttcttacccggaagcccgcagcaatgcgggcttttttattatcttaacaacaggatagcgtggcagaaaactgtgatccatttggcaaaacgtgcacttattgtttaccctataacctgactgccctgtcgcaggctgagttatttacttccccccaggggattcataaggaatgttaaatggaagatttgaacgttgtcgatagcatcaaccacgccgggacgtggctggcacgcaaccaggagctgctgctgagctatgccgtcaacatcgtcgcggctatcgctatcctgatcgtcgggatgatcgtggcgcgcgtcgtctctaataccgtcaaccgcctgatgctggcgcgtaaaattgacgctaccgtggccgattttctctctgcgctggtgcgctatgcggttatcgcttttacgctgattgccgccctggggcgggtaggcgtgcagaccgcctcggtgattgcggtgctgggtgctgccggtttggcggtgggtttagcgctgcagggatcgctgtcgaaccttgccgcaggcgtactgctggtgatgttccgcccgttccgcgctggcgagtatgtcgaccttggcggcgtggcaggtacggtgttgaacgtgcagattttctccaccaccctgcgtaccgcggacggtaaagtagtggtggtcccgaacgggaaaatcatcgccggcaatatcattaacttctcccgggagcctgcgcgtcgcaatgagtttattatcggcgtcgcttacgatgctgatatcgacaaggtaaagcagctgctgacctcgattatcgaatctgacgatcgaattctgcgcgatcgggaaatgaccgttcgtctgaacgaactcggcgcctcgtcggtgaacttcgtggtgcgcgtgtggagcaaaagcagcgatctgcaaaacgtctactgggatatcctcgagcgtatcaagcgtgaatttgacgccaacggcatcagcttcccttacccgcagatggatgttcatgtggtgcgcctgccggaaaaagcagagtaaagcgcctctcaataactcaggccggccatgccggcctttttcaatagctcatcattagtagttctaattaatgattaattctttcaatttccgctaataattcattcgcgctatagtcagcgccactctcgaactcagcggataaatccttatgtttacttattactttcaggggcttgccctgggagcggctatgatattgccgcttggcccacaaaatgcctttgtgatgaatcaggggatccgtcgtcagtatcatctgatgattgccctgctatgcgcggtcagcgacttgctgttaatctgcgctggcattttcggcggtagcgcactgctgatgcaatccccgtggctgctggcgctagtgacctggggcggcgtggcctttttgctgtggtatggcttcggcgcattgaaaacggcgttcagtcagagtcttgaactcgccaatgcagaggtaatgcagcaggggcgctggaaaatcattatcaccatgctggcggtgacctggcttaacccgcacgtttatctggacacctttgtggtgttaggcagcctgggaggtcagctggcggtggagccgaagcgctggtttgcgctagggaccattagcgcctctttcctgtggttctttggcctggcgctgttagccgcctggctggcgccgcgactgcgtaccgccagagctcagcggatcatcaatattgtggtcggcgccgtcatgtggtttattgcgtttcagctggcaagagaaggcgtcagccatatccaggcgttgcttaactaagcgttgtccgatggactttcctgctgtacgcgctaagcttgctggcatgcgtcccgtaagggcgatttaagtaacatggagaaacgacagtgaagttaaaagtcttagccctggcggcaacactcggattgaccacgatggcggcacaggccagcgaattgccggatggcccgcacattgtgacttcaggcacagcaagcgttgccgcggttccggacatcgccaccctggcgatcgaagtgaacgtgtcggcaaaagacgccgcgtcggcaaaaaaacaggctgacgatcgcgttgcgcaatatctctctttcctcgaaaagagcggtattgctaaaaaggacatcaactcggcgaatctgcgtacccagcctgattacgactatcagaacgggaaaagcattctgaaaggctatcgcgcggtgcgcacagtggaagtgaccttgcgccagctggataaactcaacggtctgctggatggcgccctgaaagcgggtctcaacgaaattcgctccgtctcgctgggcgttgcgcaaccggacgcctacaaagataaagcgcgtaaagcggcgatcgacgacgccgtgcatcaggcgcaggagctggccgcaggcttccacagcaagctgggtccggtgtacagcgtgcgctaccatgtctccaactatcagccgagcccgatggttcgcatgatgaaggccgctgacgctgcgccggtttctgcccaggaaacctacgagcaggcgactatccagtttgacgaccaggtcgatgtagtctttgagctgcagccggcgcaagccgctgctccagccaccccggcgaaaccggcggaaacgccgaaaccggcccagtaagcgatagaaacaaaaaagccacttcagcgaagtggcttttttatgcccgcggtttaatcctgacgcagcaccttgtgtccgtagtcaatgagcgcatcggtcacccggcgcatcatgcggctttccggggcgaagcggtgccagtagagcatgcggcgctggaacaggcccggggtgagatcgataagttcgccgctgttgagctctttttcgatctgcagatgcgggatcatacagcaggtggtgccctggcgcgccagctgcacgaaagcttccgacgagttgacgatgtggcaggggacgctgcccggcggcaggtcgaagttttgctgcaggaacgcctgatgcatatcgtccagatggtcgaaggcgacgaccggcgccttaagcagcgccgaacgcgtcacgccattcgggaaatagcgttgcgcaaactcttttgatgcgacaaacaggtaatcgagcgcccccagctgatccaccaggcagcttggcagcgcctgcggctggatactcactgcgcccactacttcgccacggcgcaggcgctcctgggtgcgggtttcatcttccacctgcaggttgagacgaataggggagtctgacagaacgttggccagcgccggcagcagccaggtcgccagactgtcggcgttcaccgccagcgacagcagcagcggcgtcgagccggtttgttcatcgcccagccactcttcctccagcagttcaacctggcgcaacagagccagcagtttctgtccttgctcggtggggcgcggcggcacggtacgcaccagcagcggctggccgaacatattttccagctgcttaatacgctgtgagacggcggactgggtaatacatagcttctgcgcggcgcgctcaaatcctcgttccctaatcaccgcatccagcgcttgtagtgtcctgtagtccggtcgtttcattattctggcgtgcccccataactaatcgttatctcgcactatgacataaatttttatttgatacagacgaaattggtctgttcagttgtgtgatctgcatcgcagggacatttccactatcgatgttctataatgcgccacaggcattcacatctcggaccagaattatgacgcaggatgaactgaaaaaagcggtaggttgggcagcactgcaatatgtacagccagggactattgtcggcgtaggcaccggctcgacggcggcccattttattgacgcgctgggcaccatgaaggggcagatcgaaggggcggtttccagctccgacgcctccaccgagaagctgaaaagcctcgggatcaccgtcttcgatcttaacagcgtcgatcgcctggggatctatgttgacggcgcggatgagatcaacggccatatgcagatgatcaaaggcggcggcgcggcgctgacccgtgaaaagatcatcgcctcggtcgcggataagtttatctgcatcgccgacgcctccaagcaggtcgatattctgggcaagttcccgctgccggtggaagtcattccgatggcgcgcagcgccgtggcgcgtcagctggtcaagctgggcggccgtccagagtaccgtcagggcgtggtgaccgataacggcaacgtgatccttgacgtgcacggcctggaaattctcgatgcgatcgcgctggaaaacgcgatcaacggtattcctggcgtcgtcaccgtggggctgttcgccaaccgtggcgccgacgtggcgctgattggtactgccgacggcgtgaagaccatcgtaaaatagtctgtccgcagggagccgaccggctccctcgcaaatattttttcaccaggtgcaatttggtgacttctgtcacatttatgcaaccattctgatttacacgctaccatttcttctctttctggtgttttgtcctgcgatttccctctggatgacatttcttcaggacggcgacgcaaacgttcatattgccgcgatagttttttttgatatgttgctgagacgaactttcgttcagcacgacatcagttaagacaaaacaggacggggaaatggctaaggtatcactggaaaaagacaagattaaatttctgctggttgaaggtgtgcatcaaaaggcaatcgatagccttcgcgcagcgggttacaccaacattgaatttcataaaggcgcgctggattcagaacagctgaaagcgtcgatccgtgatgcccatttcatcggcctgcgttcccgtacccatctgactgaagagattttcgccgcagcggaaaaactggttgccgtcggttgcttctgcatcgggaccaaccaggtcgatctgaacgccgctgcgaagcgcggtattccggtgtttaacgcgccgttctctaacacccgctcggtggccgagttggtgatcggcgaactgctgctgatgctgcgcggcgtgccggaagccaacgccaaagcgcaccgcggggtgtggaacaagcaggcggtcggcagcttcgaagcgcgtggtaaaaagctgggcatcatcggttacggccacatcggtacccagcttggcattctggcggaatcgctgggaatgcacgtcttcttctatgatattgaaaacaaactgccgctcggcaacgccactcaggtacagcatctctccgacctgctgaacatgagcgatgtggtcagcctgcacgtgccggaaaacgcctctaccaaaaatatgatgggcgcggaagaactggcgctgatgaagccgggcgcgctgctgatcaacgcctcccgcggtaccgtggtggacattccggcgctatgcgatgcgctggccagtaagcatctggccggggcggcgatcgacgtcttcccgactgaacctgcgaccaacagcgaccccttcacttccccgctgtgcgagtttgataacgtgatcctcacaccgcatatcggtggctccactcaggaagcgcaggagaacatcggtctggaagtagctggcaagctggcgaaatactctgacaacgggtcaaccctgtcggcagttaacttcccggaagtttctctaccgctgcacggcggccgccgtctgctgcatatccatgagaaccggccgggcgtcctgaccgcaatcaaccaaatcttcgccgcgcagagcatcaacattgccgcccagtatctgcaaacgtcgccgcagatgggctacgtggtgattgatattgaagcggaagaagatgttgcccagcaggcgctgcaggcaatgaaagcgatcccggggactatccgcgcccgtctgctgttctaatcatttttgcctctcgggcaggtcgcgtacctgcccgtttttttgttaatactttccaggctgaatttctcgtccccgcgtacctaccaacaccaggtttttcccggggtgatgaccgccggcagcgggatatcccactcttcgctcggcaggctatccacctgctggcagtcgtgcgcgtagcccaccggctgcaggcgatactgctgccagttttgcagcgtccggtcgtaaaaaccgccgcccattcccagccgttggccactgacatcgaaggccaccagcggggtcaccagcacatcgagttcagccagcggcagcacatcccgcacatcgagcttcggttcgcggatcttcaggcgattcacgatcagttggctctgcggatggtagtgtaaaaacagcagattgccggggctaaagggatgcagcaccgggagatatacccgcttgccggcgcgccagagctggtcgatcagcggctgggtgtccagctcgccgtcaaaggagagaaacagcgccacgttgtgggcgagaactaccggcggccaggccatcatccgctcggcggcctgttgggcaaacaggcgctgttgctccgggctgagtgcgcgtcgacgatcgcggatctgctggcgaatatgctgacgggagagcagggtatcgggctgtatagtcatgcaggtctcgttacgagctggcgaaacaataggagcaagtgtaatacagggcggcttcagccgaaaacacgtatgggggatgatgcgaagtaaagaagggaatctccgagatgccgccgcaggctgtaacccttgaacccttggttcaaggtgaatgtgtcgtcacggttttaaggcttctcggacgaaccgagcatgctcaccaaccgtggagcgccacattcttgtggtatgaaatatcggctcaggggactggcccacttgcaaacatctcagagaaattttgttcttgcgattactctaacacagttaactgcaaagtgttattcaaacttcgaccctggcttttcgcttatgcgaccttgctcaagcaatgcttgttcgatggtctgctgaagcatgcgaatgcgctgctccatgctggaagcgtagtcgcgggtcttcgctttttcctgagtcaactcatagctgatgttcaacgccgcgatgaagaccagctgctcagtatttgtgactctagtgcgttcttttaaatcttgcaaccgctgattaaggtcttcagctgcctgattcagggcatccctttgttcaggcgggcaattcactcgcagtgaacggccgaaaatttggagatctacgggttgtgcagacatgccaccttcctgctgattgactgcgctgccttcacaccctggcccgggtctgcgaaggggcgacactatagctaccctggtgcgaagatacaagccctattctggttcaccagggtccaaagtggtagcataccatgaatattcctcccaacgatgacgaatgcgcatgtctatacagaacgaaatgcctggttacaacgatgtagaccagttactgaaccaacaaggggtaggtctcaccccggccgaaatgcacggtttgatcagcggattgctgtgcggcggcaacacggacagcagctggcagccgctggtgcacgacctgaccaacgaaggtctcgcctttggccatgaactggctcaggcgctgcgtaacatgcattccgccatcagcgattcactggatgacgacggtttcctctttcaactgtatctgccggaaggcgatgcggtgagcgtctttgaccgtgccgacgccctcgccggttgggtcaaccacttcctgcttggtcttggcgttagccagccgaagctggataaagtgaaggatgaaaccggggaagcgattgacgatctgcgtaatattgcccagctgggctacgatgaagacgaagatcaggaagagctggagatgtctctggaggagattatcgagtatgtccgcgttgccgcactgctgtgccacgacacctttgcccgtcagcagccaaccgcaccggaagtccgcaaaccgacattacactaactaaaattcgttcagggggcgtcatgactcagcaggaatttctatcgcgtcgccagacgctgttggcgcagatgcagccaggcagcgcggcgctgattttcgccgcaccggaagcggtgcgcagtgcagattcggaatatccctaccggcagaacagcgatttctggtacttcaccggctttaacgaaccggaagcgctgctggtgttgattaaaagcgatgaaacccacaaccatagcgtgctgttcaaccgggttcgcgatctgaccgctgagatctggtttggacgccgtctgggccaggaggccgcgccggcgaagcttggcgtcgaccgggcgctggcgttcagcgaaatcaaccagcagctgtatcagctgctcaacggtctggacgcgatctacttcgcccagggtgaatatgcctatgccgatgagattgtgttcaacgccctcgaaaaactgcgcaaaggcgcgcgccagaatctgcaggcgccgaactcggttatcgactggcggcccattgtgcatgagatgcgcctgtttaaatccgcggaagagcttgccgtgatgcgccgcgccggggagatcaccgcgctggcccatacccgggcgatggaaaaatgccgccctggcatgttcgaatatcagctggaaggtgaaattctccatgaattcaaccgccacggggcacgtttcccctcctataacaccatcgttggcggcggcgaaaacggctgtattctgcactacaccgaaaacgaatctgaactgcgcgacggcgatttagtcctgattgacgccggctgcgagtatcgcggctatgccggggacattacccgcaccttcccggtaaacggtaaatttacccagccgcagcgcgagatctacgacattgtgctcgaatcgctggagaccgcgctgaaactctatcggccgggcacctcgatctgtcaggtcaaccaggaagtggtgcgcattatgattaccggcctggtgcggctggggatcctgaaaggcgagattgacgagcttatcgccaacaacgcccaccgcccgtactttatgcatggcctgagccactggctgggtctggatgtgcacgatgtcggtaattacgacaccgaccgttcgcgcgtcctggagccgggaatggtgctgaccgtcgagccgggactgtatatcgccaccgatgccgacgtgccggcgcagtatcgcggcatcggcatccgtattgaagatgacatcgtgattaccgaagacggtaacgaaaatctcaccgccggcgtggtgaagaaggcggatgagatcgaggcgctgatggcggcggcgcgccagtcatgagcgtgctgatcgtcgggggcgggatgaccggggcgacgctcgcgctggccatctcccgtttgactggcggcgcgctgccggtccacctcattgaagcgcaggatccgcattcgtcacgccaccctggctttgacgaccgggcgatcgccctggctgcgggcacctgccagcagctggcgcgtatcggtatctggcaacgcctcgccgaacgcgcgacgcccatccagcgagtacacgtcagcgaccgcggtcatgccgggtttgtgaatctggcggcggcggattatggcctgtcggcgctgggccaggtggttgaactccacgatgtcggccagcggctgtttggtctgctgcgcgaggcgccaggcgtcacgctgcactgtccggcgaaagtggaagcggtcagtcgcagccaggagagcgtcagccttacgcttgagggcggcgaaatcattaacggtaagctgctggtggcggcggacggttcccgttcggcactgggcgcccgctgcggcatcagctggcagcagcagccgtatgagcagatagcgatcattgctaacgtcagcaccgcgttgccccacgaaggtcgcgccttcgagcgctttaccgagcatggcccgctggcgatgctgccgatgtcgcaagggcgctgctcgctggtgtggtgtcatccgcagtcgcgccgcgatgaggtgcagagctggtctgacgaacgcttttgtcaggagctgcagcaggcgttcggctggcggctggggcgtattacccacgccgggaagcgcagcgtctatccgctggccctcaccaccgccagccgcgcggtgtcgcaccgcctggcgctggtcggcaacgcggcgcagacgctgcacccgatcgccgggcagggctttaatctcggcctgcgcgatgtgatgagcctggcggaattactcgctgacgcccatctcagcggcgaagatttcggtcattatccgctgctgtgccgctatcaggcgcgcagggcaggggataaagccgccaccatcggcgtgaccgatgggctggtgcatctgtttgccaaccgttgggcgccgctggtggcggggcgcaacgtcggtctgatggcgatggaattatttaccccggcgcgcgatgcgctggcgcagcgtaccctcggttgggttccccgttaaggagtagaacgtgcaaagtgttgatgttgccattgttggcggtggaatggtggggctggcggtagcctgcggtctacagggtagcggcctgcgcgtcgcagtgctggagaaagcagagccgcgaccgctggccgccgatgcgccgccggcgctgcgcgtttcggcaattaatgccgccagcgaaaagctgctgacaaagctggacgtctggcgcgagatcgtcgcccagcgggccagctgctatcacggtatggaagtgtgggataaagacagctttggccacattagcttcgatgaccagagcatgggctttagccaccttggctatattatcgaaaatgccgtagtgcatcatgcattgtggcagaaggcgcagcgttgcgctgacgttaccctgctggctccggcggaacttcagcaggtggcgtggggcgagaatgaagcctttctcagcctgcaggacggcagcatgctgaccgcgcggctggtgatcggcgccgatggtgccaattcatggctgcgcaataaagccgatattccgctgaccttctgggattaccatcatcatgcgctggtggcgaccatccgtaccgctgagccgcatcaggcggtggcccgccaggcgttccatggcgacgggatcctcgccttcctgccgctcagcgatccgcacctgtgctcgatcgtctggtcgctatcgccgggggaagcgcagcggatgcagcaggctgatgaaaccaccttcaaccaggcgctgaatatcgcgttcgataatcgccttggcctctgccagctggcaagtgaacgtgaagttttcccgctgaccggccgctatgcccgtcagtttgccgcccaccgactggcgctggtcggcgatgccgcgcataccatccatccgctggccgggcagggggtcaacctcggttttatggatgccgccgagcttattgacgagctgaagcgcctgcacgctcagggcaaagatatcggccagcatctttatctgcgccgctacgagcgcagccgcaagcacagcgcggcgctgatgctggcgggcatgcagggcttccgcgaaatgttctccgggagccatccggcgaagaaatttcttcgcgatgtgggactcaaactggccgatacgctgccgggcgtgaaaccgcagctgattcgccaggcgatgggcctcaacgatctgcctgcctggttacgttaaccgcgtcacacttctttcacccggcctgggcgccgggttttccccctcatttgaaatattctaatttcacctcttttttcgcattagatttattaatgcgcccttttttttgttaaagaaattagagccgtaaaatcgcataaaacaccatcattacctaattgccgcgccgttaatgttaattttatgtggcgtaaatcgcttttttccagtcaataactctgtaggcttttcggcggattttagccataagctaatgtgatgccctgaatgagcttatggtttagcgccgggttcggtggtaagttcaggccaaagataacgtttgcgtcggcgtccgtcagcgatgccgacgccgaatttcgtggcgcaaaatcgccgacaatttcgtggctggttccgttttattcgatgaggaaaagatggctcaacagactccgttgtatgaacaacacacgctgtgcggcgcgcgcatggtggatttccatggctggatgatgccgctgcattacgggtcccagattgatgagcaccatgcggtgcgcggcgatgcagggatgttcgatgtgtcgcatatgaccatcgtcgatttccacggcagccggatccgcgagttcttgcgctatttgctggccaacgatgtggcgaagctcaccaccccaggcaaagcgctctacaccggcatgctgaccgcctccgccggcgtcatcgacgacctgattgtctatttcctttctgaagattatttccgcctcgttgttaactccgccacccgcgaaaaagacctcgcctggatctccgaacaagctgaaccttacggccttgaaattaccgttcgcgacgatctgtcgcttatcgcggtccagggcccccaggcgaaagcgaaggcggcgacgctgtttaccgacgctcagcgtcaggccgtggaaggcatgaagccgttcttcggcgtgcaggcaggcgacctgtttatcgccaccaccggctataccggcgaagcgggttatgaaattgcgatgccgaacgagcaggcggctgatttctggcgcggtctgctggacgctggcgttaagccgtgcggtcttggcgcgcgcgacaccctgcgcctggaggctgggatgaacctgtacggccaggagatggacgaaggcgtttccccgctggcggcgaacatgggctggactatcgcctgggagcccgccgatcgtaacttcatcggccgcgaagcgctggagatgcagcgtgaaaaaggcaccgagcagctggttggcctggtgatgaccgagaaaggcgtcctgcgcggtggtctgccggtccgttttaccgatagcgacggtaatcaaaaagaaggcattatcaccagcggcaccttctcgccgacgctgggctacagcatcgcgctggctcgcgtgccggccgggattggcgacaccgcggtggtgcaaatccgtaaccgtgaaatgccggtaaaagtgactaaacctggttttgtacgcaatggcaaagccattgtgtgatttcccttttttggagatgaattgatgagcaacgtaccagcagaactgaaatacagcaaagaacacgagtggctgcgtaaagaagcggacggtacctataccgtagggatcaccgagcacgcgcaggagctgcttggcgatatggttttcgttgacctgccggaagtgggcgccaccgttgaagcgggcgccgattgcgcggttgccgaatccgtgaaggcggcctccgatatctacgcgccgattagcggtgaaatcgttgccgtcaacgaagagctgaacgactctccggaactggtcaacagcgacccgtataccgacggctggatcttcaagatcaaagccagcgacgaagcgcaggttgccgcgctgctggatgccgccgcgtatgaagctttactggaagacgaataaatacgcttcatccttcacgctgcaggggcgttggcttcctggctccccccggtcacttacttttgtaagctcccggggagtcgctgtgtcgccgccttcctgcaacgcgaatgattttgcgtattctggcccggtaagcatcagcgcttgccgggcaaaccagtcagacaaccacgattcaccgcacgtttcaggaaccatcgctcatgactcagactttaagtcagcttgaaaaccgcgacgcctttattgaacgtcacattggcccggacgctcagcagcagcaagagatgctgaagaccgtcggcgcggattcgcttaacgccctgatcggccagattgtgccgcaggatatccagctggcgaccccaccgcaggtgggcgacgcgactaccgaattcgccgcgctggcggagctgaaggcgattgccagtcgcaacaagcgcttcaagtcttacatcggcatgggctataccgccgtgcagctgccgccggtcattcagcgcaacatgctggaaaacccgggctggtataccgcctataccccttaccagccggaagtatcccagggccgtctggagtcgctgctcaacttccagcaggtcactctggatctgaccgggttggatatcgcttccgcttcgctgcttgatgaagccaccgccgccgccgaagcgatggcgatggccaaacgcgtcagtaaactgaagagcgccaaccgcttcttcgttgccgccgacgtccatccgcaaaccctggacgtggtgcgcacccgcgcggaacccttcggcttcgacgtcatcgtcgatgacgccgacaaagtgctcgatcaccaggatgtcttcggcgtgctgctgcagcaggtgggcaccaccggcgaaatccacgattacagtaaactgatcgccgagctgaaagcgcgcaaagtgattgtcagcgtcgccgccgactttatggcgctggtgctgctgacggcgccgggcaagcagggcgcggatatcgttttcggttccgcccaacgcttcggcgtgccgatgggctacggcggcccgcacgcggccttcttcgcggcgaaagatgaattcaaacgctccatgccgggccggattatcggcgtatcgaaagatgcggcggggaataccgcgctgcgcatggctatgcagactcgcgagcagcacatccgccgtgagaaagcgaactccaacatttgtacctcgcaggttctgctggccaacatcgccagcctgtacgcggtattccacggcccggcgggtctgaaacgtatcgctggccgcattcatcgtctgaccgacattctggccgacggcctgcagaagaaagggctgaagctgcgccatgcccactacttcgacaccctgtgcgtcgaagtggcggataaagccgcggtgctggcgcgtgccgaagccctgctgattaacctgcgcagcgatattcacggcgcggtgggcattacgctcgatgaagcgaccacccgcgaagatgtgctgaacctgttccgcgctatcgtcggcgacgatcacggtctggatatcgataccctggataaagacgtggcgctggatagccgttcgatcccggcggcgatgctgcgcgacgatgcgatcctcacccatccggtgtttaaccgctaccatagcgaaaccgagatgatgcgctacatgcacgccctggagcgtaaagatctggcgctgaaccaggcgatgatcccgctgggctcctgcaccatgaaactgaacgccgcggcggagatgatcccgatcacctggccggaatttgccgagctgcacccgttctgcccggtcgagcaggcggaagggtatcagcagatgatcgcccagctttccgactggctggtgaaactgaccggctatgacgccgtctgtatgcagccgaactccggcgcgcagggcgagtatgctggcctgctggcgattcgccactatcacgagagccgcaacgaaggccatcgcgatatctgcctgatccctagctccgcgcacggcaccaacccggcttccgcgcagatggcgggtatgcaggtagtggtcgttgcctgtgataaaaacggcaacatcgatctcgccgatctgcgtgaaaaagcagagcaggcgggggccaatctctcctgcatcatggtcacctatccgtcgacccacggcgtgtatgaagagaccattcgcgaagtgtgcgagatcgtgcaccagtttggcggccaggtttatctcgacggcgccaacatgaacgcccaggtcgggatcacctctccgggctttatcggcgccgacgtttcgcacctcaacctgcataaaacgttctgcattccgcacggcggcggcggtccgggcatgggcccaatcggcgtgaaagcgcacctggcgccgttcgtgccgggccacagcgtggtacagattgaagggatgctgacccgccagggcgcggtttccgccgcgccgttcggcagcgcgtccattttgccgatcagctggatgtatatccgcatgatgggcgcggaagggctgaagcaggcgagccagaacgcgatccttaacgccaactacatcgctacccggctgaaagacgcctacccggtgctctacaccggtcgcgatggtcgcgtagcgcacgaatgtattctcgatattcgtccgctgaaagaagagaccggcattagcgagctggatatcgccaagcgcctgatcgactttggcttccatgccccgaccatgtctttcccggtagcggggacgctgatggttgagccgacggaatcggaaagcaaggtcgagctggaccgctttatcgacgcgatgctggcgatccgcgcggaaatcgaccgcgtcaaagccggcgaatggccgttggaggataaccctctggtgaacgcgccgcacacccagggcgagctggtgggcgagtggaaccatccgtacagccgcgagctggcggtattcccggcagggttgcacaacaagtactggccgacggtgaagcgtctggatgatgtctacggcgaccgcaacctgttctgctcctgcgtgccgatgagcgaataccagtaagtttgcgttttagctaaacttttaaaggcgctgcggcgcctttatttttttggagggaaggtatgggaatagctcttattagcggcgcgagccgcggcataggccgggcgacggcgctgctgttggcgctggaaggatataccgtggcggtcaattaccatcacaacattaacgccgccaccgaggtggtgaataccattgtggcgtctggcggcaaagccacggcgctgcgggcggatatcagcgatgaagcgcaggtgatggcgatgtttgaggcggttgaccgcatgggcgaaccgctggcggcgttggtcaacaatgccgggatcctgtttacccaatgtacggtagagagcctgagcgccgagcgtattaaccgcgtactggccaccaacgtcaccggatactttctttgctgtcgcgaggcggtaaagcgcatgtcacatcggcatggcggcaagggcggggcgatagttaacgtgtcgtcggcggcgtcgcgccttggcgcgccgggggagtacgttgactatgccgcgtcgaaaggggcggtagataccctgaccaccgggctggcgctggaggtggcggcgcaggggatccgggtcaacggcgtgcgtccggggctgatttataccgagatgcacgcctccggcggtgagccgggacgcgtggatcgagtgaaaggttcgctaccgatgcagcgcggcggccagccggaagaggtcgctcaggccattgcctggctgctgagcgacaaagcgtcgtatgtgacgggtagcttccttgaactggcgggcgggaaataacccgtagatgtctattgcccggcggcgctgcgcttgccggccctacggggtcaaagccgaatggtaggccgggtggcggatacgccttacccggcataaaaaccgctaaagcccgacggcctaccaggaggccagccacagccgcaggcgcattccccaactgctggtccagccggtggtaaccgactttacctcgccttgagaaatgaccaccagcgttggcgttacctggatatcccattgccgcgccagctggccgcttggatcattcaccgtcggcagcgtcattttcttcctggtcagccacttctccagcgtgacgttatcgccggaacgcagggctaccgtcagcacattgccgccgtcggcggcaagcgatgccaccgacggcgtggtatagcgacaaactccgcaccaggtcgcccagacgtacagcagcagcggcttttgctggcttatggcgttcagatccagcgtcctgccgtcgagtgtctgcagcgatgtggcgctgacgttttgcggcagcgcgggctggcgaaaataatccaccgccaggctcaccgccgcgccaatcagcagccacaccgccagctcgcgcagccagcgcctgattttactggccacgggctttcgccagctgttctttcaccagcccctccagctcatcagcagggatcgcgccggccaccatctgatcgccgatgatggtcgccggggtgccctgaatattcagcacctgcgacaaaatcaggttcatcttcagcgaatccatggtcttgtcatcgatatttacgctatcggtagcggttttcttctgcgcggcggcgatactggcgtcatcgtgatagccttttttcgccatcagccgctgatgcagcgcccagaatttatcgggctgctgacgccaggtggagagcgcgattttagcggcattcaccgaactctgccctttaaacggcagcagcttaacgatgagctggatgtccggattatcgtggacgattttttccagcagcggatcaaactgtttgcagtaagggcagttgtaatcggtaaacgagacgattgtgagttttggctctttcgcgccggtgcgcgggctattcggatcgttaaacagcagctgggctaactggtcattaccgttcgattgtggttcttccgccggggcggcgaagctgaaggccgatacgcacagcagtaataaggcggtgatagctctcatgttattttcctttagcggcggacagggtagcgataagttgttcgcggtctaacagcgcaggcagaatctgtccctgcggcaattccggtccgtaaatctggttaaacggcaccgcggcgctgccgcgtgcggttaaaaactggctaatgtcagcggaggggcggctccagtcgccgcgcagggcgactacgtctggcgctaacagcgcctgctggacgtcgtcgcgcagcagcacgttgtatttattggctttacaggtcacgcaccagtcggcggtgacatcaataaatacccgcttatgctccgccagggcgctggcgatagcctgctcgctgagcggctgccagttaacccggtcgcggcgcgggccctggccgtcctgttgggcgacaaaggcgacggcgcccgccaccacgatggccagggcgcccgcgcgcagcgccgtccgccagcggtagcgccaggcggtggccactagcagggcgatggccagaatcaccagcagggtaagcaccggcgtacggccgatgtggatcgtcagcaggctgaccagccatagcgctgaaccaagcatcattagccccagcaccacccgcagatgattcatccagcggcccgggcgcggtagacgttgcgccagacccggccaggcaacgatcagcagccacggcaggctcatgccgatccccatggcgaagaaaatgccccacagcagcggcaggggcgccaccagcgccaccgacacggcggtaccgaggaacggcgcggtacagggcgtcgccagcagggtggcgaaggcgccctgccagaaatggcccattaagccgttgccgccgcgggtggcgaggaaagtgctggcgctggaggagaggcggatttcgaacagccccaataaactggcgctgaacagcaccatcaccagcgccatcgcgccgataaaccacgggttctggaactggatgccccagccgagcgcctgattccccaggcgtagcgcggtcatcatcagcgccagcgccaggaacgagacgacgatcccgcacaccgaggcgaggaactgccgccgcaccgcgccgcgttcgcgacgttcggtttgcaccagcgagccgagtttcatcgccagcaccggcagcacgcacggcatgacgttgaggattagcccgccggccagcgccatcagcagcacccagcctaacgccagccccggcgcggcgctgccggcggcgatggcgatatggctttcctgcgcctgaccgctatccgccagcaccagcgacagcgttttgccgctcaggtccggcgccgcttcgccccagctatcggtgaccggtacggtggtggtcaacgtaccgccgcggctggtaaagctcggcttaccgaaatcgacatcctccatgctgtcgataaacagcgctggctgctgccagccggcatcgcggcgggcggtcaccgtcagtttgccgctgacgtagctggcggtcagttgcgaagtcaggccatcgcgcagcggcagtgtgcccatcgcgcgggtaaaatcataattaaatcgctcccccgccggagtcgtcatatccagcgaaaagggatagtcagtgagaatacagacattgctgcaggtagagagcgtcaggacgccgctaagcgtcggtggtatcttcccgcgcagcgtcatcggaaagctgacgtcgccgtgatagccctgagtggaaatgcccgcgacgtcgaagcgctgcggcgtcggccagcgccagttcacctccagcggcgtgtgccaggcgatagccggcgcgatgccgccttcccctggcgagcgccagtaggttttccagcccttttccagcgctacgtctaaaagcaggcgagtgtcgccattgctctcggtttgcgcccgcaggcgcacgctggcgtgttgattgtcggcggcgcgcagccagccgctgtcggcggcctggctgacgggcagccatagccaaagcaggcagaccagtagtcgcctgaataccatatacataagtttgctccgtaagtgatgaattaacctgaactgtcaggagaatcaatcactcacggaagacgcataatcgcagatgcacccgcaatcggggtgaggagataacgcggggaggccactggcgttcgatacgcggcgggatcgccgccagcaccgccagcagcagggtgatagccaacagtgccccttcaaacagcatcggcggaacggccatcagcgacttggcgctgagctcgcacggcgtgaccggcgcctcggcctgatcctggtttttctgtagcgacgggctgtcggcggtgaggttcatgaccagcgcgtgcatcccggccatccgttgagcggtgcaggttagcaccaccagacaggccaggaggacaaaaagaatggctttgcgttgtcgcttaatcatgattgcctcaaatattcacgaggcttatcttaacgggcgaacgggttttggcaatggtaaagctgtaaagaagtgtctggcggataagcaattagccctcccccggccgggagagggcggttagttacaggttctcaccgttgctggcgatgacctctttgtaccagttaaagctcttcttgcgcgagcgggacatgtcgccggtgccatcgtcgtgtttgttgacgtagatgaagccgtagcgtttgctgtactgcccggtggtgaaggagacgcagtcgatgcagccccatggggtatagcccagcagatcgacgccgtcataagtgaccgctttgatcatctcttcgatgtgggcgcgcaggtagtcgatgcggtagtcatcgttgatgctgccgtcggattctactttgtcgtaggcgccaaagccgttttccacgataaacagcggcttctgataacgctcatacagttcacacagagaatagcgcaggccgaccgggtcaatctgccagccccagtcggaagctttgacgtgcgggttcggcacgctgccttcgaaaccggaaatggcgtcgccagtgccgccctcggctttcaccgcgttggtcatgtagtagctgaagccgagataggcgcaggtaccttcgcgcaggatctgcgcgtcgccgtcttccatcctgatgttgaagccgcggcgttcccattcattcaacacatagctcgggtagtaaccgcgcagctggacgtcggtaaagacgtagcgctcgcgcatcgactcctgggcgaacatgacatcttccggtttgcaggagtaagggtagagggcgaccatcgccagcatgcagccgacctgcatgtccgggttgatgcgccgcgccgctttcaccgccagcgcgctggccacgaactggtggtgcagcacctggtacatggtctcttccggattgtcatgctcggtatagaccaccccggagcagcagtagccgaacagcggcgcgcgccagttgcgctggttgttgatctcgttaaaggtcatccagtatttcactttgtgcttatagcgctcgaagaccacttcggcgaagcgtacaaagaaatcgaccactttgcggttggtccagccgccgtactgctgcaccaggtgcaggggcatctcgaagtgggagagggtgatcaccggctcgatgttgtatttcagcagctcgtcgaacatgtcgtcgtagaacttcagtccctcttcattcggctgggtttcgtcaccctgcgggaagatgcgggtccaggcgatagaggtgcggaagcacttgaagcccatctcggcgaacagtttgatgtcttctttgtatcgaccgtagaagtcgacggcttcgtggttcgggtagtattttcccgcttcgacctggtgggtgatttcgcgcggcacgccgtgcgccccgccggtcaacacatcgcagatgctggggcctttgccgccctgatcccagccgccttcaacctgatgcgcggcgaccgcgccgccccataaaaaatctttcggaagggttaattttttcatcctggctaatctctctaataactattgttctggagtctagcaaagtgaaagtgaatgtcacgatataacaaattccgccaaaggtaatatgttacatcaaaaaaacaggctgttatttttagctgattttgcgcgctaatttacgtccgagggattcgagaatatagatcactggaatttgcgttgtaatatcgtagacgccgccaatgcgcgtctgcggcacgtgccaggagagattgaaatcagccagtttggccagccgcgaatgctcatggctggtaatcgacatcaccttgcaatgatgcaggctgaactggctggcaaagcgcaggatctcttccgtctcgccagagacggaaagcacgatcgccagcgcgttgcgggccatatcgttggttacaggaaaataggggtcgtcaatatggttgctgaatttaccgacgttggagaagaagcgtgcgccatatttcgccagcgcgccggaggtgccggcgccgacaaaaataatacgttcggaggcgagaataatatcgacggcctgctcgagtaattcatcaaactcgtcattattgacgcttttaaaaaagctcattatttcgctggcgccgatatttgcctgttgaggctcattctgctcgagatataatttaaagcgcacgcgaaattcagagtagccctcgcactgcagtttgcggcagaagcgtaacacggtggtcgtggagaccccggcggcctcggccagttcgcggatggtcatgtacatcactttgtcacgatttttaatgacgtagtggtagaccatcatctcaagattattgagactggcgacagcggcgtgggagaacatactcacagggcgaactcacaattcataatgaccaggacggaattatatcatgcaggccaatgacattaccttttttcagcgttttcaggacgacatcctcgccgggcgcaaaaccatcaccattcgcgatgcagcggagtcgcactttaagcccggcgatgtgctgcgcgttgggcgctatgaagatgacggctatttttgcaccattgccgtgaccgcgacctcgacggtgacgctcgatacgctgaccgaacagcatgcgcaacaggagaatatgactctcgggcagctgcggcaggtcatcagcgacatctatcctggcgagagccagttttatgtcattgaattcaaaacgctttaagataatcaggaacagctgtgagttgaaataaaaatgtaactttatgattttaaagtatttacaaatatacatcgttttattttagctaacaggtgttcactggaatcattctcagttaccctaagtgggcaatgaaagcgttcttgttttcacggagtccagtatggttcgcaaaccattaatcactcagggatattctctggcagaggaagttgccaacagcatcagccacgggatcgggctggtgttcggtatcgttggccttgtgttgctgctggtgcaggcggcggatacaaacgccagcgcgacggcgatcgccagctacagcctgtacggcggcagcatgattatgctgttcctcgcttccacgctctatcacgcgatcccgcatcagcgggcgaaacagtggctgaagaaattcgaccactgcgctatctacctgttgattgccgggacctacacgccgtttttgctggtggggttgaattcaccgctggcgaaggggctgatgatcgtcatctggagcctggcgctgctggggatcctgtttaagctgaccatcgcgcaccgctttaaaattttgtcgctggtgacctatctgaccatggggtggctgtcgcttatcgtggtctatcagctggcagtgaagctggcggtgggcggggtaacgctgctggcggttggcggggtggtgtactcgctgggggtcatcttctacgtctgcaaacgtattccttataaccacgctatctggcacggcttcgtgctcggcggcagcgtgtgtcacttcctggcgatttatctttacatcggccagtcctgataaacatcccacggtggcgctgcgcttaccgtggctacaaaatactgcggccgggtagcccggctaaggcgcaagcgccgcaagccgggaacttttccttaattttcttccagcgaatacggcaatggtttgatgctcaggctgccagcatcgtcgcgtacacggaacacgctgtccggttccatgtcgttattcatcactacctggaccatcaggcttccgtcatccagctgtacggctgccagcaccgtaccggtgcggcgccagttgtcgcccatcttcagctccaggtcttccccggcttccggcacccggctggcggtccctgacagcgtccacagcgcgcgcttattggcgccgcggaatttcgccctcgcgaccatttcctggccggtgtagcagccttttttgaagctgatgccgcccagcgcctgcaggttggtggcctgcggaatgaactgcccgctgttggcgctgtcgataaccggcagaccggcttcaatattcagcgccagccactgttggctgttgttaaactgcgcttcgccgcgcaacgcgtcggtgacgcggttggcggtgtcgacatcggtcaccagcaggaagcgctcgcccgggtgttcaaaccacagcaggctggtagcgccttcgctgaccaccggggtggcagcgtcgggcaaggcggcgaacagcggcgccagcgcggcgcgcgcctggaagccggccacccccagcagaaccagatcgtcgttggcggcgatggtgactttggagaagacggcatattttttcagctcggtcagctgcgcgtcgcgcaggctgcggcgctcaatccacgcgaagccgccctcgcgacggaatacgcgcaggttgctccacatcttgcctttggcatcacagtgggcggcaagcagatgctgggcatcggtgagatgactcacatcggcggtaatctgcccctgcagatatttttcgctgtccggcccgctaattgtcgccagcgcccagtcatccagggtcatcagcgttaacggcagacgagcggaagaggaaggctgacgcggaggaaaaggtgtaaaagccatagtcatatcctgaatcgcttaacgcagtgtgtgtgaccaatggtaaaagagctatagtgcattgcaagtgctttcaacaggccatttgtgcgctggcgtgagacagccgcctgacgcagggaatcaataaacccatcattattttaaggtttttatggaaggatgctcgcattcagcgatattcctgtaaagttacggcagaaaacgggttaaactaacctatattttgctgctggaaggtcaacatggacattaacaataaagcacgtatccactgggcatgccgccgcgggatgcgcgaactcgacatctccatcatgccgttctttgagtatgagtacgataccctcagcgacgctgacaaacagctgttcattcgcctgctggaaaatgacgatccggatctgttcaactggctgatgaaccacggcaaaccggccgatgcggagctgcagcggatggtaaccttaattcagacacggaatcgggaacgtggtcctgtggcaatctgatctccgtatctcctggcgcgcgcagtggttttccctgctgcttcacggcgtggtggcggccctggtgctgttggttccctggccgctgagctataccccgatctggctgctgctgctgtcgctggtggtcttcgactgcgtgcgcagccagcggcggatccatgcccgtcgcggggagataaaactgctcaccgattcccgtcttcgctggcaaaacgccgaatgggaaatcctcgggacgccgtgggttatcaatagcggtatgctgctgcgtttgcgccatgtcgatacccggcgcggacagcatctttggctggcggcggacagcatggacgccggagagtggcgcgatctgcgccggctggtgctgcaaaaaccggcgcaggagtaagccgcgtcaggaaaagtgttcggccatttcgccgaggatctgctcgcaccagctctggatgcgctcgtcgctcaggtcgtactggttggtttcatccagcgccaggccaacgaacagttggccatcggcgatcactggtttcgggctggtgaactcatagccttcggttggccagtagccgacaaacttcacgcccttggtcgccagcttgtcatgcagcatgccgagcgcgtcaaggaaccattcgccgtagcccagctgatcgcccatgccgtacagcgcgacgatctttccctcgaggttcagggtgtccagctgatcccagaccgcttcccagtcttcctgaatttcgccgaaatcccaggtcgggatgccaaggatcagtacgtcgtactggctcatcagcgcgggggagtcatctttcagattgtgcagcgtcaccagctcggggccgatgatatcgcggattttctccgcggccatttcggtgtagcaggtactggagccgtaaaacagacctatattcatcgcgtaaacatctcgattcttgccgtgaatggcgggcagtgtaccagaaaggcgtcctcttaaggcataatgagagcgtttaacgaacaatgaggccgatgtgaaacaggatctggcactaatcgaacagtttctcgatgccctttggctggagcgcaacctggcggagaatacgctcagcgcctaccgtcgcgatttgacgatgttagttgagtggttgcaccatcgcggcctgtcgctggcaagcgttggcagcgacgatctgcaggcgctgctggctgagcggcagtccggcggctacaaagccaccagcaccgcgcgcctgctgagcgccgtgcgccgttttttccagcatctgtaccgggaaaaaattcgcccggacgatcccagcgcgctgctggcctcgccgaagctaccgcagcggctgccaaaagatctcagtgaggcgcaggttgagcgcctgctgcaggcgccgctggtggagcagccgctggaattgcgcgataaagcgatgctggaggtgctgtatgccaccggcctgcgcgtctcggagctggtggggctgacgatgagcgacatcagcctgcggcagggcgtgctgcgggtggtgggaaaaggcaacaaagagcggctggtgccgctgggggaagaggcggtactgtgggtggaaaattacctcgagtatggtcgcccctggctgctgaacggcgtggcgtcggatgtcttatttcccagccagcgcgcccagcagatgacgcgccagaccttctggcatcggattaaacactatgccgtactggcggggatcgacagcgaaaagctttccccgcacgtgttacgccatgcgttcgccacgcatttgctcaatcatggcgccgatctgcgcgtggtgcagatgctgttaggacacagcgatctctccaccacgcagatatacacccacgtggcgaccgagcgtctgcgacaacttcatcaacagcaccacccgcgggcgtgagtgctgaacaaaaggactgagtatgaaaaaaggtttattgatgttcaccctgctggcggcctccctttcaggagcggcgcacgccgatagcgcggcaattaaacagtcgctggcgaagctgggtgtgcagagcaccgatattcaaccatcgccggtttccgggatgagcacggtgctgaccgacagcggcgtgctgtacgtgaccgacgacggcaaacatattatccaggggccgatgtacgacgtgagcggcgcgcagccggtcaatgtcaccaaccagctgctgctgggtaagctgaacgcgctgagcaatgagatgattgtctacaaagcgccgaaggagcagcacgtcatcaccgtcttcaccgatattacctgcggctactgtcataaactgcacgagcagatgagcgactacaacgcgctggggatcaccgtgcgttatctggccttcccgcgccagggtctgcaaagccaggcggagcaggacatgaaggccatctggtgcgcgaaagatcgcaacaaagcgctggatgacgccatgaatggtaaaggcgtgcagccggcgagctgcagcgtagatatcgccaaacattacaccctcggcgtgcagatgggcgtcaacggtacgccggcgatggtcctcagtaacggcatggtgctgccgggctatcaggggccgaaagagctgaaggcgttcctcgatgagcacaaaaaacagacaagcggtaactgattcgcgtgaaacaacagatacaactacgccgccgcgaggcggttgacggcgtcgaactccccgccgacctgccgccgctgctgcagcggctatatgccagccgcggggtgcgcagcgcgcaggagctggagcgcagcgtcaaaggcatgctcccctggacgcagctcaccggcgttgaaaaagcggtcgagatgctacatgacgcgttccagaaagggttgcacatcgtggtggtcggtgattttgacgccgacggcgccaccagcaccgcgctcagcgtgttggccctgcgcgcgctgggttacggcaacgtctcctatctggtgccgaaccgctttgaagacggctacggtttaagcccggaagtggtcgatcaggcccatgctcgcggcgcgcagatgatcatgaccgtcgacaacgggatctcgtcccatgccggcgtcgatcatgcccatgcgctggggatcccggtgctggtgaccgatcaccatctgccgggcgagacgctgccggcggcggaagctatcgttaatcccaacctgcgcgattgcgacttcccgtcaaaatcactggccggggtgggggtggcgttttatctgatgctggcgctgcgcacttttctgcgcgataaaggctggttcgacgctcgcggcatccccgcgccgaaccttgccgagctgctggatctggtggcgcttggcaccgtcgcggacgtcgtgccgctggatgctaacaaccgtatcctcacctggcaggggttaagccgcattcgcgccggcaaatgtcggcccggtattaaggcgctgctggaaattgccaaccgcgatccgcaaaagctggcggccagcgacctcggtttcgccctcgggccgcgcctgaacgcggcgggacggctggacgacatgtcggtcggcgtcgcgctgctgctgtgcgacaacatcggcgaagcgcgggtgctggccaacgagctcgatgcgcttaatcagacgcgcaaagagattgagcaggggatgcaggcggaagcgctaacgctctgtcagcagctggagcgcagcgccgataccctgcccggcgggctggcgatgtaccatccgcaatggcatcaaggggtagtcggcattctcgcctcgcggattaaggagcgcttccatcgcccggttatcgcttttgcgcctaccggcgacggcacgctgaaaggctccggtcgttccattcaggggttgcatatgcgcgatgcgctggagcgccttgatacgctttatcccgggctaatcctgaagttcggcggccacgcgatggcggcgggcttatcgctggaggaggcgcgttttgaagagtttcaacagcgcttcggcgagctggtgaccgaatggctggatcctgcgctgttgcagggcgaggtggtttccgatggcccgctggcggcggcggagatgagcatggaagtggcgcagatgctgcgcgacgccgggccgtgggggcagatgttcccggaaccgctgtttgacggtcgttttcgcctgctgcagcagcggctggtgggcgagcgtcacctgaaggtgatggtcgaaccggttgacggcgggccgctgctggacggtatcgccttcaacgttgatacttccatctggccggataacggcgtgcgtgaagtccagttagcctacaagctcgacatcaacgagttccgcggcaaccgtagcctgcagctgatcatcgatcacctctggccaaattgacaacagtgtaggaataagggcgcgaatccggtagaattccgctcttatcaccgcattttgacaaatccattaaaagaaaccgaccatgtttgaaataaatccggtaaaaaaccgcattcaggacctcacggagcgctccgacgttcttagggggtatctttgactacgatgccaagaaagagcgtctcgaagaagtaaacgccgagctggaacagccggacgtgtggaacgaacccgaacgcgcccaggcgctgggtaaagagcgttcttccctggaagccatcgtagataccctggatcagatgtcccaggggctggaagacgttgccggcctgctggatctggccgtggaagcggacgacgaagagacctttaacgaagccgtcgccgagctggataccctggaagagaagctggcgcagcttgagttccgccgcatgttctccggcgaatacgacagcgccgattgctaccttgacattcaggccggttccggcggcaccgaagcccaggactgggccagcatgctgatgcgcatgtacctgcgctgggcggaagcgcgcggctttaagaccgaaatcatcgaagaatccgaaggtgaagtcgcggggattaaatccgtgaccattaagatcattggcgattacgcctacggctggctgcgtacggaaaccggcgttcatcgtctggtgcgtaagagcccgttcgattccggcggccgccgtcatacctccttcagctccgcgttcgtttacccggaagtggaagacgatatcgatatcgaaattaacccggccgacctgcgcattgacgtataccgcgcctccggcgccggtggtcagcacgttaaccgtacggaatccgcggtgcgtattacccatatcccgaccggattggtgacgcagtgccagaacgaccgttcgcagcacaagaacaaagaccaggccatgaagcagatgaaagcaaagctttatgaactggagatgcagaagaaaaatgccgagaagcaggcgatggaagacaacaagtccgatatcggctggggcagccagatccgctcttacgtgctggatgactcgcgtattaaagatctgcgtaccggggtggaaacccgcaacactcaggcggtgctcgacggcagcctggaccaatttatcgaagcaagtttgaaagcagggttatgaggaaccaacatgtctgaacaacaagcacagggcgctgacgcggcaattgaccttaataatgaactgaaaacccgtcgcgagaagctggctgcgctgcgtgagcagggcgtcgctttcccgaacgatttccgtcgtgaccatacctctgaccaactgcacgctgacttcgatggcaaagaaaacgaagagctggaagcgctgaacgttgaagtggccgttgctggccgcatgatgacccgtcgtatcatgggtaaagcgtccttcgtgaccctgcaggacgtaggcggccgcatccagctgtacgtggcgcgtgatgacctggcggaaggcgtttataacgaccagttcaaaaagtgggacctcggcgacatcatcgccgcccgcggtaagttgttcaagaccaaaaccggtgagctctctatccactgcaccgagctgcgtctgttgactaaagctctgcgcccgctgccggacaaattccacggcctgcaggatcaggaagcgcgttaccgtcagcgttacctggacctgatctccaacgatgaatctcgtaagaccttcaaagtgcgttcgcagatcctggcaggcatccgtcagttcatggttggccgcggctttatggaagtagaaaccccgatgatgcaggtgatcccgggcggcgcttccgcgcgtccgttcatcacccatcataacgcgctggatctggacatgtacctgcgtatcgcgccggaactgtacctcaagcgtctggtggttggcggcttcgaacgcgtcttcgagatcaaccgtaacttccgtaacgaagggatctccgttcgtcataacccagagttcaccatgatggaactctacatggcttatgcggattataaagatctgatcgagctgaccgaatctctgttccgcaccctggcgcaggacatcctcggcaataccgaagtgccttacggcgaccaggtgttcgacttcggcaagccgtttgaaaaactgaccatgcgcgaagcgatcaagaaataccgtccggaaaccgagatggcggatctggataactttgattccgcgaaagcgatcgctgaatctatcggcatcaaagtggagaagagctggggtctgggccgtatcgtgaccgagatcttcgaagaagtggcggaagcgcacctgatccagccgaccttcatcaccgaatacccggcggaagtttctccgctggcgcgccgtaacgacgtcaacccggaaatcaccgaccgctttgaattcttcattggcggccgtgagatcggtaacggctttagcgagctgaacgacgccgaagaccaggcgcagcgcttccaggatcaggttgatgcgaaagccgcaggcgacgacgaagcaatgttctatgacgaagactatgtcaccgcgctggaacacggcctgccgccgaccgctggtctgggtatcggtatcgaccgtatggtcatgctgttcaccaacagccacaccatccgcgacgttattctgttcccggcgatgcgtccgcagaaataatcgcccttcgcgaagagcaaaaaacccggcttgccgggtttttttatgtctgatgtgaggtcctaaggctggcgtagcctggctcagcgcagcgcaagccggggatcccggatggcggcgtaaacgccttatccgggctacgcaatggcgcagaaccgtaggcctgtgcaagcgtagcgccgccaggcattaatgacaggcacagggctgcgcctggcctggagaatagtcagcttacccgcgcagacgcgcaacaaagtcggtcagcgcctggcgggcgtcccgattttccgcttccagcaccatccacgggctgaacgcccacggcgtggcggccagcgcgcttaacatggttgccaggtcaacccactgatagtccatgacttcatcgtcgttaggctgcacttcgcttaccacgcgcgcggcatataccgggcacacttcgttctcaacgataccgtttggggcgaccgcccggtagcggaaggccgggtgaaccggcgcgatatcagagatctccacaccgagttcgaagcgacagcggcgcgtgacggcctgctcgaaggtctcgccctgctgggggtgtccgcagaccgagttggtccataccccgggccaggcttttttgcccaacgaacggcgagtgaccagtaactgaccctgctggttaaacagccagcaggaaaacgcgagatgtaaaggggtatcaaacgtatgggcggcatacttctccagcataccggcaggctgatcctgctcatccagcaaaatgacgtgttccccggccatgacgactcctgaaaataaaaaatgacccggcacaaacccgccgggtcatgtactcaggccactagggtagcccataaatgggagaaaggcattaccaaaacaagccctggcagcatgttggcgaccgggaaaagcttaatgttgcagatgcgtaatccagtggccaccatcagcaatccaccggcgcaggagaaatccgccatcattgacggcgtgatcatcggcagaataaacaccgctagcatcgccagcgccacctgaatcacgatctgcgggatagcgatggtcatcaccgcgtagcccagcagcgtcgcgaagatcccggcggtaaaaagatcgaggatggttttaatgtacaggattgatggatcgccgctcataccttcggtcatggcaccaaaaataccggtaccgctggcgcaaaacaggaccaaaatagccacgaatttttcggtgaactcttcatgacctaatccctgaacgggtggaagaactttattaatcaacccgcgcgttgatcccgccgcgctgccgatgcgtttttccagatgcagcagttcgccgaggaaggcgccgagtaccatcgccagcactaccgccggcatatatttcaccttcagtaccagggtgatacccaggccgacggagcagagaccaaaggtcatcggcagggctgttttgacgcgttccggaagttttcctccggccattgcgccgatcaatccgccgataatcacggcggaaccatttacatacggaccaattaacattgcgagttcctgttacgtgtaaagcagctcgccctcaccccagcgcgggatgttattgacctccaggtcaaacaggtcaagcgcgcggtttacgctatgggtaataatgtcatctgcgctttgcggacgctgatagagtgcaggcaccggcggaaagatgatgccgcccatctcggtaactgccgccatattacgtatatggccgagattaagcggcgtctcgcgcgccagcagtaccagccgacggcgttcctttagcactacgtccgccgcgcgggtaagcagattatcggtgagacagtgggcgatagcgcccaatgatcgcatcgagcagggggcaaccaacatccccagcgttttaaacgagccgctggagatggacgcgcccagatggttgatgggatgtaccacgtcagccagcgccatcacttcatctaagcggtaatccgtttccagctcgcaggttttttccgcacctttggagaccaccagatgaacctctatcgccagtggccgcaaaagttccagcgctttcacgccgtactggaacccggaagcgccgctaatcccaatgatgatgcgtggtgtcatggtattcgcccttattcgaagtccggcaggaaacgttttacatcaaccgctttgaacttagagcgctcaaagttgtgtttcagatggaacggtacggtgcagtcgaaaatggttttgcacgacattccctgctgcagcacgctcgggctgtactctggcacctgcgacgggtcgagcggatgacagcgcacacccgggatcattacggtatcgacatcaccctggtagcgggtttgcatcgcccacagcacatcgtcgctatcgaaaatatcaacatcctcatccaccaaaatgacgtgcttcagctccgggaaagcggagaacgccaggagcgccgcctggcgctggcggccttcatcggcaggggaagatttcttaaattgcagtaccgccagtagtttgccgccgcctgccgagtgggcgaagacgttgagtaatttgcccggcatggcgcgctccaccatatcgagaatactcgcttcggtcgggatcccggccatgttgacatgttcttcgcctggtccgacggtggtgcgccagataggctgagtacgatgggtgacggctttgactttaataaccggaatcgcctctttcgcttcaccggtatagcccgggaactccggcattgcgcggccggtatgggtgttctgatcttcgcgtacgcgcacgttcggcaccagttcgccttcgataacgatttcggcgtgggcaatggctttttcattaatagtcttacattgcaccatctccaccgcgcggccacgcagcgcgccggcaatgcttagctcgttgaaacccagcggggtggtcggtggctcaaagcaggcggcgatttcgatagccggatcgacgccgatactgatcgaaataggcagcggctggcccgccgcttccgccttcatgcggaaggcatcgatatgacgacccggcgtcagccacattgatagctcatcgcggctctggacacacaggcgatgaatagtgatatcggattcatgggtttgcgggtcggaggcgtagcacaggcccatagtgatatacggaccggcatcttcttcggtgttagttggcgcaggcagcagtttacgcagatcaaaatcagcatcgctggcgaggtgaaccacttcctggcataccgccgtgccctgtaccatggttgggctaatagcattttcaacggaatctttcagcaaatgacccagttttgccggttcacactgcaggaactggctaacgcgctggcgcgagccgttcagaccgatggccacgctgatatcgtcgaaccccttaattttgttaaagaccatgaccgggccgttcttgcgcgttgggcgctggcaggtgccgccggcgcccacgtagcggtatacgcctgagagctcggcgtgaggatcgacttcggtatcggtctcaacatattcgcccggcagcgtttttaacagtgccagagccgaacgtaaatcatgcaccggtgacggcgtttttttatctgaatttgccatgagtgttcctttaaaaagcaattttgctaagcgcacaatatttttcttcgataaattaaacaaataccgtttaccggatggtcagtagatcaaaaaagttggttttaaaaaaatgttaataaacaattaatcaatatggtgaattcgacgcggctttttatttctcagcgttagtgtgatactgcccggaagataattaatgaggccggtcatggatcttaaacgcttacgctatttttgccgggtagtggaacacggttcggtgagtcaggcagcgaagtcgctcaatatggcgcaaccaccgctcagcaagcggattcaggagcttgaagaagagctgcaggtttcacttttcgagcgccgcggcaaccgcattgaaccgacggaagcggggtatttcttatatcggaaaggctgtgaaattttacgccaggtggaggataccgctcgggagacggccgatattgcgcaaaagacccgcgtggaagtacgtattggcttaactcatctgtaccagaattattttcagcctttattaatggagctctatcggcgcaatcctgaaaccgcgataaatatctcggtgactgactcaagtcatctggaaacattattaaatgaaggcgctatcgatctggcattaatacagcgaccctaccgcggagaaggcttcgattatatctccttcgaccccattaaactggtagcggtcattaataaaaaatgcctgtcgcaaccgccttccaacccctatgactacaatgctctggcggagatgccgctggtgctgctgcaccgggcgaaagattccggcacctatgaaatgttaatggacctgttccgtaaatccggcgttagcgcgaaggtgattatgcatattacccagcccggagtgatcctcgactggctggaggacgggctggaagcggcgacattgctgccatcttcggaagtgaatgccgaaaaacttcctcattgctatgtggttgatgtcttcccctcaccgcaaatattttatccggctctggtgaaattgccgtcgatgccgtatctgccggcgctgatggatattatcgccgggggttatccttttaccgcgccgagggagtagagatcagagaaaaagcgtagagcattggggattgttgcacggactggtatgatattcgccctgattgcgaggtaagtggttgtgttaagtgcaggatgcctgatgatgaaacgcttttatatgacactgatgctggctgcaagcctggtgctggccggctgctccagcacctccgattccggtggcacctacaccgttaaacgcggcgataccctgtacggcatctcccgcaccaccggcaccagcgttcgcgatctggcccgcctgaataacatctccccgccttacaccattgaggtggggcagaagctgaagcttaacggcagcagttcaacgaagacaacgaagaaaaaatcttcctctacgcgcaccgcggcggtcacgccttcgtccgcggtacctcagtcctcctggccgccggtgggacagcgctgctggcgctggccgaccagcggcaaagtggtcctgccttattccaccgccgatggcggcaataaaggtattgatatcgccggaacccgcggccagccggtgtatgccgccggggcgggcaaggtggtctacgtcggcaatcagctgcgcggctatggcaacttgatcatgattaagcacagcgaggattacatcaccgcctatgcccacaacgataagctaatggtgaataatggccagagcgtgaaggccggccagcaaattgccaccatgggcagtacggatgccgactcagtgcggctgcatttccagatccgctaccgggcgacagccatcgatccgctgcgttacctgccgccgcagggaagtaaacctaagtgctaaaaggttattttatcgccagtcagcatccggcaggcttgtcacagggtgcgtaagggctataatgcttctcgcacctcttcgcgggcgtagttcaatggtagaacgagagcttcccaagctctatacgagggttcgattcccttcgcccgctccaaattcaagtctcctgaagtctaccaaactcaattttcccttgataaatcagcggttatagcattctgttagtctattgaactccgacggaagactccgctttggttgcgggatcggcgttttgcgctgctggcgctggagtcgtagcgtttagtgatatttttgcgcttatcctgtttccgcaggatgagtgattttacgcaaccggctcgcgctgacgacgaccgataccgcagaggccgcggcggcgctccacagcgcaacatgaattgacctttcatctgctgccagcagaacggctacggcggcggctcccaggcactgcccgaaagtgcgcataatggataaaacaccggacgcataactcgcgtgctcacgaataacgtttgagagcatttcccggttattgggactctgaaagcagccaaaccctattccgcataccagacttcgcaggcagatatcccacattgaagggctggcgggtaatgtcgccagcaggatcaaaccgacgacaaataccaccagccccagggtggatatcgccggggctgatatcgtgtccgcccaacggcctgcatgcggcgcaatcagcacgatccctaatggccacggcgtaaacagcagggcagacactaccggactgtagccgtattcgctctgaaacaggaagggtagcgcaataaaggtgatcccctggctgacgaaagcaaccatcgacgtgaaggccgcgagggtaaaacgttcatttttaaacatactcggcggcagtaagggatgacccgtgcggcggatttgccagataaaagccatgccgctcagcgcagcgagagccatccagcaaaggctgccgaattgagaagtagcgttctgtaggctgttcgccgccatgatcgtcgaacccaacagcagcgccgacaatatggcgcccacggtgtcgaagggcgcctgcatacggatcgcatcccgcggcagcgctctgaccgccagcagtagggcgagggtgccgggaagaacgtttatcgcaaacagccattgccagctaagggtgtgaaggatcgtaccgcccaataccgggccgatagcggagctcgaggcaatgagcagggcatggaaccccagaatgcggccaagtaagcgtccgggaaatacggacctgagtattgcgggggcaatactcagcgtcgccgcgccgccgatcccctgaagcacgcgcataccgataagcacttcgggcttattcgccagcgcacaacccagtgatgtcagggtaaaggtcgtcaggcccgccagaaatacggggcgataacccagacgggccgcaagcgccgcgaatatcgccagcgtcatcgcagctgccagcagatacccgttggcgaaccagacggcaatactggcaggtacctgcatctcctgagccatggagggcagggcaatgttgatcatggtgccatcaaacacgcccattaaggtggtggtcattattgcggccatcacccgtgcgcgcgccgggccaggcagtccttcgtcgccgggttgactggaaaagagcgtcatcatttgtcctctgagaagagtgtatggatgacaaaactataaagatggcttttaccaggcggaaggcgcactattttcactttattgttgcatcaaacgccttatcttaatgtgctgggaggaagggtaatgtctgatcccgattttaatttgctggtagctctcgacgtactgctgagtgaagcgagtgtcgcaggtgcggctcgtcgtctgaacctcagcacttcggccatgagccggacattaagcaggttacgcgatgtcacaggagacccgatcctggtacgcgccgggcgtaacatggtactgaccccgtgggccgaagcgacccgggatcgcgccaggcgtgcagtgcacgatgccagggcggtattacagccctcaactgaaacgttcagcgcgcaaaatctggcgcgtctttttaccatcagggcaaacgatggttttgtggtggcgtttgggcctgcgcttatagcagcggttgccgacgcagcgccggacgtctgtatacgcttcgcgcctaagccggaaaaaacgtcgcgctatcttcgggaagggctggttgatctggagattggcgttcagagtaatatggggccagaaatacggctgcaacgactgtttgaggatcggtttgttggcgtcgtccgtaaagggcacccgctggctaagcaggctgaaataggcgtgagtgattatgtcgcctggggccatgtggtagcgtcacccgagggcgcgttgcacggatccgttgacgatgcgctggccgaactggggacaaaacgtaaaattgcgagcgtcgtaccgggatttccgacagcactttccgtggcgctggaatcggatcttatcgccatgatacccgcactctatttactcaatcagcaggtaacggaccaggtacaccttttcgagctgccgttcaaaagccgtcgtattacggtatcgcagatgtggcacccaagaatggaacgcgaccccggtcaccgctggctgagagagcaaattcttgcgatatgcggtgtggccaggtcagtcatgactaaggagcctgtatagcgattgctataacatcaacttaagttaatgatgcagttcattgatatttaagatgaaataaattaagtgtagtagctaaattgagatgttcgtctcggggatgcggatgttttcctggactggttatgtatttagcccaagatgttgccggtacttcatcggactcattgcacctactgataccttaattcgcttatcgttataccagcgtatttaactgtccagaaggcagataaatttttccagtgttatgtctgcccattttctgccgtagaacatttcatttttgacccgcccgaagaagcgctccataggactgttatcccagcagtttccgcgccgactcatactctgcttgatccggtatcgccacagtaactgccggaactgcctgctcgtataatgactgccctgattactgtggaacatcaccccgacgggcttaccgcacgtttgccatgccatttccagcgctttcatggtgagtctactgtccacaccttacgaccaggcagaatggtagattcaactatctactgctcacgatgtacgctactgcgtagcatgataagccccttcctttagcttaaatattccaggaatgccctgtggatcagggtttatctttcaatcctaggacaaacggtacggaatcgcgtagagaaggatttaccgcgccgctgtggtcaagtccggggtagagatgaatattagtatgcgtacctgccgcctgcacgtctttggcaaactgctgttgcatagctgttggtacattaatgtcgtctccaccaatgccaataaataccggatgcgtgattttcagcgtcggataagaaagtgaagggagcgcattagtcagcagtgactggatattaggtgtcagactattgttcatattcaggcggttatgcatcacgttttgcgttaacggggtgatacagagggcttttgcctcatccaactgtgctaaggcagcgttctggaagtaattctccgccttcagcgtagggttagtatccgcagccgattgccatatataaaaaatatacggtattttaggatcgccagatgactgatttttatcatcacttttggtgaataagctggcaacatcgctctctgcagaaaaatagggggtgccagttagcacggtcccgatgatattcagctctggtgcgtaggtgggctgatagcctgctgcagcaaaggcggcgtgtgccccctgagactggccaaccagtaccagttcgtttttaagcggaaattcagtgagcgcagcacgtataccgtcaagcacgctccagccctcaccttgtgcgttaagatagtggtgcatcccgtctgagcctaatccgggatagtcaggagccacaaccgcgtaccccaaagaaagccatgtattaagatattggctgtctcgtgccgtgcgtgtattcagtgacggtgcgcagtccgagtttattcctactgtgccatgtgtccaaacgattaccggccaaccgccctctggctctgggccaaagggaataaacactgccgcactgtccgtacgctctcctttgccccgtacaccatccacagccgtatactcaatccggtactgactcttcgcctctaaaagcccatgcgcgggatccagtggcattttcgtcaccactgtccccgtctttgctattgcaatacttgtgacaggtaaaataagggtgaagactactaagctttggtttactaattttttaaggtacatagcttttccttgattttttataatgggcctggcgaataatcgggagcaattctgcaatctcagactaacgaatttcgataggcaccatgcaacatcattacctcgggcatgttgcaaatagcctccttaatacgctggaacatcgccaagcgcaccttaccacaatcattacaaatgaacctgcaacaggggatgcatgccggtcgcagattcaatccgtaatcttcgtgaaggattggtgtcagtatagtgatcgtcaacggttgaatgcgtgaagctgaaataggcagaaaaaacaggcatagggttaccgtgcctggtgctacgacgatgatctcttctaagaaaaaatactcatagaatgagtggttatgttgtgagtaatctttatgtcaatatcaagcgcagtcggttctacaaggtggagtttatgactttcttgtaaaatcagtaggttaatggaacaacttgaaacaatagatgctcatgtttaatcctggatatggattagctgttcttatgtatagttgttgtgcagctgaatttatgtgatcaaataatcataaccaaaaaatacctattggttatagttgctgtgtgtgattaattattttgaattaatacgttttgtttttttgtgataaaaattattataatcagttggttattttattttagtcattttattaagcaaaccttaaaaattttaatgttgttaaaaacaattttgatagtttttgtctatgttgttttttgtcttcaatcggtataaactatttctattctctcgaacaatgttttacttttctaatgttttatggggctaaatgctcttccctggcttgaagaagcaacctatttcctatagacaaaacgattttgcaataatgaatatcttcaggtctatgataaacaacacttttgttttcctgcgatggttttagctgcgagtgtttttctctgatcaagaaataactaaaaaattcagtatgttacctcgcttttcctctattcgttaattttatttattattattggtttgaacaaaatgatcgtatgaagtgtgagttgtttgagtgtcaggttttagcaaagaggatatttctaatacaaattaattgagtttttttatgtgatcagaaatgaaagttcggctttctttttttgattaatttaattttatgcaatcaatgcgagtaagaaaatgttggaatattgtgtgacgcagacaacttactttttaaatgaatcgtctgtttatcggcggatgaattattttttagttcgtttgtatgaagatcaaaaaaaggccatcagcgaaagaggtgttcaagataaatgccagatttaaatgatggaactctaaccgaagagagaaatatcagcgtggtcctgattaatcgttatcctctcgaatctatagccataaaatccattctggagaaaaaaggagtggccgttactggcgagacgataagcggtattgatgctcttagccttgttgaccaattgaggccaaatgcgattattatcgatgtcgatctgccagatattgacgggattgaactggtagagacgttccgtaagcgtcagtataaaggaagcatcattgtgacctcgaataaatacgagtatttttattcccgatgtgctgccaatgctggaggcaatggttttgtgagtaaaaaaggatcgatgaatgtaattccttccgctgttctggctgcgcaggatggttattcttattttccgttttcgcaacataatgcttccggggaggaaacgtttgccaggaataagctacaagccttatccgagcaggaaactatagtattgcgatatttactcgtgggggatagtaattcacatatagccaccaaaatggatataagctcgaaaactgtttctacttataaaagtcgtctgatgaaaaagctaaattgtcaaacgctggtggaacttattgggtttgccaatacatttaaaattgataacgcctatatttatgaatagctatgtgggaatcatatgcttatatttagtgattactccttagtggttagggttatatattgtgataagttcaccaataatatagcctggcggttgtgtttattgttcatggcgaaaagtgtcagccggtaatagcaatgactgcttgtatagaaaggtaatgcaatcgtatgccactaactgaaatgaatgccatgcaaattgctctttccggttatgctgagtaaaagataactgcataaggagcataggagtttcattttttaggatcgcagatgacaactcgctgtgacgagttgaaaggggattaaacagcggttgttatttagtgtaagcatagtgtagtttgaagtcgcgtatcataacgtctggctgccgattgatttctggtattcgagcagccactcgccaaacccgatgaatatatcctgtactgagagcgtaatctggcacttagagagataaagggtgatatgttttcttatccaacaaggtgaatgaagatggaatactaccgtccccacttcaacaatggtctggatattgtttaagggtggctgaagcgttcaccggtttcgaaccacaaggctatgaccgtttgtacgacaacatcttcatcataatgaatgcgatcgaaattccctcgatagtgaaaagcactcgttcctgagccaatgaaaatatatcgttgccgacggcaggattgaaggctaaagcaattgtggtcagacaaaatgaccagcggaagtaatttttggccccaaactgtaacattaacaggaacatcccgccaacaatggttaagtgaaacaaggggtaaggataacatgccaggattatgcttccggcaatggctcccagtattgttcccatgcttctggtatgtatgcgatatcgcgtttcctcccatgcaggtttaatcacccgcagcgaggctgcggggatccagcatgcatgtgccaatggaataagcgacacggccgcacttcctaacaacgcggtgagggtaatgcctaatagaaaccagcgttgtttcggtgacttcaatgggtaaaggggagtgagagctggtgagaggggctttttggggataaagagcagaataaagggaatagcccacaggcaacccagaccgaaggaaaaaatgtactgacttaacttttctgaggatgattgtccgtgcgccagaaaaaaaacaagagctgccagtgagaccggcaggcgtagattccctccacgaagttcagccatgccttgcgccagggcagccaggatggtgaacaggaaaaaataaattgagccgcttggggcactgagacccagcaccgcgaaaaagatcattattgcggccgcagtgaatacctgcaggagtgaattccgtgcaggcaatactgaaaaagaaatcatcatcatataggcaccaaaagaggcaatactcccggatcccggctcctgcataatgacacttatcatccatggaaagagcatggcaagtgtgagcgcaatgggtgatatttttaagttgattacaggtcgctgtattttatttatcactattttatctttttaattcaaaggaacaacgcgggggtgtttgtgttccacaaatagtccgcccgcagccagtgggatggcaaataccaatcgccgttgtatagggaaccagagtatccatttacatatatcccgtaaggataactaacctgtaaattgtttatagagctaccgattgcctttattttgtgaagataagtctatttctgctgaaaaaaatcagcggttatctttcctaatgcaatcaattgttgttcaagcaattgtatatcctgctcgatcagagaaagcggttgccctgttgccagcgcattttctaatttatctgcaagatggtgtaaagaaattgcgccgattaactgtgctgtaccattaagacgatgtaaatgatattgaacgatatcccgttcaccactggacattgcttttttaagcgccgccagatcgttgatattctcatggtatgcctgtttaattaattcaagcatgaatgctgtatcatccattgcgttatcccgtagtacccgcatatcgataagctcattaaaggctgtcgtatcatatggtgtgtttaatgacgccgatattccagaaagaattgatttttccagacgcttcgttatgttgttaaaagcggcagcgagttgcggcaaattaacgggtttaatcaggcatagatccataccgctggccaaacaacgtactttttcgtcaggttgagcattagctgttaaaccccaaataacgagtgtggggttaatctttcttacctgctgggtgagcgtaagcccatccattcccggcatattgagatccgttatcagcagatcgtactgtcgttgtttaatcaaactgaatgcctgttcaccatcttcggcatcatccacataatagccaagaatatctaactggcgacgcagtaatagccggttggtaggattatcatcagcaatgatgacccgtagccctgatgatacaggaagggtcatttcctgtttatttaaatctgtaggggctcgctcagaaacttgagtctgaacatatatgctcattgttgtgcccgtgccagggtggctggccactgaaatggcgccatgcatgcgatccatcagttccttacagatggttaacccgagaccagagcccatttgcttcttaccacagctggcctgactgaaaggtttgaacagcagttgctgttcttcttcgctgatccctacgccactatctttgacgctgagcatcagctgagctccatcattttcacgaggttgtgtttcgaccttaatttctacaccaccgctaaccgtaaatttgatcgcgttgcttaagaaattggcgagcacttgcttaatggcctgcggatccagccacagtatgcctccagcattcaattgataacttaccgttaaatgcaggtttttttggcgtgcaaggccagcaaaattggccatcgtggcttgggttaatgcctctatgtcaacccattccggtgtcagttcaaaattgccagattctattttttccatatccagcacatcgccgatcagtcctatcaacgattgcgccgtggcataagccagctgaagtgattcctgtgcttctcgttcactttgcggcccggttgccagtagttccagaaagcccataattgcgctgaccggagtacgtatttcatggctcattttggccaaaaatctactttttgcccggctagcctcaatggctttgtccttttcgacctgcagcgcttccataagtttgcgggattcagttatgtcctgccagccgcaaatcagcacgggtggtaatggcactggcagcgggcacaatgtcatccagtgcagaatggtacggtcttcggcaccgttgttgagtgtaaactgatgtgacgccaccgtatccggagccaatccttgctgcatttcctgctgaataatcggaaagatatgtacaagcgggcttcggcgatcaaaaagggaataatgtatagcctctctttgttgtggtgtaaaaaacgcgttgaaggcacggttgtaactttcaatttctccttccggcgtcgtaatatagacagggacaggtatcgaattcgataaggtctgacgtaagctcagctggtattccagcgctgcctgcgaggccttttcccgccgaatggcgcgcagtaaataaccaccccagagtaaactgctcaaaatgagcaataccgcgctaatcgtcaaaatataaaaaggacgactatagagatcccaggtatcgatttttacctcaggcatttttatccatttgcctgccaggtttagcatctccttaggtggaatttcggccaacgctttgttcaggatgctttgtagctcgggtttatcacgaggtacagcgaaagcgatctgtgcggaaggctgatcggggatccgttgatagctcatggtttctgggtagtaatgatcgatgatatatcgagccgccagttgggtggtcaccacgctatccactttaccaagattgagactactcagagcggtactggtattttcaacgacgacccaatggacgtcgggatacttctgaatcagcttttcccgtaaggaataataagcaggtatggcgatcgttgaaccggctttgaaaatatccttttgcttattttcattgctggtcaccacaacataaggtgttgaaaaaaaaggctgcgtaaaggccatttcatcttcacgttccgggctataggtcactgtaggtactatatcccagtcacctttacgcataatctctgccatatcactgttggattttgcgataacgggttgaaaatgcagcccggtctgtaattgaacaagattaagaatatcccctactaacccacgaatttcccggttttcatccagtacggtgaaaggcgcataataaggattgaccagagtcctgaggactgggtttttttctatccaacgcttttcttttggcgttaaagatagcggtttagttaaaaatgtgaggttaccatcatccacccatgtatgggagatcctggtatgtgtcgatgcatctaatgctgaaataaatttattgattatcgcgacgagcctggattgatcctctcgtgcgataaaataactacccgttaacggtgagcgccagtatttaacaacatctagattttgataaaaatcccgagctataagaaaattgctggcaatattatcaccaatgaaatactcattttctctgttagcaacagatgccaatgcctgataattactgtcataggagacaatattggcatgtctgaatattgatttaatgaagttttccgatggatgatgttggcttactgccacgttcaccgttttatcgagctggtaaaatggcataattccgttcgaattgcgtgtcactaatgccggataggtctggaataatagctggctgataataaacggggtggtgactggaacggaggtgttatctgaggtcagtaccagatcgacttcagcgttcttcagggcaccaagcgcctgagattcatcatcataatagtgaagcacaagattaacgtgcaaagcgtctttcagcaattgcaaataatctgcattgatccctcgataacagccgttaatactattcatggcaaaaggtggattttcttcgccatagacggcaatcgtcatggtacgtttatcggcaagccacgagagatcctcctgacttaatggaagcttagagataaagctgtgcgctttgctggtcagtttcagcgtgattggttcagtcgtagcggctgttgtttggccgatcagcaatatcatcgccagcgcaataataattcgagatatcatttttcaaccgatattgttaatgtttgaaaagacgaataaatctttaagtgtcttacaattgagctttaccataagacgtcttttataagtgcttactgttttttggttgatattcatctcaacagcaatattttgattttgtgcgccattaaggatgtgtctcattatcttaagttcctgttccgataatgaaagtattttattttcagcaggagtaaggttatgcgatggcaaaggaaagtaataataaccacgttgtacagcctgaatagcagcaacgatgttatccattgattcttttttactgataaaggcattggcgccggcatcgacactgcattttcggtaaaaaatttggttttttccggacaccatgacaatactgccagcgtagtgattttggcgaagttttgtcaccacatcgattccactcgacccaatcagaatggcatccacgataacgatatcgggttgcaaccgatcaaccagctggatggcatgaaaatcatctgcagcttcacccgttaccactatattttggttctccaggatggttcttagtgctaaacgtgcaaacggatgatcgtcaataatgactgcactcattttgggggtacttctgttcatttcgagatccttttgtaggtgatcgaagcaagtgttatcatggtacggcctgaattattgctttatatgattagccggatcctatgtaacttcctggtatgctactttttactgatgttattccctggtcggcgcaagggggtatgtgcgtttaccaactcactgttacttttcccaaaatagacaagcgcgactttcaacgcatacaaacaacgcggtagcgtagtaaacttcattaaccttgctgagcgcaagggcttgtatatcggaaatatttcagtgggggattagcattggtggtcataacttcgttatctcatccttttgaataaaccagatacatttagtgtgacttaagtcaaaattttaatttaaaaggctgacatatatactcatcattgaaattccccctggtgttggtcagtcaatgcgggctgtgtattgggtaaataacaaacttttattaaaggccgcacgatttcgtaaaaaatagaggcctcttatctaaaatgcaagcgcgaaagttttttttaagattgtggtgattttaatgtagggcgtttcctacacaagtagtattaatccggcaggcctaatgtcaggagtattaatgacttaaatttgtaaaagaaccttgggcgaaagaaaggttcatacaactgctgagacattggggcgttacttaaaggcttgagtgtagtattttgttagttgccgaggctgtatttattaaaaatgacacgatttgtgggcgtcatcctacgaatgtaggaaattactctcgatgaaataatctcgctctcatttattaatttaacttaatctttaagataggcattgtcagccacggtaggctgcgcaggaatttaattgtaatctttatttaatgaaggacttggctatgaaaaaaattatcaccctcgcacctgttgcattaatcctgggactggctagcaatgtacaagctgccactcaaggtgatgtaatgctgcgcggtaccattgttgatactacctgtgaaatcactgttaacaacggtgcggcagagctgaatgtgggttcttttggtaaaaccgcatttaacactgctaaaaagcaggttggtcaggagtcgctgcaggtttctctgactcagtgtgatgctgatgaacagggcggcctgcaggtaaccggtattgttggtgctgacagcgaaattttcatgagcaataccggcgaatctgctggctttatgctgactgcggaagatggtacgacgcagattaaaaacaacgaggctgtaccggttacggctgatgcagatggtaacctgacttataccttcaatgcaggtatgaccgtaatggatatcgctgatattgttccgggcgaatataacgcgccgatcaagatttcttacgttactaactaattaatttactctttgaaaagagagttcctctccgttctctcttttcatttttgggattgcaaatatcatgaaattatatcaaaaactaggcatgctttttaccttgggtatcttatgtgttcagcccgtgctggcagggataagcattggtacctcacggattatctttcatgagaaaaacagtagtcagagtgtcgacattaataacagttcaaccagccaaacctatcttattaatgtcggcatttcggatacgctcaatgccaaaaccgccaatactgcgtttcttccaacgccggcgctttttcgtatcgagcctgattccaggaataccgttcggatcctgaaaaaggcgtataacctgccaagcgaccgcgagtccttgttttattttaacgttatggctattccgacaggtaaagttggcgaggctgatgcggggaattctcttggcggtacccttcaggttgcaacgggtaacaccgtcaagcttttttatcgtccggataatttgcctatgacgcagaaggaagctatgggcaaattagaatttacacgtgctggcaattcagtaaaagtttttaacccgactccctattacatatcgctgaggaatctcgtggttaacggtcgttctgtcaaactcgatgtaattaaagggacgagcatgattgcccctttctctgcgaatacgtatccggtagctgcagggcagggaattacaaaatggactgcgattaatgattttggtgcaggagaaacatttaatggggtcattaaataaaagatacataccaggccttgcactcttatgtatcgctctggctgtgaatccagcccgggcggcaactacagagatcacggccgatattatcgacggaatttgtcatatctctttcagtactaccgaaattgtttttgcgacaaaaggctcccagcaatttgcgactggaacggcagaggtgcaaccacttgacgtgaatttgagttgctcgggtatgagcggcttagcgcccacgttcaaagtgagcggcgattcgtcaggcgttagcgaccaacggctttttaggtcggccagttcaacggctaattatgcaggctttatgttgaagcagggaaccgtcaccgatctgggcgatttctataacgcgcctaatacggtcgcccccggcgatgtgattgctatcgataaagatgatggtgattctgttcagcattttaccgtagggctggttcatggggcaggggatccgccgattggtaacgggacggttaacgccaaaatcaatttcgcctttgtctttccgtaacgctttcatggcataacacaatgaaaaaatattatggatttttaaagcatggtgttgtctcgagagtggcactttgcctgggtctgttgacattcgcgaccagcgccagggccgtggatattacctttaccgccacatttcaggcaccgacctgtgaagtttcagcccctgctactctggattttggatcggtagtttcctccgagattaaacaaggtctaagccaggaattatcgctggacgtcacgctttcacaatgttccggctttattgggacgactcaaaaacccggaattaaagtgaccggcgcgggttctgctgtgtcgggtgactttctgtttcgctcagcgacatctcagtcggtgaattatggcgttcttattaagaatgcatcaaaagcggtggtacaaaataacacttttttaccggcctctctgacgtcgacaaattttgatggtggcagcgacacgatcccactcaccgccacgctctcctgtggcactaaatgtaatgacgcaaccaccaggcctggttccctgaatgccagcgttacctttacttttgcttatcagtaaggagtgcttaagtgcatcaacttttccgtctcttgcagcgcactcttctggtgagtggattattgatagctgctgttcagcacgtatatgccgctgatggtgggatcagtcttagccgtacgcgcattatttttacctctgcggataaagcacaaacgctgtctatgaaaaataatgggccgcgcccttatctggttcagtcagcgattatcaccgcaccggatagccgtgagcttgcgccgtttattagtacaccaccgctgttccggcttgaagccgacagccagagcgcaattcgtattttacgccgtggtgatgcggcattaccggccgatcgtgaatccgttttctattttaccgctattgctgtaccggcgaccgataaaccgaatcagggacatgacgcaacaatgtctgcgcgtctttcagtcggcatacaaaatactatcaagctattttatcgccctgtcggactggctatgactgcggaagaagcgggcggcaaattaacctttcagcagcagaacggaaaaattcaggtaaataaccccactccctattacctgacgttttcgcgactggcttttgatggcacggatgtgaatgtgcgtgaaggcgtatcaatgattgcgcctttttcgcaggcgacatatccggcgaagggaatggtacgccaggctcagtggtccgtcattaatgattacggcggtagcagcaagttgtatcagtctgctgtgcagggaggcagaaattaatgcgtttacctctgacgtcagccgtattgattgctgcattgtcctgtacgccatcctgctttgctgtggcaccggagtcgtccggtatttcgctgagtcagttccggattatctatccgggcgcggacaccaaaggcgttacctggtcgctgacgaataacaccgaccgtgcctggctgatccagtcctggatacgtccggtggactttactaccggcctgccgatgcctgaaacagagagtagtgcttccagcgccaaaatcccttttctggtgacaccgccgttaaagcgagtggacgctggggaagggatgacattgcgtattcgcctcacggaattgtccctgccgaaagatcgtgaatccgtgttttacctgtcggtaaaagcaatcccggcggtaaccgatagcgacagcgctagtaacgggaagctggtggtggccgtagtgaacaatatcaagctgttttatcgccctgaagggttacctgcggggggagtaaagaaagccgccgcgcagctgcgattcagccgccagggagagagcctggtggtcgataacccgacgccattttacatcaatttcagccaggtcacggtgggaggcaagccgatctcagcggatggcttgcgcaagctggttcctccttatggtcaacaacgttatgaccttgtcaagggtatgagcgggccggtggagtggcaggtgctggatgaggaacaccgtcccacaccgcttcagcaccaggctctgtaacaccatgaagaaccgtccgttaacgccagataaaaagcaggcaacgattgtgattaaaaaaaagacatcccggaaaggaagcaacgccagggttgccaggattgacactttcccactgaaaacgatctctctctgtgtcttcatgagctgcaacagcgcgtgggcgacggactattttgatccagagttgcttgcgcttggtacaggaaccagcgatgtcgacctttctgcctttgctaatcccggaggcgtggtggaaggcgattacctggtcaatatctttattaaccagcgtatggcgatgtcgcgtacgatccctttccgtaagaacgcgcagggtaaagtggtcgcagagctgacgcctgcattgctcaatgatttgggggtgaatgttgaccatttaccggcctttaaagatttgccgaaagataaaccggtgaaggatcttgccgaactcatcccccagtcatcggtcaagcttgatattgcgcgtctgcgtctggatatcagcattccgcaggtggcaatgcagccgggcaaaaatagccgtatggaccctgaactgtgggacgacggaataccggcattactgttcaactacagcctgagcgccggacgtaccgaacagaatatcaataacgactctcgccatatgaataacctatttgccaacgtacaaaccggggcgaatttgggagcatggcgtcttcgcagcaccatcacccacaactattcagatcaaaatggtgggcgtaacggccagagcagacataccgatgatacgcgtttttctaatacgtatctgatgcgtgatattcgcgcatggcgatcgcatttaactatcggtgaatccagtaccggcagcgaagttctggatggtgtaccattccggggcgtgcagctccagtccagtgagcagatgctgcctgctcgtttacgtggatttgcgccacaaattaccgggattgcgaacagcaatgcccgtgtcaccatccgccagaatggctatgtggtgtacgaaacctatgtcgcacccggtccgtttgaaattaaggacctttatcaggcaggaatgtcgggcgacctggaggtcacgatcaccgaagcggacggcagtgttcgcagctttgtggtgccctattcaaccctgccggtgatgttacgccctggcacgttcaaatatgaagttactgccggtcgttacgatggcgggctcacctatggttcgcgtcaggaaaattttgtcctcggcaccctaatctatgggttaccaaaaaacattacgctgtatggcggtggtctggtatcggaatattacaccgcattatccctgggaagcggggtctcgctgggggactggggcgcggtgtctgcggacgcgacgttatccaccgccaaatttcatggtgaatcccgtgaaacgggaggatcgtggcgtttgcgttactcaaaaagtctccttagcaccgggacgtcaatcgatctgacggcgctgcgctattcaacgaagaacttttatacctttagcgaatacaacacgatgggttatgcgagacgcgatgaagatattttttatacgccggatcgtcgccgcagtagttttcagactcaggtttctcagcaactgggggagctgggatccatcagccttcgtgcgcatcgcgatgaatactggggctccactaagacgctgactggtttatctgccgggtacaacggtggctttaaaggagtgagttatgggctttattacaccatcgatcgcatgaaaggtaacgggagttggccagagaatcgccaggttacattcagcctgaacataccttttagtattttcagctattcgccagcgctgcaaaacgtctatgccacatctcagatttcgcatgataacaccgggcgcactctgaatcaggccggtatttccggcagtaacgggaatttttcttatagcatgatgcagaactggggcaatcaaaatcaggccagtaacagcaaccttaatatgggctggcagggaagcaaaggcagcattaacgcgggctatggctactcccatgatacgcgttcaatgaacatgaatattaccggaggggcaattgcgcactctgaaggcctgacgctgtcgcgaacgcttggaagttcaatggcgctggtcagtgcaccggaagcaagcggcgtccgtcttaccagcggcaatggcgtaaccgattggcagggttttgccgttgcgccttacctttccgattataccagcaacaacatcggcctcgatcccagcaccctgccggataatgtggacctgccgaaaaccaacgttgaagtttacccgacgaaaggcgcagtggtgaaagccgatttcgctacccgtatcggttaccaggtattaatgaccctgacgcgcgtgggcgggatgggcgttgtgccctttggtgcgacggtttcgctgttgaataacaaggagcgtgatgatgcgaccagcatcgtgggggataacggccaggtgtatatggctggtctgccggtgaaaggggaattgtccgtggtgtggggtaaaggcgccgataagcagtgtcgggtgaattttaatcttaacggccttaagccaacggcacaaatgccggtaattcaaatgaatggcgattgccgttaatgaaaatgctttatgtcctggcctcaggcagcagcgcagcaagagagatcgatatgaataaaatgaaaagtgttatctgttttctggcactgggtgctatcagcccgcacgcctgggctacgccaaataatgatgacattaaagcgatgctttcccaggcaaagagcggggacgcctctgcccaaacccaacttggcattctttatgctgaaggcagtggtgtcacccgtgattataaaaaagcgcggtcgtggttcgaacaggccggtaaacaaaattatgccgatgcggaatataatctcggcgtgatgtacggcaatggggatggtgtggcgcgtgatagtaaaaaagcgcttacctggtttgaaaaagcggcagagcatggccatatcggcgcccgttataatctgggcatgatctacggccagggaattgggactgccaaagacctggttcgtgcggctttctggtttgagcttgccgggcaagatggttcgcctgaagacaaatacacgcttggcgtgatgtacagcaagggtgaaccgctggagaagaatgatgtaaaagcccggcaatggtttgaacgcgcagccaatgaggggcatgtgcttgcccaatataatttagcggtcatgtacagcgaaggactagggggcgatcgcgatctggagaagtctcgttactgggcggataaagccgccgggcagggtgatccagaggccgccagattgctcagcgtattgaatgaacgaggcaaacagagtcccttcgagatactgatggtggcgagcagtaaccctgctgccgcgccgcatattgtgccaccggttcggctcggatctcacaatgaggatgaacaaactgatactaaatcgggtgacatgccggatgagacgccggttgttgctgttatgagtgagcaaagagggatttcagtggaggataaagctggcaaggatcacgtcagtgttgcgacagatgtaacgtctgaaactgcagtagcaacggaggaagatgttaaaccaacgccggagacagttgaacccgaagctaacgtaaaaagcgtcatcgatacggacgtggcgagtgaagtagcatcaccggacgcactgataatcaacggcacgaagaggattgaagctgacacgctttatagcgaacaggctacgacagcgtcaccgtcatcggatattgaggctgcagatatgaccactaagaatgagattttgacaaccccaacatctcagagcaacgaaagacccagaactgaggatattaatgaaagtgctcagacagaggaagataccgcaccggttgagcatgatgtgactataaagatgcacgagccagccgtaaaagaagaaagctttgtgaagcagacgaataaacagtagtttttcttagttgaaaggatgtaaattagtggggctactgataaaataatggattcaatagggagtgtttttatttacattgcttttctatggtatggggtattcttgcgttgaggatatcaatgccagtgaaccagggtgagtatgtcaatgcactatagattataaagcatcactttcaaaatttattattgtagtgtttgctaaaggtgacttgatatttaggtgaaatggccggtgtatgctaaataatctatttattttcgtggtgggattattatgtctgaactcaataaagttgctataactaaacgtattgttcacatatcgactttagataagccagtcgagattaaatgttgcaataagtaccataatttttgttctaaatatcgtcttttccgaaatataggcagatctgaagtgagaataccacggtattatactaagttgctaaaatgggctttttatgtattaactatatatgggggggcaggagtatcaacgagttctgcggtgaacctgtcttccggttatcagataatccagacaccctcagttaccaacatttcttccagcgttatccctgagccaggtaattactctcgtaatccgccaaccggatgggcttggaatatccaggcatttatgaatgaaaatctttcatcaggactgctaggaagcatatatgcttcggccgcgagcagtcctgatcgttactgtaataacacattaccttatttaacgatcgatggttatacgggttatgaggtttcgccgggagttctgcttattccatatggatctattcgtaccccctttcgcttatctgcagctactcacagtggtacttctcaaatgtattatcaggcgttggttcccaatacgatggcgacgggcatagcaaatggttcatgggatcaaaagggaataatatccggagatgctgtatcttcagccgccagggggagttgtaagtcttttattaaagggaataatcctattaataataatgactggcaagcaattaactatgattatggcacagcgcaatttaatatgggctatggtgtttatgttagtccgacagcggctccttttcagaaaacggtttatatacatcaaacgtattttggtttgctgactaatggaatgaatagcgctgtaaccagaagttttgacctgaacctcccttctgttaattgtactttgaatgttccggcagtagtcgattttggaagtgttacgtcagatgccgaaactgctgcaaaaggcatcagtcaacaatccacttttgctgttaactgcagcagcacaggaggcttgccagtatcaacgactgttggatactcattcacacctaaaagtcaaaaaggggataaaacgagtatacctttaatagccaaatctggcggtgcggctgttggaagcgtacgtggcttcctgggagagaatgcaggctccgaagcaggttgcgtcaacaaaaacacttctattttgatggatggaacacctaaacctctgcggaccattaccaataattcttcttggtccgagccgttattctgggtgctttgtccgaaatccgatgcaaatccgggtttagcatcagctactgcaacacttgagctttactggcaataaaagcgtcatccaggggagttgtaattacacaggatagtcaagtttttttcactgatacgaaagctttcagaggagcattcaaaaaaggcatcactctgatttggggggattaaatatgtcattaaccagtggcggtgaggtcgcagttgaaccagataaagttcttgagggagcaatttaagctggtaaaactcatccagataattattggggaaatagagttgcgtgcattatttttccctagggactattgatatttttgcatattgaagatcggggcgacagcggacgctttcatcccgaaaaagtgaccacttattggtggtcactattttcttgcaatacgacttcgatagcgcccggtcacaggggaggcccgcacctctgtatccgggcgcttcatatgagccccttcttttcttctgccatataacctcctgtctatgatgctgcatatagcctggatttcgcgcccgtaatgcatcaagcaagtctacataatgggtgatgcttctgataattgataaacatcgataaaaggcacgatctggccatgcataggagagggcgctggcaggtgatctgcccgcgccttcagtcagcgtggctgtttcagcgacgaacccgctgagacacaaggataagtaagatccctatggcgagcggcagcgttaaaagttgcgaaagcaaggaaatcgcatagccataaatataattttcaaggcttatggcaatgattggaaacactaaaaacaccagtgaggcctggaaagcgcctgattttttttgcagcaaaaagtagcacaggatgccgaaaaccccaccaatcactcccagatacagcgtggacagcacagagggcaatgagaatgtggatacctgaggatgttccagaaaatatccagcagcggtaaggatgagaccggcaaaaaagcagggaagggcattaaaagtgagcactgaaacggtgcaacatcttttcttactctgggtgtagatcaccgcgtggatgagcacggcagctaccagcgccacaattccctgccactggctaccggcatttgactttgcctcatgaagaataatgccagacaaagagataagcgcgataagcaggcccaagatttgtaataactttggtttttcgtgtagaaagaaaatggatgcgatcagtaccgcgactggcatggttgaaaatattacggaggcgaggcctgaactcacgtacgtttcaccataaatcatcagagtgaacggtatcgcaaaataaaaaatacacaccacaccctgaaatatacgttgcttttctggaaaaactaaaggggttttggtaagcagcgcaatggaaattaaaaacggggaggcaaatataaaccgcatgcccgtggcgaatatgggagaaatggtttccacggcgactctcatggcaagccaggtggtaccccaggttaaacaaaccagggtgaacagcaggaatattgtcacgttacgcatataatcatcctaaaaataatcactggcctggcgatccttccctgacgcttccatgaagttttcgatgtcggggaaccttgccagtgatggcgtttaccatgcttgtgtgcagagggttcacaagctgtgcgggaaataaatgcttagactgtttcagtttggataaaggttattacgggaaggaattatcccagtgtttgtgctctgcggttaacgcattcatcctggttttattgaggatggacggttattatttaatatcaagcctaaacgattaataaatggcgcggtagaatgatgagaatatcgagagggtttgtctgtctatgccacctttgctttattttacacttggtgtttaaattgtttatgtactattaagattataaatattattattgcttgcagcctgtgccaacagatacggctccatttaatggtgaataacactattattacgctgtgctgattttgaccttcataaaatcagctggtctgtcggctgcatgcttatcataacctgtctgctatttcataccatttattgtgcaactggctatcgcctgtctttgccagtaaatgatggagggctcaggttgtcaacgtacggtcttgtaaattaaataacgtgatggagatgaataaatgaaagttaaatcattggtttttagtgccatcggcgcactgtttttaacctctgccgcccatgcagctgaccacaagaagccggttaattcctggacctgtgaagattttctggcggtaaatgaagattttcagcctacggcagtgggggttgcggaagcgctgaattctaaagacaaaccggaggatgcggttctcaacgtttctgggattgaaaaagtcaccccgacaatcgttcaggcttgccagaaggacaagaaaatgtctttcaaagataaagttcgtgctgaatgggataatctgaaaaaggaaatctattaatcccaggggaatgccacaatcccttattccgcaataatgttaggagtagcagagccgcgttataacgtggctctgtttttttgcgactaagtaaatacttcatcgatttcgctttcgcatccgcgttaagcgactcgtccctgcagatcatacccgcaactatccgctaagtcgctgtgcttaacgcgaggctatcatcatgcgtgagcttatttgctccagaagcgctgtctgatgactaaatataatgatgcttaacccgcgccgacgggattcatggattaactgctgccagatatcccgttgcacagaaggatcgagctgggcggtgatctcatcggcaatcagtacgcgagtacggggatcgagcgaccgcagcagcgcaatacgggccagttcccccccggacagctgagcaggttttcgcctcaaccactcggggttaacgtgaaaacgcgccagttgttcatcatccggctgccacgcatcgcgtaaggcatttcccgtggtgcgaaaagggttaaatgtgcgttcagggtgctgaggcactaactgaaccggacaataaccacgttttggcaaaggaaggccgtcaagggtgatccgcccctggcggcaggactgccagcccgcaagcacgcgtcccagcatggttttaccatagccgctcggtgccgaaattcccaaccgctcacccgccggcaattcaaaagagaaattttgccacagcgggcgattatcttgctcaatggtgagctctgaaacagaaaacattacacgcccccggcctggacaggcatttcctcatcggaaaataagcgttggtgttctggcagggccaaccactgacgtcgcaatgctgcgcttccaccgccgtctttgagttcgttaacgaccatatcatcactgatctgtccgtgactgagggccacaatgcgatcggcgaaacgtgccgccagcgacaaatcatgggttacccatagcaccccggccccctgagccaccagatcgcgtaactgatgtaggagctggaaagccagcggttcatcaagccatgccgtaatttcatccgccagaatataccgggctcctcctaatgcggcattacatgccagaatgcgttttgccatgccgcctgacagctggcggggatatttcagcagaatatcgtgctgaagatgataatgtttgatttgctgttctagcgccagtgcgcaggtatgacgaccactgaggtgcaggcttcgcttcagctgagtgcctacggtcagaagggggttgagcgaaccgacgccctgcggaatatagcaaagtgtgttaccccgaagcgttgcgcaatggcgggaatctatcgctttgccctccagtctgatttccccacgcatccgtaagttctcgggtaagagtgccagagccgtttgcagcaggaggctttttccttccccgcttccccctaccagagccgtcatttcgccgcgcttgactgacagattaatattgctaaggagaggcgataactgttggcgtccaaaccaggtgtaatgtacatggtcgacgtagatgctactgaaattcagcatgatggattccttaaccacagatcgcgaatggcgcgcacgcagagatcaaacagtaaaacaattaacagcagcatcaggccgggatacagcgccagccaccagctaccgttgctaaagaaacgcagcgcatcggctaataaaatccccagggaaggatcatgaggcgccagtccgaaaccaagaaaacttaatgctgcgctgtgtaagacagcatgtgggaacatcagtaatgttcccacaagccactgtgatgaaagcgcgggcagataatgcgcccgccagcagtaccagcgagtatttccaatacgctgagccagcgtcatgtagtcgctggtccgaatctgctgggcttctgctcgcaggatcagcgccagtttgggccagtgggtgaacgcgacggctaaaaccacgccccgcattcctcctcctaccgtaaagcagattaggataagcagcagcagatggggtaatgagagcagggtatcaatgatcaatcgtagcgcctgatccatcacgggatggataagcgtcagactggcgatcagcatcgcaataacaccgctgcagattgcggcaccgacaccaatttgcaaactggtcaatgccccctgaaagcaacgtaaccacagatcgcgccccatattatcggtgccaaaccagtggctggcgccgggcggaagatagcgtgcctgcagatctatcggtacatccactgacaacaatgaaacgccataggcagccatcatgccgagcagtaaggatgaaaaaataaaacgcagtaatgccggagcgggattattctgcatcatttcggctccagaatatgatttgttctggccagtaacatcgcagcgaagctatttccgcaaaataccagcacggtactgaacagcacgatgcccatcagcaacggaatatcgccgcgcaggccagcatcaatggtggcttgccccagtccggggtaggcaaacactttttctgccagaagcgagcctccgaggagttcgccaactgaggcaaactgcaggcaaagcgcgggggttaatgcatggcggagtacctgtacccgtaatagcccccagcctttctcgccctgggctcgcgcgtagtgtacaaagtcactgcgcatcgtttcggccactttttcccgagtgtgcagtgcaatttgtccaatgccggtcaggcttaacgcaaccatcggcaagatgacatggtgaaggcgctcccccaggctggcattgtcggcgttctgacccggtgcccaggcacagcaaaccggaaaccattgccagtgaacggcaaatatcgccagcagtaataagcccacccaaaacgtcggtagtgaggacaacaggtggctgatgcggcagattaagcgatccggccagcggtggagataacgtccggcagtcaatcccagcatgatccctaacaaccctgacagcagccaggcgctggctaacaggataaatgagagggcaaagcgttcgccaataacctgggcaaccggggcgttataaatcattgaatatccgagatcgccctggatgacttgcgaaaaccaatgccagaagcgtagccacagcggttggtccagtccccagcgtgcggcaatgagggggtactgttgggggggaacatgcagcaaatcattgccgatataggcacgaatgggatcaaccggtgaaaaactcagcaatgtaaaggttccggccgataccagtatcagcagaatggcgagcctgaagacagcaatcaaaacaggacctggcccgtaagatcgggttagatttagcctggtcattaaaaaatgctttactggcacgtccatttccagtcctgaacattgttaagcactgaccagctgccatgaatttcaggagcagcattacctaaatcaatacacggactggcaaggtaggtatgttgtaaatttagcagccaggcccaggcggcatcgccccgcacgcccgcgccagactctccatcccattcaacctgctgccagacaggaaccgcttgttgccacgttggcgcgttgagcgcctgctggagatgctggtccacggcgttattgctgtaataacccggattgtaatactcaacgcccgccgccttgctgctgtaatgatggtaaagctccatcggatctagactcccccagccgaacagcgtgggattggcatgcatatgccgctcgacggtttcccaactgccggatttgagctccatcgcgataccgaggggtttcaccatcgcgctgacggcctgagccaaatcgcgacgggtgctgtctccgctggcataccacagcgttaactgtgcctttttaccgtttttaacacgaatgccatcctctccgacctcccagccggcatcatcgagaatgtgtttcgctgtggcgagatcaccatctttgaaggcggcctggggattgtcccagggtaagccctgcaccgcgctataagcaggtactgcgtgaccttccataagctggtttgccagaaggtgacgatcgatggcgtagttgatggcccgccggatagcgacatccgcagtaacgtcattaccgatcgggtatccgttagcatctttttgaccggcaggtatggtggggaaagcgatgccccggttttccacgcttgggcgtacccatagtgttaagccctgttgcggcgtaaccgaaacggatggtgcgactctgactaatcctaactgaccactttgcgccgcagcgtaggcgctgtcttcatccagaaagacaaagatcagtttatcgaagtcgtttcggtggcctgaataataaggattagcctcaacgataagctgctgcccgggctgaaagctcaccagccgatacggccctgcgccgaccggattttgcgcataggtttttgcatcatattgatgttgaggcacaatccccagcgatcctaatacgctgacaaacgtgctttgcggtgcggacagggtaatctcgacccgacggtcgtccagaaccctggcggcggaaaaattccccatatcgattttgccgccaccctgcgcggcctggttataggtaaaggccacatcctgggccgttaagggcgagccatctgagaatttcaaatccggcaggagcgtaatggtccagatctttccgtcggcactgtgctcgacgtgttcagtaagaaaattctcccagtccatatcgacattttgttttaacagcgcgctatgcaacagcaacgtgcttccatggctccagcccagtaaaggatcaaagccttcactgggctcttcaccaatagccaatgtcagtgagtgacctgaggttgagtccgtttcagcctgcgcataaaacggtaacgtgctggcgataagcgcaaaagtatatgacattacttttagtaggtgaggcatgcggcttccttgtaacaatgcatagtcaataaaaaatgccctgacgcctggtatgcaactctgctttttcagcaatatcgataatgggcgccggtcacatctacctagtgaccctgacgatgggccggcataatgtctttattcggcaccagaaagagccaggaagcgagaacaaagggcatggtcagcgttgggatgcctaccggcgccagcaatgtgttcatggctccctgcacgaaaacggtaaatatcacgccgataaaggtgtaacccaaaactcgccagctgggtttattgaaacttgagccaagcgcaatggccgtgagcaccgcgctaaatgcatataacccgctgtcggtgctggtggtattcgctccaagcagtgaggcagttaataccgcgagcagcgaaccgccgatggcaaatatcgccgcccaacgtgacgccaccgccagacccacaacaaataatccccccgcggccacgctgctgaataaatacacctcagaaacaccgtgtaataccgtggcaaatatgtggccgttgaacagcccccccgccggagcactaactaacgggtgggggagttcaggtacggataacccggaggcatccaggcctgaaaacgcataacttgccagcaacacaacccacgtcgtcagcacaaagggagccgttaatgccgctactttccaggttttcagtatgtcggcaatactgacggtggcgataacagacacgatgctgcctgtaataatgcagccccaaagctgcggcgtgacggataaaaaggtcggcagcgccaccccaaccagacaaccattgtatccgtatagtccggccagccatgaggtgcgatcgttaacgaacataccggtaaatgtcgcaaccaccgtacccagcacacagccataggccgctgcgggattgccttcgccgtaagcggcaataaatatggcaataaagaagattaacccggtcagcgggttattctgaaacatgacctgagcacatccccgcagcgtcacgtcgataaacctgacagcagggtttatttcagtgtaatgagtccatttactcgctatagctgatgaggtattcatgatgtggcgtctcctgctaattatttttcattctgagcttgtctgacggaagagggccgttaaggcccttttcctgaaggcaacacgctgatgtaaaggtcagactttccagagaaagggcgccggcaatgaataaccggtggcaacttgccgcacggtttgccagaaatcccggatggctttttttatacgggtgctgtcgtttgccagtaccttataaataagcccagccccattgggtaaacggcttacgccatgacacagctcctcgctataaaaagagcgtgaacgggacaaaatttcgtcctggcaggttgaaggggtcaacacaattacgttgccgtaaatatcgaatgttcccattacgccgacgacatccagcggcttttctttaggggtaagtaccagtttttcagtgaacaaaacgtcaccggcttcatttttggcactgatccgcgaggaataaacatcaaaaccaaaacgctcatcctggtgatgatgcttacgccctggcatcaggatttccgaataaagcacggtggcggtgctgtcgcattcaataagggtatcgctgataaatcgcgaatgacgatgcggaatgacctgatccggcataaattcaagataagcctgcttaccgacgcgtatatgttgcgtttgcgcggcaaaattattatccatcgaatggattttagtcgctgactgcgtggtgatatgggcgcaggcgcccgcatcaacctcaatctccaccgttaagcgatccccctgcaaaacgcatcctgaggtggagatcatgggtacgcagggcaggaatggcatttcctcatcccagtagagggctttttgaaccagcaatggcacctttctttccatttcatggagggtgcttttggcgccacgatcggcaaaacgtagccgcaaatagccatgtttgccgacggcgccgctggccatttgcggtggctcttgttgatactttgccagttcgggcgccaacgcgcccagagaaagagtatcgaacgccggcgacgccttgtgtttggtctgcatgatggctcctattttgcgtgcgtaaacaggaaatctttttcgatcatgtccaccagggcatcgatgccttcgccagttttacagttcgttaatatataaggacggttgccgcgcacaattttggtatcatcctccatgactgcaaggctcgctccaacgtaaggggcgaggtcgattttattaataatcaaaatatccgcctgcaccaggccgggcccatttttacgggggattttttccccttcggccacatcgataacgtaaatataaaaatcagccagcgccggactaaaggtcagcgttaaattatcgccaccgctctcaatcataatgaggtcgctgtccgggtacttatcttccatttcctcaaccgcagcgatattcatacttggatcttcgcgtactgcggtatggggacaggctccggtttcaacgcccataatccgctcttcatcaagaatgcctttcagggtgcgttttacctgtttggcatcttcggttgtgaccacatcattggtaatgattaacggcttataaccacgctcgattaatttaggggtgatgacttcaatgatggctgttttacctgaaccaaccgggccgccgatacccaggcgagtaatttttttcattctccagtccttatttttaattcataaataaacgcacatgcgcatcaacgtgtacggcggccagaatatcgataagcggcgtgtacgacgccatttcgctgatatcggcattcacggcctgccggcaaaattcaggtatgtttttatttacggcatacagaatctgctggctgtcaaagtgcgttatcctcatcagtcgctgggcggcgctcaggatagtcatggcaacgccatactgatgcatagcgatggtttcctgagcgctgatcccttgtaaccccatgaccagcgcctggcttaccggaaatgtgcctgctgtctgtccggttttaatgttatccagccaccacgtcagcaggtcggcttcgaacacctgacgggtcatctcaaccagtttcttacccatccgctgcgtcattaaccgcgactcttcattgagtttgcgattcataatttcgcgatcaacggccagaagctgatctaagttgccatcaagtaatgcccggtgagcatgggccaggccaatcgcatcgcattgcgctgcctggaccagcgaggtttcaacaaacgcttttaagctcacgacatcgtggaccaatcccacctgaatagcggattccacaccacatgaaaaagtaaatgctcccactggcagaaccgagtcgccgaactgcaatactctgatcagacgcaggagctgatgtgattcatcaatgtttatgctcatgcgcattcccatgatgtgcgtggtgagatcgatcgtgggcgtggccgtgctgtggatcgccgctgagtacgctgacatggacatgcgggtcttccgcaccgccaaacagcaggcgggactcggacggtgtcaggtgtggtaataccgtttcacccgcgacaaagtgatattcagattgcgcgtaaccatgagttttcaacacggaattcatcattttcttttcgactgataaagggacatatacctgagtgcctttgatcaccgacttccagtgttgatttcccagggcgtgtccgagttcaaacacgcgtttaattgcgccttcgaactctgccgtggccagggaggcgagctggataaccagcacttcccgcagagtgatatgtacggttaacaggtattttttgtcgtcatcacataacaaaatatccccgtcggttaaccgcatgcgacgatccagagcgataccgatatcaaaaccctgctcgctttgcttacggcaacggcttttttgagcttcccattgttccagggacagcacatcgtgttgatatccgcgggtcttttcctgccacgacgggtcgttttttacatttccgataatcgtctcaatcagtatcatgtttatttgcctcacatcagaacgcacggatatggcgcttagccaaagaaatatttttggttcattaccgctgttgtgacggggttgcaggtggcatgttcaccatccactttcacggcgaaagtttccggatcaacttcgatatgcggcgtggcggagttacgtaccaaatcacgcttggttactgagcggcaattgttgatagcgataacctgacgctcaaggccggctttctctttgacaccatcatccagcgcggcttgagacacgaaagtcgcgcaggtgtcttgcagggttttccccatggcaccaaacatcgggcgatagaataccggctgcggggtcggcagcgatgcgtttggatcgcccatcaaggcccagttgatcatgccgcccttgatcaccatcttcggcttcgcaccgaaagagcgcgggtcccataaaaccagatcggccatcttgcccacttcaactgagccgatgatatggcttacgccatgcgcaatagccggattgatggtcagcttggcaacgtagcgcaatacccggaagttatcgttgccgtcgctgtcttctggcagtttcccgcgggagactttcatggcatgggctgtctgcacaacgcgcagccagttttctccgacgcgtcccatcgcctgagagtcgctcgaaaacatcgagattacgcccatgtcatgcagcacgttttccgccgcgatagtttccggacggacgcggctttcagcgaaggaaacgtccgcagccacgtttgggttcaggttgtgacacaccatgatcatgtcgaacagttcagcctgggtgttgatgccgaatggaagggtagggttagtggagctgggcagcacgtttaactggctggccaccttgatgatatccggtgcgtgcccaccgccggccccctcggtatggaaggtatgaatagtacggccttcaaacgcctcgatagtgttttcgacgtaacccgcttcgttaaggctatcggtatgcaccgatacctgaatatccatttcgtcagcaatacgcagggaatgacgtaacgcgtttggcgtggctccccagtcttcatgcactttcaggcccgccaccccggcaataatctgttcaaccagcggagcacgcccaaacgcgttacccttacccaacagtccgacgttgaccggtagcccctccactgcgcgcagcatcttgcgaatattccaggggcctggggtgacggttgttccgttggttccgtccgtcgggccgatcccaccgccaaagaaagtagccacgccattcgatagggcgctgtacgcctgctgcggtgaaataagatggatatggctgtcgatgccggccgcggtcaggatcaagtgttccccggaaatggcgtcagtgctgagcccgacaatcatattctgcgtcacgccatccataatggccgggttaccgcttttaccaatgccaacaatcaggccatctttaataccgacgtcggccttaatgacgcccagtttggcatcgagaatcgtgacgttggtaatcaccaggtccagaacgccgttatcgcgcgttaaggtattattcgatcccattccatcacgcagtgatttaccgccaccatagaccgattcgtcaccatagccgcggaggtctttctcaatttcgatataaaggtcggtctcacccaggcggattttatctccgaccgtcgggccaaacaggctggcatattcttttcttgaaatagttggcataaaatcctcactagacagttaattctgaaatttaacttactgatttaaaaccatgtttgatggcattgttaagaatatcttcaggtgcatcgccctgaatgccagaggcgttgccgacccagccgtcgaccagattattaaagccgtataccacctgctgaccgctgaaaggaattaattcaacggtaatagcatcacccggttcaaatcgtatcgctgtcgtagcggtaatgttgagtcgtttaccaaacgctttactgcgctcaaactccagtgctttattggcttcaaagaaatgaaagtgcgagcctacctggattggacgatcgcccgtgtttttgacatgaacggtagtaatggagcggccttcattaaaagtaattggcgagtccgctaatacatagccgccgatggggacccctgtctccacctttttaaccatggtttccgaagtgttggattgctttttcattagagctcctttgcagagtcatttcaggcttattcactgaatcgggtcatgaaccgtgaccagacgactgccatcggtgaaaatggcttcgacctggacgtgaggaattaaatcagccacaccgtccatgacgtcctctttggttaatacggtacgtgcttcattcatcaccacttccagggtttttccttcccgggcaccctccatcgccgtggtcgtaataatggcaaccgcttccgggtggttcagttttagacccttgtttttgcgcttcaacgcgacgtcagccagggtataaaccatcagcttttcaatttctctgggcgtgagttgcatatttcctccattcctgattacacacattgtttaatatcggtgatgctgccccagccacagggatggggcagagagatattaatttttctcgctataggcatcttcgccgaataaagtgttatcgagttcgccgccaactttattctggtcgactttaactacggtgaatttattaatgagccacagaatagccagtgtgaaaataaacgaccagacgctggtaaataccacggcggtaatctgtttaatgatttgcatcccattgccttccagcagaccgtcaggcccattcgcgttccatgtggctgaggcaaagacacccaccagaatcgaacctgttatcccgccaacgccgtgaacgccaaacacgtccagcgcatcatcaaggtagcggcgtaccaacagcaccacgaaataacagacgaagctggcaataatgccaattagcgcggcagactgaatcgagacatagccagcagctggggtgatagtggcaagcccggctactgcgccggttaaaaaaccgaccagtttgggtttgcctgtacggattttctcaatgacaaaccaggtgacggcagcaaaagcggcggcgatatccgtggtcacaaacgcggagaccgtaacagtattgacctgcagttctgaacctgcgttaaaaccataccagccaaaccacaataaaccggctcccagggcaatataaggaatattatgcgtaccgtctgaggccaccgtacgtttgccaacatacagtgctgaagccagtgcggcaaaacccgctgtggcatggaccacgatcccgccagcaaaatctacgactccccatttcgccagcattccctccggactccagatcatatgaacaaacgggcagtaaaccagaagtgtccagaaggtaaggaagaccagatacgccggaaaattgacgcgattcgcaaacgcacccgttattaatgcgggggtaatgatggcaaacatcatttgatagacaaaatgtactaataaggggatgccacctttgttaccggtgtacatcgtccctggatcaatattattcatgaaagaataatagaggggatcgccgatgatcccgttgagcgtcggaccaaagctcagtgaataaccgacaataaaccaaagggcggcgacccaccccatcgagaaaaagctttgcgccattatcgtcacaatactttttctgggtaccagtccgccataaaaaaatgccagcccgggcgtcatcaacatcacgaggctggcgcagagcaacataaaagcagtgttaggtacatctaatgataaataatttacaagtgcatgttccataaaattatccctgtgatcttatacagcgcctgtaagcgttgattttttaagctggcgaacgcagattgcacgatatgacagtgcgatatgtaaaatatatatgcaggacattgtttatattcgtaaaataaatcctccacgcatcgagggagtggttttattaacctgttaatatgcttttaatcgttcacgcttttctccatggcaggctgtgtgctgattttcctaaaggaggccagacatgctaacaacctcttataaatgcatgccttgcattcgataaaataggtctcctgacttttgtaaagttatatacttcaagagtgtatagcttgttttataatctgtatatcagagtggatacccgcatgagtcatacccatcctactggtgtaagttgttgcctgacggaataaaatattggcttatttctgtcagggtagctgccggagaaattatatctcaggacggaataagaaggcaggcacgtaaaaaagcgaaaaacagcaatctgtaagataggctgttttccgctggtggtttatcagctatggcagaaaagaataaactgcgcaggattatcgaatatcattcacccattgcataattttactttctggtttttcatgacagattttgattaactttggtaccgagacggtatccgtttcattccagtcaacggtgtctccacctttatagacggtttcattattgattgcccagtaagctaccggggtcattgccttagggttcatatcaaggtattcccggcaagtcatgttttgcggtgtggtttccgacgctttctccgccgccacggcggcgttggcgttcagtaaaacaagagtcacaacgggtgtgagaaacagagtggataattttttcatgatgttttcctgtttaaaaagcctataaaccatatataaaatagcgatttatgtggtaattaattttttttgtgctttattcagtgcatagctgagcactaagaagaatccggcacagaacagcatttccagcccaataaaggtgacagtgatgatatagctggcgtcttcgctagcgcggagccaggccagggcgatgatgaggtctattatgccaatgaaaatacaccaataacgacccttcatagcccgatctttaaatcccatggcgatgcgactatacccggcaaggataaataaaacacaaaacagcaatgacaaagtattaatgccgaatgacgtgctaaagataaaaccacagccgatgccaaaataaataattccaaataataacgatgagatgtaagaacgagtattatatttaatgaatatcaatgccatcgccacagagtacatgccacagatgaacattaaagcaccagtcagggtgctaatgaccacaccgctatatattgggaagagcatacaggccagcgcgcacaacagcagtataacggccataacggcagtagctctgcggtatctttttaccagcgtactgccgagagtatttattttactgctgtcaataaataacatgatttctccgttagtcattacggtagcaaaatgaaccgcagcagatagtaggcgacggcatttaatagtatttcagttattataagtggcggttattttcgtggatatcggagtgcgagtcgatcgatatcatcaatatcttacaggtgtaggatgcaatggtgggggagctttaatttttctcaacggagtcgttggcgccgctttttcttttatggatgggaaggcgggacggcaacggttatagtatgtaatttgtataaactggctggacatgatgtgaaattaacaggcttgtagcgagtgggaaacaggagggggattatcaggcccgttgccgggcctgatagataacaagcattatccagctttgctggagttaaacggtggttttgcgaaccataccagcagagtgagcatcaggaatacgccagccgacaggtaaaaaacatcgttggccgccattagcaggctttgctgagtaatttggtcatcaagataggtggctatttgctgcttatcaaaacccatatgttgcagtttatggaacatatcgacagacggaggattatactctgtcactgattctgttaactgcgcgtggtggaaggagtcgcgacgactccatagcgtcatggtgatcgtggtgccaatagagccggacaaacttcggaaaaaattactcagactggtggcggcagcgaatttctccggcggtaaccctgaaagtgaaatggtggtcagcggtaaaaagaaacaggcgaccgcaaaaccctgcataaattgtgggataataacccacgtaaaatcaatggccgagctaaaggtgacggaacgccagtaataacacagggcgtacatgataaaactaaacgttaccaacatccgcatatcgattttattgccatagcgaccaataagcggcgcaagcagtagcggcatgataccgatcggtgcgtaagccagtccggccgataccgaagtgtactcaaaaacggtctgcagtaactgcggcattaacacgatcgccccggcataaattaaataggcacaggcgatacataaaataccaatagtaaaatttcgcgaacggaacaggctaagatcaataatcgggttattatccgttgcttcccagatgaccagtaaaataatagcaacaacggcaataatcgccagaacaatgacagtggttgagttaaaccagtcgagatcttttcctttatccagcataatttgcaggctgccgacgcccagcaccaggaggctcagcgcgatgagattaattttaaccggttcagttggcgtctcgcgccctttgagtaaccaggaggtcagcgcaaccacaatgacacccagtgggacgttgattaaaaatatccagccccagtcgtaattatcgcaaatgtagccaccaataatgggcccaaaaatgggagcgataataactgtcattgaccaaagcgccagtgcaatattgcgtttttccggtggataattgcgtagcagcagactttgtgagagtggaatgagcggaccagccaccagaccctgaacaacacggaatcctatcagagtgtccagatttgtcgaaagtccacagcataatgatgccagtgcaaagagggttaccgaggttaaaaatagtttgcgttcgccaaaacgttgcgccagacgaccggtaacagggatagaaatagcattcgccacaccgaacgaagttataacccaggtaccttcatcggttgaggcgcctaaaaatcctgagattgtcggaattgccacgttggaaatggtggagtccagcatttgcataaaggtggccatcgacagcgctaatgtcaccagtactaaggcagcacccttcagcggcggaagtgcagtattattactcataaatcacatcgcgttggctttgatgatattgaggatttcgttatcaacaggggtggtatcgataaccagtgcgttgcttgcgtaagccggggtttttcgctgcgttgttgccagtgcttcgccctgcgaacgggtttcatgcagccgcacggtggtggataaaccgatgcgcaacgggtaggcctttatctgctcggcatccagcgtaatgcgtactggcaggcgttgaaccactttgatccagttaccggttgcattctgcgcgggtaataccgaaaatgcgctaccggtgcccatgttgataccatcaacctggccgttaaacaccacatcgctgccgtaaaaatcggtgacgatcgagactttctgaccgatctttacccctttgagctgtgtttctttgaagttagcgttaatccagacctgctcggctggtacgattgacatcagcgcctggcctgagccgatagtttccccgacttgtacattgcgttgggcgaggtaacccgtgaccgggctgcgcactttggttcgctgaagcgcaacccaggcttcccgcatggattccgctgccattaacacttccggctgtttttctaacgccgtattctgaatcagtacacggtttccgcgataagcctgaacagcaacatccagcgctgctttgctgctgtccacggcatcctttgcatgttgcatattctcccttgatatcgccgctgcgccctgcagcctgctacggcgttggtagtctgccagtgcctgctgatatgcgattttggcttcctgaacgttagcgttatattgatcgtcagcaatatacatctgtttgatcttgcggaccgtattggccagattattggcggctttgttaaaattaattctggcgtcggtatcatctaatgtgacgagaatatcaccctgacgcactaaatccgtgtcggtgtaattaatactaattacgcttcccgcaaccagcgaagagacggcaatttgattccctttcacataggcgtcatcagtgctctgcacatttcgtaaatcaaaataccaccaggctgtgctggaaccagcagcaataaccatgatagccgcgaaaataagcaacattttttttcttttttgaatttgcttgccggtaatgttttcgtcagtatgtaagttgttcatgatgaaacttattccatatgtctgtatgcaagagaaatttatgtgcaggaagcgctgcgtttgatagatgctatgaggaaaatgggcgtattgaaatgttatttccttatgcatataaccacttggttaatgatttttagcccagcgggaatgacatagcatcactatgcatagcggtggtaaatgtagtcccggttaaacaagtgtaaaattatgcctggaacagtcacattggatgtatcggaaatatttgcaggttaattcttacagatgtaatccctgcagaaggtaagtgaaagaaaacggcattatcaggttgcaacgacaaaactttcaatgcctatctaggatgaggacgatgaaggatgctattgtagataatggatgaataatacgattcccggtcttccggctacgtttgcatatcgtcgatcaggcatgtctggttggatagaaggagagcacagcatgtcattacgttcaacataacaaggaataatgatgagtaaaacggcaaatttaagcgcgattattattgatgatcatcctcttgcgcgaatggcgatccgtaacctgctggaaagtgagggttttaacattgttgccgaagcgggagatgggggcgaagcgttaacggctgtagccgaacatcagccggatgtggtgatcgtggatgtggatatacctgtcataagcggtatagaagtcgttgaaaaactgcgtaagaagcaatttagccagattatcattgtggtttcggcgaaaaacgatctcttttatggcaagcgtagtgcagatgccggcgctaatgccttcatcagtaaaaaagaggggataaacaatatcatctctgccgtccatgctgcgcaaaatggatacagctattttccattttcgctgagtggctttgtcggcagcttatctaatgagcaggcgatgctgcagtcgctctccagccaggaagtcaaggtgatgcgcgccatcctgaatggggcagacaatatgaaaatcgcttcagagatgcatatcagcaataaaacggtcagtacctataaaggtcgattgatggagaagctgggttgtaaatcgctggtggatctcttctcatttgcaaaccgtaataaaatcggataatgcgatataccggtgaagggcatatccagcgttactgtgggggatgttagcgtgtcccccgtctttataaatcaaagccgtcagcaacggctggcgcaaaaacgaatgtcaggtatcgtcattgtaggtgcaaagttttcacagttaagcatacatgagtcctctgaacgcgatcgcggattctaaatcgattatttattattgatggaaagagtattgtgcctgcctgttatactgataaatgtcgcgggcagagccgcctgcgaacgatgccttcatgttcccgtgtagggcaataaaatggcaatgcattctcaataaggcatcggatgatatccccgctaacagagagactgaaccctacgggaaagtggaccaacatgcctgaagtgactatcgatacctggagcttctatagccgacccttttactggtttgcagggctggcgacgctattgatcctgagtggtttgctctggggcgtgcattggctgcgatctgagcgcaaacgaaaagcggttcaggcggcgctggagcatcagctcagttttcaccagacgttgttcaacgcgatgccgataccggtgtatgtgattacccttaagggcgagcttgacagttataacaacgccttcagcgcttttttccccgagcatctgcgtgaagcgatgcatttttcactgttcgaccggcgtcatcctctcgcgcatatcttccctgcgatccagcatgaggttcagctgggcctgacccccgatatcattatcacgcatccactggcattacataatggtatagaggaacgaacgattttgcactggatggtgttatgccgcttacccacaaccctgacaccggtcttaatgtgtggctggcaggatatcactgagtcccgacagttagtggagaagcttcagaatgaaaaagaacaggtcaaagacgccagtcaggagagcagtgcctctttgccctgctcgagtcatgatgttcgtacgtcagtaagtgctatcctggggtttcttgaacttatcttcacccgccaacaaacagcagaagaagatcagcagtgccttaaactggcgtatgccaccgctcagtctttgcttggtttgaacgttgataccctgcctgggaacgttaaggcagttccgcaggcaattcgtattctcattgccgaggatctccccgccaaccgccagctgcttcgccgccagctcgataccttgggctacgctgctgatgaagcgaaggatggcgccgaggcgcttaaactcatccagcaacagcgctatgacctgttaattaccgatctgaatatgcctgtgatggacggtattacgttaacctgtcgcgtgcgcgagtacgataccagaatggtcatctgggggcttaccgctaacctcgtggccggagaaaaagagcgttgcctggccagtggcatgaacttgtgcctgtttaagcccctggatctttctcagctggccaccgcgctgtgtgaaataaatataccccagcccggcagctcgcttgatgaattcctcgatatgaagatattcaccgcgctgacgctgggtgataaaaaattaatgcggcagatgctcgagcaatcgcgggtggaaaacgaaaaggatatcgccgcagcgcgcgcggccatcagtggacaagactggcgactggcgcaataccatttacaccgaattaatggtactgcacagattcttggcgcaaccgctatccatgcgacagctgaacagttagagaatgcgctggcggcgggggaacctgaagccgttttgccgcagggaatagatgaacttacgcagcagttgcaggcattaagcgcggcgataatctttttttccagtcaggcggactaccattgatagtgccgctttcaccggatcgctcctgattgctctgctgcgcggcgcaacaggagaaaaagtcagttcgacttaaccagtcgatctgttatgagtcatgggcggcgcaggctttactcgggagcccagtcttaaccccagctccacagccataaaaccgactatcaggctgataaccagataacagatggcgatcagcgcgctgagtggctcattcatcatttccaccgcgccagatacaaagctggagaaggttgatagccctcccatgatacccgtagccaccatcatatggatgtactgattaacccggttccttttatacagtgatgtgcataaaccaagcaaaaaagcggcaataatattggcgatgaagatatccaggggaaagccatcgctcaggcgaggcactaccaacatcaataattcgcggcatattgcgccaaacgccccgccaacaaagatcagaatagtaaaattaagcacctgatgcgctccttatggacaggctaaccatgcaccgcaggcagccgccgccacgccggtaaccacagagacgattaaatatcctgcagcgagtaacctctggtgcgcatgagccaggttggcggcatctaactgcatgctgctgaaggtggtataaccgccaaggataccggtcagcaggcctgcatttaaccattcaccatagcgctcgcgccagtcgataccgaacagcgcgctgagatatccgatgattaatgcgccgctcacattgattaaaaacgtgccgagaggaaaatgtccgcggtaaagtttgctgacggcaagaccaacccaccagcgtagtaaagagccggtgccgccgcccaggcccacccaaaaaatgtcagtagcgaccatatttataccttttaaaatggcatcatcccgagaatcatcggtgggtatctcttaacgtttgcccgggagtaaccctgtcgtattggcgtaagcctgtattgagataaaatttggatctttccctacgttgatcccatcaaagttgctgctgcctggccccgacattcacggctatcctgcgttttagtcacgagggatcccagttaccaggttttgtataacccggctcgagaacaaataccgataccgattgaggtatcattgccagaaacactgccccgttaagccatgttgcaaaacgcgctcctgacctgtttttttgcttagggataaaccgtggacaggaggcatgacatgctgcattttttgaccacgagagcgcggcggattcgcttttttcataggcgctgagagagcaatgtttgaagattaagtctggcataaaaacaccttttggtaaaagaacaggaaacacatgtatcagtaaatttctgctgataataatcaggtatgataagcaatgattcgcttttgataataagtatttttctaccagtattaatgtaagctgaagactagcagagagggaaatagatgagaaatcgttcttgccgttataaaaaccatccttgaataggtgaaagctatcttgtcatcgttatcaatcgcttaaaggaactgtggtagtctatactctaaaggcgccttccgtaacactttgataataatggttgttttttttgtttgtttataggcttgggtgatttttttagttcaagaaaatgctatgaaaagtctcctgaaatactacacccccctaatttcatcaaaaaaattattttgctttggacttgccagatatatgtaggattatagtgggcctggtgaaggtgggggatgacggatgtaggattttcccggatgtaaataaataccgatcaaattaaatgatgcgacaatatctgcggttgatatcacctcgagtaagatttcactgcctgtcattcaatgggaaataggccgtgcgaggtctggatcaagttagagagattacgtgatgaattgcatccaataccataaaaaggaagcagtgaggggcgtcaagcttcatgctctcggataattttctcagctttgctgaacagatatgggcgaaatcaaatttcccattgccagggcgtcttcgcgttggttaattatggtttagccgaaagtggtttcctgtgtctcgtcggacaaaggcggctccatcgtgtttggtatattgccagaggcctgcgtcatttcccccatgacaaaagcgagattcgctgcggcgatcagcgcggaggtgtaggcgtcgacattcctttgctctgcgctcagcagaccgtttgccgcttcattagcggcggtaatggtgcccacaccatgacggtaagtctcaaaggcagtatcttcagtcatcatggcggtactggccagatggggagccgcccggtgtggttcaaacgcagagcgcagtttgttggccgaaactatgctctctctttatccactatgcggtatatcgctgatacacatcaaccatcagcggcggggtatcgcagtcggtgttatgtacggccagtctcacgctttctgttattttcttcgtaccaggaaatgaaatcagctgccggcatcggtctggcataaagatacccctggacgtaagacacccggttatctttgagccactctgcctgctgttgcgtactgacgccttccgcaatcgtggcgaggcccagacgcttgctaaggccaatgatggtatccaatactggcgtatccgtcccggcggaggtcagcgtatcaataaaaattttatcgattttcaggtagtccacgggcaggttgtgaagcagactcaatgagcagtatcctgtcccgaaatcatccacggctacctgacagccatgctgacgaagtgcgttcagattctctgaggccaatgcggtgtcatcgaccaggctgcgttcggtgacttccagtaccaggcgaaatgaggcagcgagggattgacgaaactgcagcacgtccgtggtaaaggcgtcatccgtcagatgggccgcagcgatattgacccccagatggaaaggggcggtcacctgccaggctttgacatcggcagcgatcaggccaaaaagatgtcgcgtcaggctgataatcatctcctcttcttccgctgcctggataaacagcgctggcgatattgagctgccgtcagcccgctgccagcgcatcagggcctccgcaccggtgcacataccggacgccgcctcacataccggttggtaatgaacaacaaactctcctcgcgccattcccttcgctatttcatcagccagagacaattttcctgtcagccagcgtcgccataaatacagcgtagccagcgtcaggagtagagaggccgggccgagaaaaatcatattgcgcaccaggtagcgagcaagcgattgccagggggtgatgatctgtatacgcgcctgactaaagtcagaattgaataccgcactgaagcccgcgaggtcttcagtgcctttatcctgactggagataacgggaccgtcactaaaccgcaaccgcaggatggcatgattttcatcatccagggtttccatcagatcggtaaaatatcgtccatctactacgctgaaaaccgtgatgccattaccggcaccagaggcgtagatgatagccgtctgatgcggaacgctgcgggtaccgttaatcgccgttatttcgagactgcccatctctgctgagagggggagtccataaactgaccgaatactttgctgtctggagccggtgatggaggaacaaacaagcgtgtccccacgcaccagaccggtactacggatgtaaggggtgagcgcaccggtttcggtcatcttttcaacaacgttttcgcagggctgattcgccatttgcgctgtcgtgtggagggtatggcgagcaatcgacgtcacgtggtcaacctggcctaacagaatctccgccgttatggcggtatccctttgcaactgacgaacggccatccccaacgatagcaggccaaccagaatcgccggaacgagaaggctgacaacaatcatccttttactcagctgcatcatggtgatcatctctgttaataattagccagacgcacttcagttggtgcactggcaaaaaggtccgtgttgtttttattcccgaatttatccgccggttatgccgcagtgagagcgtgaatttcctcagcgctaaggcagatttaaatgccgacagatgctgttacctaactcagtctgctcgatcccggtggaaggcacgattctcatcagaggaagctcgggataacattctattatccgttgctcgatgaggctgtttgcccaactgcactgggcaatcgcattctcatagtttgaaaaccctggtttgttgtctagcccacattcggatgcggatacacctagccctgcagattcaatatgcaggaaatgtctcaatgagggggcctggctcatacgatcgacaaacctgagcatcccctccacataccctgtccaaataaacggattattaccggatgaggtgatatgcgcacaattgatgacgtcagtaatggcattgagacgacaatcttcaagaaaaaaatccggtgccgtcaggtctcctagcaggatattgccactggatattctgttaattaacgtttcagcgagttgaaattttctgaggttctcattgacacgcatcacagcatgttttgtcgattcacctcttgtcagtaatagcagttggcattcggatttttctttcaagatataactcaatgcggcaccacctaaaaaaccggttgcgcctgtaataagtacgttccgcattttttcactatcattttcagggttattggccagactaaacggatgactctcaatgcttcttcaatatagcagtaattcttgtggtctggggtgaagtatttagtgttaccgttttttggtggagttgcgtttacaacaacaggcaggagtatttaggaattttcggacgcggagttgttatttctgaaatatttcagcgatgaaggtaaatgaagcaaataaataaaggacagcttccctgtcctttattcttttttattcagttttgctctcgcgcgatcgtaatacctcaccgaccaccggggcggcggtaaacgcatttggccatcccgcgtagaacgccgcctgggcgaccacttctccggcctcttcagccgaaagcccattatccatagctctgtttaggtggtagccaatctgcgcgctctgtccggcggcgattaacgcgctgaccgtcaccagacttctgtcgcggggcgtaagcgcgggccgttgccagaggtcgagaaacagcgggtcggcggtaaatttaaccaggccaggcgaaatggggccgacatttttttccacggtgtctgcacgctgtttctctacctgttcattgagtggcagcagcgttggcgaggcggcgggcagggcctctgccgtcacgcccctggcttcaaagatggttttagcgacgctgacggctgacatcgcattgggccagccagcgtagaaggcgaggtgagtaatgatctctgacacttccgctggcgtcacgccgctatcgagcgcaacggcaatatagtgcttcagctcgcctggctggttgcgggcaatcagcatcgctacggtcacgatgctacggtcgcgggcggacagggcgtcacgttgccagaggtcgttgctgatggcctcgcggccgaagcgcgccagcgccggggagaccgcttgaatatcagcgtccgcaagggtggaaggggtaattttcatcatagcttcatctctttgttcgtgggcataagcaaaatcagacagcacaagcgacaaggctgccgcggcaatcacgtttttcatgttttattctccctgctgaacaggacagagggttaccgcgtccacacctgaggatggtctttggcttgcggcgtgttttgcgccatcacgcctgtgagaacgtgcggctggtaggcttcttccagataacggatgtcttccgggctcagttgaagggctacagcgttgaccgcgccgtcaacatgatgcttttgcgtggcgccgatcaccggggcggtgactttagtcagcagccaggccagcgaaatttcggtcatcgagacctgatgccgttcggcaagttcggcgacgcgggcaataatgatccggtcctgctctgccgtgccgtcgtatttgccccgggcataatcatcttccaccgctcgccgcgtgtggccttctaagcgggagagacggccgctggccagcgcgctatagggagtcatggcgataccctcttccgcgcacagcccgaacagctctcgttcatcttcacgcataatcaggttgtagtggctctgcacagaaacaaaggatgtcagcccttcgcgttcggcaagggcgttcgccttcgccagctgccaggcatagcaattggaaatgccaatcgcgcgcaccttgccggcggtcactgcggtgtgcagcgcctccagcacgtcgataaccggggtgttgtaatcccagatgtggtagatgtagaggtcgatgtagtccatcccgaggtttcgcagactctggtcaagcgagcgggttatagcctgttttccgctgatcccctcggcaatctgcgcggcggttcgtggcagaaacttggtggccagcaccacctcctcgcgttttgccatctcccgcagcgcccggccaacgtaccgttcgctggagccgttctgataggcgatggcggtatcgtaaaaattgatgccctgttccagagcgtggcggatgatgtcccggctggctgtttcgtccagcgtccagcgatgctgacccgttgacggattgccaaaccccatacatcccatgcagatacgggagaccagtaagtcactcttcccgagccgggtatactgcatcgttattttctccctttgggttattccaccagagtattaagccgcgcgatcagtctggccgcgtgttcccgggcaagcgttttttgctgagcgattttgtcggcatcccggtcggcgtagctaataccgcaggtataaaccggcgccagcagcgcaagattgcacagcctggccgtggtctcgaagggaaggagatactcctcaacggcatggccaaagaaaccgtcagcggtatagagcgcctgtggcgctcccgtggtgaaggagaggatcagctttttaccacccagtttcgccgttgagccatgggcgaagccgtggacaaatacctcgtccagccactgtttcattaacccgggcagcccataccagctaaagggaaactgccagacaatcacatccgcctgcagcaggctttcctgctcagcggcgatgttgaatttgccgtccggatagagccagtccagacgacggatttccgcatcaggcagggcggtcgccagctcatcgaggatggtggcgttggcgatggaatggttaagatccggatgcccggaaacgacaagaatatgagccattcccaacgttactcctgatgtttaaattcagcggagaagagattttcccagctaataaacgagccgagtggaatacactcgaaggttaatagacccgcttttgccagcggaaattcggccatgacattattcgcctcttccacggtgtcgcactcgaggaaaatagcgacgccgggtcgatcctgacggaaatagatgtcgcgaataaagcctgacttgtacagtccccaggcatgcagggcttctgcggtaaggtgcggcgcatagtgttccagcgtcgcgccgggggcagggatatccagacataaaattcgcatagttgtctccggaaagtcgttgtcagcgggaagagacaaaagtatacgagccgcagggggggaagattaggcggtcattgacttaagaatatttagcctgtacttaataatcaggcgagggtgtcgtaaggagatgctatgaataacgcgctttataatcagatacgcatctttcagagcattgcgcgcgagggcaatatctcggccgccgcgcgcaagctcgaaatcacgccgccgtcggtcagcaatgcgctcaggctgctggaggagcatattggccaccccctttttgtgcgcactacccggcgtatcgagctgacggaaaccgggcaacagctgctggagcagaccgccgcggcggtggagacactggaaaagtcgctggaaatcatccgcgaccagaatcaggagccctccggggcagtgagaataaccctctcgcgctttgcctacctgcttattctcaaaccggcgatggcggcattttgtcagcaatatccggggatccagctggaaatatcggtctatgacggtaccgtcaatattattgaagaacgtttcgaccttgggatccgctttggcgatattctcgaaggcggcgtggtcgcccgcccgttaatgaagccgtttcgtgaagggctatacgcctcctctgcctatcttgccgaatatggcgtgcccgcgatgcctgccgatctccatcatcaccggctgattggctatcgctttattaccaacaaccgcatcctgccgctgagcctcaatgaccacggcgagcagctcaccgtcgagatgcccggacagttaatcagcaatgatattgacgtcatggccgacggtattcgccacggactggggattggccgtttatttgaaccaatcctgcaattacagcccgatcgtgagcagtttattcccgtgatggaggactactggaaaacctatccgccggtttatctctattacccaaaaaacgcgggcagaacgaaaagggtgaaagccctgattgatttcctgataatgcatgccgcggatgatgcagagaaagtcgggtcttcccgctagcgttcagctcagatcgtgcagcgctttgtccagcggtggggaaagctgaatatcctgaaacgcaaccgccagtccgccacgctccggtgagcagcacatgacgcccgctttcaccgggcctggcggaaagtagccgagccgcagcagcggccagcgctcgccgtcggttgaatactgcagccttaacgcgtcgcccttgcgggtcagccgcagccagaaggtgcgcgggtcgccggggaaaagcccggtggcccagtcggagtgggttagcgtcagtacgctgccgatggccggggcatcgtcattaaactcaattcccgccttcagccaggtctgctcgtcggccatcatcatcagcccagcctggtcgtaaagcgtggtgaaatccgcacagatttttgcctgcagggtaaaatcgcccgccacttctgcggcatagagatggccagagaagcgctcgaagccataccaggtatggcgccagaagtcggtatgcttattagtgaccaccgtcaggccgtcggaatcgcggcgccactcggcaggttcattgatccagtgaaagtacggctgcatttttcctccgggatatgctttcagacagggttataacagcgactgcagcgcgggtgacgccatgctggcctcaaagggaataatctctgtacgggcgagacccagctgctggaagggatcctggctcagacgcgcttgcagagtttcccggctatcgcattttgccagaatgacgccgccggtgcggggaatacggcggccggaggcgagaaagaggccgtcggcatagccttttttgagccattcgatgtgggcggggatcgcacggtcaacctcttcgagcggttttatatacgttaaaacaaccacataaatcgtactcatcctgaaagccctggcaatccaatgggatctccagcctgacatatttcgatgatggataaaagaaaacgcggcatttttccgtgctatttagcagggatggcggggcgcaacatcccggatgctcatcgcagacgtgaattaatatatatgtttttgcgcatgtatattgatctttctttgtggccccgtatgctgtccgtcacgcttgaggagaaatcatgtctttattgcccctgcaactgttcaaaaacctcgccgatgaaactcggctggggatcgtattgctgctcaaggcgcgtggagagctgtgcgtgtgcgatctctgtacggcgctcgcccagtcccagcccaagatctcccgccatctggcgatgctccgtgagagcggattgctgctggatcgtaaacagggtaagtgggtccattaccgcctctctccgcagatgccggcctgggcggcgcaggtgattgagcaggcctggctcagtcagcaggaggatgtgcggctgatgatcagcagactggctggcgggccgggttgccggtaaaaaatttatcttaacatatatgatttttcgaatgtgattggcggaggaacgatgttgctggcaggtacgatttttatcctgaccctggtgctggtgatctggcagccgcgggggttagggatcggctggagcgcgacatttggcgcggcgctggcgctggccaccggtggcgtacaggtagccgatatcccggtggtatggcatatcgtctggaatgcgaccgccacctttatcgccgttatcattatcagcctgctgcttgatgagtctggctttttcgaatgggccgcgctgcatgtttcccgctggggaagaggccggggtcgtctgctgtttacctggattatcctgctcggcgcggctgtggcggcgctgtttgccaacgatggggcggcgctgatcctcacgccaatcgtgattgccatgctgcgagcgctggggttcagcaagggaacgatgctggcctttgtcatggccgccggatttattgccgataccgccagcctgccgctggtggtgtcgaatctggtgaatatcgtttcggcagatttctttgccatcggcttcagggagtacgcttcggtgatggtgctggtcgatctcgcggcgatcctcaccaccctggcgatgctgcacctgttctttcgcaaggatatcccgccggcctgggatatggcgttactgaaagcgccggccacggcaataaaagatccagcgacgttccgcaccggctggggcgtgctgctgctgttgctggctggctttttcatccttgaaccgctggggatcccggtcagcgccatcgcggcgctcggcgccgggatcctgtttgctgtcgcgaagcacgggcgggtaattaacaccggcaaggtgctgcgcggcgccccgtggcagatagtgatcttctcgctgggaatgtatctggtggtgtatggtctgcgaaacgccgggttaacggactatctgaccacggtgctgaacatgctggcggagcgcggcctctgggccgcgacgctgggcactggtgttctgtcggccttcctctcttcgattatgaataatatgcccagcgtactggtcggcgccctgtcgattgatggcagcgcggcaacagggacgatcaaagaggccatgatttatgccaacgtcatcggctgcgatctggggcccaagatcacgccaattggtagcctggccacgctgctgtggctgcatgtgctggcgcagaagcacatcaccatcggttgggggtattatttccgctgcggcatcaccatgaccctgccggtgctgcttgtgacgctggccgcgctggcgctgcgtctctccttcaaccagccatgagaacgtactatgagcatcaccatttaccataaccctgactgcggcacctcgcgtaatacgctggcgctgatccgtaacagcggcgccgagcccaccattatctattatctggagacgccgccgtcgggtgatgagctgcgccagctgctcgccgcgatgaggatcccggtgcgcgcgctgctgcggaaaaacgtcgaaccctacgacgcgctgggcctggcggaagaccggtttactgacgaccagataatcgactttatgcttcagcatccgatcctgattaaccgtccgatcgtaacgacgccgcagggcacccgactctgccgcccgtcagaggtggtgctggagatcctgacggcgccgcaacaaggcgcattcgtgaaggaggacggtgagccagtcattgatgccgcagggcagcgtgtgaaatagcgcgcagaatggcgccggctgtagcagccggcatgccgtgttaatcctgctgtatggtaggctctccaggtatgtagcgcctggattgctgacaatattctcgcttagcgctatttctccactatccagtctgtttcccttacttttcctgccgttatacaccgcctctgcgccggtggtttatgtctctcgataaattattaactgtttgtttttaatgggtaaaatttcgttttgtgcgtaatgatataaagtcaacgtcgtttgcattattgcgaacattaaatctgtaaaactagatgtttgtcgacttttcatctaaaaagggaaggtaaggggctggacaaaaccattgcgtggttatcaaatggttaaaaatgctcgtgtttgatgttaatacaaacaaattataaatcgtcagcctgctttatacggttaacttgcgctgcggcgcaccttacctggagaatttatgcattcctctgttaataaaaacgaaagccgtacctttttcggccatccttatccgctgggctccctgttcttcactgaaatgtgggagcgcttctcgttttacggcatccgtcctttactgatcctgtttatggcggcgacagtgtacgacggcggcatgggcctggcgcgagagaacgcctcggcgatcgttgggatttttgccggcagtatgtatctggccgcgctgcctggcggctggctggcggataactggcttggccaacaacgcgccgtctggtacggctctatcctgatcgccctggggcacctgtcgatcgctctgtcagcatggctgggcaacgatctgttctttatcggtctgatgtttatcgtcctgggttccgggttgtttaaaacctgtatctcggtgatggtcggcaccctgtataaaaagggcgacgcgcgccgcgacggtggtttttcgctgttctacatggggatcaacatcggctcgtttatcgcgccattgatctctggctggcttatcaaatcgcatggctggcactggggcttcggcatcggggggatcgggatgctggtggcgctgatcattttccgtgtctttgccgtaccgtcgatgaagcgctatgacgcggaggttggcctcgattccacctggaacagcccggtggcgaaaaagaatggcgttggagcgtggctgctggcgctggctctgggagtggcggtgctggtcacgcttatcagcctgggcacgatcgtgattaacccggtggcggtggccagcgtgctggtctatgtaattgccgcctccgtggcgctctatttcatctggctgttcgtcttcgccggactcaaccgtaaagagcgggcgcgcctgctggtgtgctttattttgctggtctcggcggcctttttctggtccgcgtttgaacagaaaccgacctccttcaacctgtttgctaacgactataccaaccggatgatcggcgattttgagatccccgcggtctggttccagtcgattaacgccttgtttatcattctcctcgcgccggtattcagctgggcgtggcctgcgctggcgcgtaaaaacgttcgtccgggcagtatgaccaaattcgtgattggcatcctgtgcgcagcggcgggctttggcctgatgatgctggcggcgcagaacgttctgagcaacggcggggccggtgtgtcgccgctgtggctggtgggcagcatcctgatgctgacgctcggtgaactgtgcctcagcccgattgggctggcgaccatgactctgctggcgccggagagaatgcgcggccagatgatggggctgtggttctgcgccagcgcgctgggtaacctggcggcgggcctgatcggcggtcatgtgaaggccgatcagctgtcgctgctgccggacctcttcgcccgctgctccatcgcattgctgatctgcgccgccgtgctggccgtgctgattgtcccggtccgccggatgctggagaacagtcggtccagcgccgcgcaaaaatccctcagcaacgcctgacgcgatcctcaggccggccctacgggccggcttgttttttgtccaatccccgccccagcagaacaaaatccccttttcacaatgcgcgatgtcccataacgtgagcgtgttctttgaaatcacgtcgctttccggtccatagtgtagtcaggtttactatgtggttaatataaggacacacctatgccagcagtcattgataaagcattggatttcatcggtggtatgaatacgtctgagccagtaccacagtctatggatgaaagtaccgcgaagggaattctcaaatatttaaaagaactgggcgtacccgccaccccggccgacgtcgctgcgcgcggccaacagcagggctggagcgctgggtttaccgataaagtggcggagtgggctgaacgggtcgccgccggcgaacggctggtgattaagcatccggaattcttttccacctatatgcgggaagagctgcgcgccctggtgtaatcgccgcgcatctaccccgccccttcagcttaatgccttcccctattgggaaggcattcttgttactgccctcgatagccgccgcccagggctttgatcagggtaatgtcggtgcttagccgctgggtctcaatgtccagcagcaacagctgctgggcgaggaccgcccggcgggcttcttcggcggcgtagcggctgaggaggccgcgctgataatgagcgcgagcgctatcggtggtggtctgcgccgcggtgacttttagctgctgcagcgcgcgctgctgattcaggtcgttaagctggctggagctgatagcgacatcgcgaaccgcatccagcaccgcctggttgtactgtttgatcaggatgttgctggcggtgcgtaccgactgcagattagcgttcagacgaccgccgtcgaagatcggcagatacagcccgggcagcaggttgatctgctggaaagaggacttaaacagatccccgacgctcagggcgttatagccccagaacgctttgatatcaaaatggggatagaaggccgctttcgccgcatcgacctggctcagggaggcggtgacgtagccgcgcagcgcctgcaggtccggacggcgggccagcagctcgaaagagagcgacggcggcagcgtctcctggagcgccggcagcgccaccggatggatggccggcatgctctgcgcatcggcgccgataagcgcccgcagggtttcacgatactgggtcagcatcccctcggcgctaatgatctgctggcgagcggcgagctgttcggcctgggcgttggccacatccacactgtcttccaggccgcgccgggtccggtgctcgtgggcttccaccgagaatcgggcaatgccctccagctcctgcagcagcgcgattttctggaacgtcgcctgcatggcgaaatagagctgcgccacgctgctggcgatgtcgagctcaatgccggcggtctccgccagccgggcgtttttctcgccaatagcggcggcgacccgggcgcgatcggccccccagagatcgatattcagctgcgccccgacgccaacggtattcagcgtataccaggggccgtttttatccaccggcagggagtatgagtagggccagctaaaggatttgtcggtgatccgcaggcggttttgcgccgcgacggcggtggcctgcaggcccatcgccgaccgggcgagttccaccgtggactgcgactgggagatgcgcagccgggcggcctgcatggtcggcgagttctgcagcgcccggttgatcagcatattgagctgaggatcatcataggcctcccaccagcgggcggccggccagtcgctgttcgccaggtggatcacctgcgccagctgggcctgctgcggattgacgatggcgacctgggcaggctcatcctggatcagcgcgcagccgctgagcaacgtcagcgtcagggtaaaaagagtgccgcgcaggcgcgcggagaaaggaaggatcatcatgacgttttagcctgttgctcagtcgctatcggtgtcggcccccagtcgggcagggcggccagcgcggcggccagcgccgggccaaaggggttagtcaggtcggcggtcagctgttcgccaggcgccgtcgcctcctgttcgatacgttcagcgtagcgccgcagctgttcggcgcagcgggccagggtcgggtctcccggcgcggcgttgagtcggtagccttcgctgaggcgggcgatctcctcggcctgggcgagggtggcgcgcatcggccagcctttcgcctggggccaggggtgagcatacgtgcccagcggttcggcgcgaacccggtggagcagcgcttcgctgtcggtgaaggcgacaagcaggggagccagcggaaccgcctccttcggggcggcgaggcagtccgccagccggcgataaagtgccgcaaggcgggttttcagctgcggcgcttcgctgtccggccagagatacaaatgaacaatggaggagaccagcaccccgagcaggatgcccagcacccgatcccgcagctcggtgaggttcgtcagcggagcaaaccagctgagaaaggccagcgcaaaggtgaaaccaatctggatcccggcgtaggcgatacgctccgagccggcggcaatccacgccgccagcgccagcaccggcagggacatcgccagcaggcccgtcagcgaatcggtccagggctggacaaagacgattaacagcagcgccagcagggaggcgagcagcgccccgccgatgcgcagccatgtcttttgcatcgtggcgcccagcccgggctgggcgacgatcacgcagctcagcataatggtatgtagaccctgccagtcggcagcggtatagaagacatagcagattagggtcgccagcagggtcttgagcgcaaaatggagatatgccgggttgcgccaggcgtccggcgccagtaggggcgccttctccacctcaccctgcggcagggcaaccggctcaccctgcgccagccgctgcagagtggtagccatctcctgcagaacagcgcgattgacgccgcgaccgctgagcgtcaggggaggaatagcgccgtcaaacggcccctcgctaagggcgttcttcagctgaagtaccgcctgcgacagctgctggcgatcgtcactatccgcctcgtctgcttgcagcagggccgccagctggtagcagcgcaaagtggcggccagccgcgagcgccaggcctggggatcggcggcgatctccggtgtcgcccggctggcctgggtgaatagcgactgcagctgattgaactgcgcggcggtctcgccgaaggtcggtggcgcttcagcgtccggggccgccagccgccgggcgacctcgtgcagcatcccggccagacgcgccttaaactggttaccgggaaaggcctgctgaaagcaggcgttaaccagcagggtgacgaggatcgcggtgttaatcgccacccacagccaaagcagcagccgcaccaggatctcgctctggctggtcatcgacgggaaggtctgagcgtaaatcaccgccagcgccaccacgaaaaaggccagtcccagcttgcccagcacccgcatcagatagagggcgcagaaaaagagcgccacggaggctgccaggcggatcagcgggtagtcataggtccacttgatgatcagcagcacgccgccgagcgccacggtgacggtgacaaaaaagaccacgctgaccagcttaatcatcaacacgttaggctggctgacgtagaacacgacgatcagcgcaacggccaggaaagggatctgcagggtcataaacagggtgatgagcaccgcgcagcttagcgtcaggcgcagcgtgtagctggcgcgtcccggcgcgtcgcgcagttcctggcgtaaaaaatgggcgagaggaaacatagcgtcgcccggctacggctgcagcacggcgctggccgaggcgcccatgcggaacagttccgggtcgggatcgctgacggcgattttcaccgggaagcgctgcgagacgtggacccagttaatgcttttctggatcagcggcagcccttcgatgacgctcccaccttcgggcaggactccggagccgaccgaatccaccaccccgttaaaggtccggttgtggttggtcatcacggtgatccgcgccgccacgccggggcgcacgttgttcaggtcggtttcgcggaagttcgcgatcacataccagcggtcgtcatccagcagggtgaagaccggcttcagcgccgaggcgtactggccgacggtggttttcagcgccaccaccacgccgttgaacggcgcgcgtacttcggtaaattccagatgcagttcagcgagggcgatttgcgccaggaccccggcgcgttgcgccaccatggcatccacgccggtcacggccgccgaggcctgtttggcctgcagcagcgtggcctccagctctgcccgcgccgctttctcagcggtgcgcgcctgatcgagatcttcctgggaagcgaacccctgcggcaccagcggctcaaggcggatacgcgtggaggtggtctgcttaaccagcgctctggcgcgctcgacggcggccgccaccgactgggcgttatactcttgcgctttgatggtgcgctgggtcagcatgatctgcgcgtcgagggtcgtcagccgggctttcgcgtcatcgagcattgcctgataggggcgggggtcgatgcggaacaacagatcgccttttctcacccgctggttatcgcgaatgggcatctccacgatgcgtccgctgacctcgggcactacatcgatggtatcggcatagacataggcgtcattggtctccggcgaggtttgcaactgccagataacgaggatcagcgccaggatggcggcaaggaccagcgccagcagaggccactttttgcgtaacaggggagtgcgggaagttgtcataagcgatcagtgaacaaaaaacagaaaccacagcaacgtggcgaacaggaacatcagcgcgacgtagctgaagaccaggggagaaaagcgcggctgccagcctttacgggtaatcaggatatggcaggggatcagtaaaaacgcaccgcccagtaagcagaaaaaccagccgggaaaagcagcgcccaataccgggatctctggcgaaagtgagcagccggaaagcggcaagacgagcagtaaccgcgccgggcgggcgatggtggcaatatgattcaatggaacatccctgagtgatcataccagtgtgtcatgagtgtaatcgcctcgttgcgggaatgaaagtcaaccgatcgttgactgcgggatccttgcgcgatgggagagcatgatgtgaggcgtcaattcccgcgcttgcgcatagtcagccgccacggcgagggctatgcttagcctgaaagataaaaacgaccgaggcaatgtcatggataaggaattactggaagccggctaccgggcctacaccggggagaaaatcgacgtctactttaatacggcgatctgtcagcattccgggaactgcgtgcgcggcagcgcgaagctcttcaacctgaagcgtaagccgtggattatcccggatgaagtggatgtcgcgacggtggtaaacgtgattgatacctgcccgagcggcgctctgcaatatcgtcataaataagcgaggagaagatggaaatactggaagggcataacaaattttatgttaacgacgcgcagggaaaccaggtggcggagattgtttttgttcccaccggcgaacacctcagcattatcgaacataccgatgttgatcccagcctgaaaggccagggcgtggggaaacagctggtggcgaaggtagtggaaaaaatgcgccaggagcaacggaagattatccctctctgcccgtttgccaaacatgaattcgataacacccgcgaatacgacgatattcgcgcatgacgtaccggcaccggtgctaaccggtgcgcttttctcgcaccctcaacgtttcgccggatcgcgctggtgggaaaagcggcggatcagatccgggagatgttcgcgccgcatcggtggtgaaaacagatagccctggaagcgatcaatccccagcgattttaactgcgtaaatttcgccagtgaatccaccccttccgccacacagcggctgccgctcaactggcagtagtaggccaggctttttattagcgcaagcgcctttggatcgtgctgggcgtcattgacgatgctcatatccagtttatacgcattgaagtgcagtcgacgcgccggaaagataacgctcccctgagaaaagcagtcgtccagcatcacgcgcacgccagcacgttgcagctgcgccacgtgggcggcggagcggctctgatggcgaaaatcgatagtttcagcatattccagcaccagccttgccacgccctctggctgccgaagctgctggcgagcggcttccaccatccgcagcaggctgtcactgtcggcgagtgaggagggtatgttgaccgaaaaatagaaggcgcctggatactcattaatattctgcacggcctcctgcagaacaaaggccgtaagcagcagccaggtgtagtcggcgcggaagtgcggcagaaaggtctgggggtgaagtacctggccgcggtggcgccagcggatcaggatctccaccccctgtagctgtgagcgactatcgacgataggttgaaaaaccgggaagacctggcgatcgtgaatcgcttgtacccattcctgttcaaacgccgtcagtgcgtttgcgggtgagcgcggcagcagcgtgcgcggaaagcggggggccagatgcggatgacattccaccagctttttcaccccagccagccgttgggtgtagagcgttttctggctcaatccgagacgttgggcctgctcgcctatcgtctgcccttgcagcagggcgaggatcaccttgagctcggcgtgggtcaacccgacgacccgttttccgtggatcagggcggcttcgctggcaagccgctcaagccgcggcgcattctccagccgatgggccagctccgcgcaggacagatcggcgggggcagtatggacgttgcgcagacgatccggatgactcacctgatagagcagcgtttgccacagccagatggccgggctgcggctcagaatcaacatcggtaacggcggcaaggcctcgtcgagtagccttgccgcctggcgcagcgtggtgagcatccacaggggatcgtcagggagatacaccacgatccgcttcacggcggccagctcgcgcagggacacgccctcgaccggcagctcaacgggccgcttcgcggcgttcagcatcagctggctcaacccgcgggcggccagcgagcagggcgagaggatataatcggtcatcattgatagacaaaggtgatgccgatgatcgactgcacgttgccggcggtaacctggcctgtggtccgggcataggtggccgtcaggccgaggttgaccggcgaggtgccgacggtgcccagcgagaccgtgctgttcgccgggacggcgctgccgttgcgcgtcagctgaacgcctatcccctgcgccggcgaggcggaggcggtattggtgaagatcgcgttggcgctgtccgcggtggtgccggagaggtaataccccagctgctggctttgcgcgcagtggacggtgagcggcacggccatcgatcccgggtagtcggggagggtgacggtgacatcgcgggcggagacgtcgcagccgccggtggggaccaccacgtcgttgttggcgtaaatgttccagatgaactggaaggagtcgctattgtagttgttggtctgatgcaggatcagcaccgcgattaacgatcctgcggtgatggccactccaccggcagtgctcaccggcgtcagatacaggacggccggccagggtttatcggtccgtgaatcataaatcacccgcgcggtttccgtggtggtcgggaacgggtaagaggtgccgttatatttcacggtgcctgaaaaactcgacagcacaccgccataggcggatccgcgctgcagggtcacgtagtcggtgatcgtttccggatagtcgttatggcaaaaaatctgcgtggagaggtcgaccaccaggttttgcccgacgttcaccgccggggtcaggttaacgtagacgttggctgacccgccgccgatgggaatcgtcgccccggtggccgttttgcaggcaaaagaccaggcgttcatcgaccagcccagcagcagcagggtggtgaacagggggattatttttttcatcatgatgctctcctggctcaggcgtaggtataggtgacgttaatcaccgcctgaatggtgccttgcgtggcgccgccgttgacggacagcgccctgacctgcagcgggaagcgagcggactggctggcctcatccacctgtaccgactggctgctgccattgttcagcgtggtgccgtcctcgttctgcagttcgagctgaatattgcccgccgttccctggtttttgtaatagccggtgctgtccgccgttccgctgaaggtggctttcacccgtgaagtacccacggggcagttgctcagatccagcgccacgctgtgccaggccgatgccgagcccgcaccgatcaggctaaaggtatagagatcgcccagctcgacggtggcattgacggtggaaaccgtgcagggtctggccaccaccttgccgttgacggtgagagtgacgtcggccgcccgcagggaagcgctcgcggttaacaggccggccagcagccagcccacatgagtccatttcatttcagcctccgcttactgaaattccagggtgaatgttgctgtcgcattgacatgcccggcggtgacgggcacctgagtggccatcagccgggcgtaaaagttgagaatattggtctggcccggggtcagcgtggtccaggtcatggtagatgacggcgcattgaccggcagccgggactgctgctgatcgagaatttccacccccattcctgccgccgccgaggtcccggcatcgagttttaacaggctggtgttgatgctgtccgccacgccggtgaaaccgaccttcaccgcggtgacggaagtgccgcagggcgacagcacgatgcggaacggcaccggcggcgtcgtcgccccaacggcataaaactgcttcgcggcgttatcctgtaaatcgacagtaaaatccttcgattcgccggctaccgcgcaggcgttatcgcggacatagccgctgatggcgatcgtgctatcggcggcaagcgcagccggtgcgcccagggtgaacagggcgcccagcagatactgcagtgttctcatcataatctccttagcggcacgcgaccgaaagctgactgagcgcctgctgctggctctccggcggcagacggtaatcggccacgcactgagcgtccgggccatcgccccatttcacccgcactttgcccgccagcggcatcccgctcaggtagacctggccgttgtccgcgacgatgctgccgctctggttgctgtcgccggtggcgagggcgccaaacggcaccggtttgccgcgatgggtcagcgtcagcaggatcttcatccccacctgggcgttaaagttggcgcggacaatcgccccatgggtggtccccacgctgaccaccgcatcgtcaaggtcgacattgtccgccagggtgttggtatccagcgcgatccggttttcacgatactcagtggcataaggcaggacggcatacccgcgccagtcggtgcgtaccccggtctggttttccactttcacgccgccggcgccgggggctttcaccagcaccacggtatcgtttaacggttggctcagggtgatgccgttggcgtgcgccagcacgccgccgctgaccccgtaatagagctgtttaaagccatcgctgcggctgtagccgacgttggcgttgccgtagccgccgcggtagttgagggcggtgtagcctgtgctcccgttgtcgccgttgccgccgccggcatagccggtctgcacgctatagctgaggttgttgtcttccagcagggtgccgtacaggcccgccagattggtcatgcggccattgagatcgtgcgacaggctgtagctggcgctggcgtgccgccagaccgagcggctgtcggaacgcagccagtggctgaaggggatattgatattgatcgccagcatttgatcgcgcccctgctgccaggcgttttttgtcaggctgtagcttagcgaccagttgatatcgtccacggcggcgttgaggccggcctgcagctgctcatcggcatcgtcggtgccccagtaggtctggtggctaccgctgagatagagggtggcggtgcgccccaactgctgagtcacgctcagctgcaccttgccgcgcttgctgtaagccagattgtagtagtcggtaaatttcggttttacctggataacgccgtcctgggtttccacactgtagccgctcatccggcggtaagtggtatcggcaaagttataatagccgcgggtagagtagcggtagcccaccagctgcaggttggtgccggtctcatccagggatttgttatagagaaaacgcaccgactgcccctgatgttcgctgtcgtcagccagggtggcgttggcctgagtgatatccagcgacagggcgccgaaatagcccatgtttttccccaccccaaggttaaaggcgcgatagcggtctgccagctgggtgccgccgtagagcgtccagcctgccggcaggccatgcatggccgtgccctggaaaaaatcgggcgtttcctgctgactgttgccgctgcggtactccccggcggtgagggcgaagcgggtatggccttcacgctggagaaccggcaccgttgaccagggcacgctgaagacctggcgggagccatccgcttctttgatcgtgacctgcagatcgccgccattgcccgcggcgtagagatcgtcgatggtaaatggtcccggcggcactgtgctctggtagatttcgtagccgttttgcctgattgacacctgcgccgtgccgcgggcgatcccgtggatcaccggcgcaaagcctttctggctgtccggtagcatattgtcgtcggaggccagctgggcgccgcggaagttgatcccgtcgaagacatcgccgttggtgtagctgtcccctagggtgagtcgcgaacgcagaggcgtgatgtcccgctcaagccagctgttaacgtgctgccagcgattctcgttggatgaggtgctaccgccgctgctgtagctccaggtgctgttatcgcgcagacgccaggcgccaatgttcaggccgctctgtagattcagataggcgtaacggctgctgccacctgtggtgttatgggcgttattgcccgtgaagttatagtttatcagcccggcggtgataccgttatcccacagctccggcggaatatagccgcgcgcatggttacccataaatgcctgggggacggtgaggtacaggcgctgctgtccgacgtcgaagcgcgtggtagcttcgctgataagcgtggtcagcggcacgcaggccgtgctgtccagcgtcgccatgcccggcacccgaccggtatccacacccatgctcgccagctggccgcgtgtcaggcagggggacagaccgtgaccctgggcatcggcctggaaggtgacgtcccgggtggtcataaaaccattgttgagataaatatcgacgcgataggtgcctggcggaacctcctggcctttttcaaatcccgacaggtcagccaccgccgccggatcgtcagctaaaaagcgggggttaaaatagaggtccgcccgcgcggcaaacggctgtgagcagagccacagcgccagcgccggagataccaggcgccgggcagttcggcaacctaaatgatccagtccatatttccgatgtgacattatccctccggtccgacgttgcccggctgtcattgcttctggtcatgcgcagcgtgtcccgcgcggcggggcgcttctgggttagcgcagcacgccattcattttcggcgtcagcgcgccgtaatcattaatcgtgcgataggtgatggtgttcccggcatccgcgggtagcttgacgctggttttgcccatcggcggtacgagggcgttctccagaatgcgtgtcccggcgttcagttcggtcaccgtcaggtaatagggggtggggttcgtcagcgtcagcgacgatccgctacggctaaaggtcagcttttccgccgcttgatccggaggcagggccagttttcccggacggtagtagagcttgatgcggctgataatcgccagctgcagggtattgtcgctgagctttgatttatccatcgaagggatcgccttcacgttcatccagaacagactttcccgatcctgcggcagctggttattggtggcgtcgataatgcgcagggtgttctcttttttaccctgcatggcaaacagcggaggagtgatgacaaaccggccgtctcgctgaccatctgcattttccacccatgactgaataagccaggtactgttgtcatcattattggtcaccgcgagctggacctgcttctgtcccgccgggtagataacccgggtcgcgccaagcgcaacgcccgcctgcgcgctggcgctaaagatactggcggcgaaaagcacacatcctgccagtaagccatgcgccatcgttgccgtttttctcacattatctccttgtctgctcaccgtgttgtcctgtttgtctgcggattaattactgataggtcaatgagaaccaggcctgggcattggctgcaccgccggtgacctggcgtccggtcgcccgatatttggcgacgaaatttagcgtcgtcggtccgcggtagagtgatatccagcgatccgttggacgattgagcgggagctgctggccctggctgtcgaatagcgcaataccgatcccactggcgatccccggaccttcacccaccgacagcacgtcggggttttttccatcagccacgccgtgaaaggtcacccccacatgctggctgaccgccgtactgcaatcctgtaaatgaatcgcgaaagggattgggttgctgtcttcgccgacagcatgaaatcgattactgctgatctgccccagattgaccgtcatctgccgatcgccggcttcgacgcggcaggagctcgccataatcaggccctgaaaacgcatgctgccccccggcagcgtgacgttccaatgattaccggccagcgccagcggaggcagtagcagcagcagaccagatttcattccctgcatcgtttcactccggttgaaaatagagagcgggccctcctggcccgaatagcttccctgcctgactcgggtcttactcgtactgcactttgaacgtggcatccgcgttcgctataccagccgtcgctgcgccggtcgcgtagtaacgtgcctggaacgggatgatgttggggccgtcattcagcgtggtcgcagcactgaaggtggcgccgtccagtgccagtggcgtaccggtattgtcgaggatctgcacgccgacgttggttgcgctgccggcggcagagttttgcagggccagaacggtggtattgctgctgtcgatggccgtaccggcgaaggcgacggacgctttggtggctaccgtagtgtcgcaatcatccagctggatgttgaaaccgacggccgaactggtgctccccgccgtggccagtttcgcggaacgcacctggcctaactgaacggtttgatcgatagagccggcatccaccgcacaggccgcattaacgacttctcctttaaaatgcacggtcccgccgttgaccgtggtggtatcggccagagctgccgtggagctcagtgacagggctgacacaacaatcattgccagtgttttgattttcatactgttttcctttgaacgatgtcgaaataacgaaccggattggcagccgttgtgccttccaggcatttcagatttcagccgagtggtccggctgccggctctgcacagttttcgcccaaccgatgagacaattggggccattttgactcgttgggataaatgatctgtattttgtgtcaattgggtattctgtggttttaaattctgccaaatttggtttttatggtaatataatctggtgtggtgggagggggtgcgaaaggaaaagcgatggcgttggcgacggatcgccggtgcagcagagatatggttagagaaaattgagtaattgcaggtttaaaaatagataataatcaattagatatgattttttttgcggaaatatggcgcagtgagttgcaaaatatgtcaaaacatttttatgatataaacagtttggccccaattgacctgttcgttatttttttaattatttaaaatcaatcagttatttcatttttcgtcttctggtctttttcctctaaaagattatttctttcccagatgccagcgaaacgtgccgcattactggcggtgtaacgtactgtatgacgaatattgcgatgtcctagataatcctgtatcaaacgcgtatctgtccctctttcagccagttcatagccgcaggcgtgacgcagcatatgggggtgagtgtgcgtgacggtacccgcattttccccggcggagcgaataatacgatacgcctgctggcgggagagcgcggtgccgcggcgggagataaacagtgcgtccgttttgtccgccgctttccagccggcacggaccaggctccagcgctcaatcgcctcgcgctcatcaaaacgcagtggatgaatcgtcgaaaaaccattctttaatcgccgcacattaacccgcccttcatggagatccagatcgtgataatgcagatccagcagttcgctaatgcgcatgccatggcgaaaggccagcagaatgaggcagtagtcccgttcgccggtagggccctgacgagcagcctgcatcatggcctgaacttctttggcggttagaaaacgacgtcggttcacaatagttgctcctgaaaataggtatgaatgaccgtcacagcgaaaccatacgccatgacgaaataggttctgtaatgctaaaacggtacagggtgaagatgattaatcatgaattgataacatattacattgccagacactaaaaatatcgtcgggtgataattcttaattttaaagattttaatcatcggctcaatagtatctgtgcgggttgccgccaggtatataaaatgaaaggatatttttcactaccagccgttattaaaaacacagccgcggaaattttttcccaccaataaatacccagtcttattcctgagtaaacgcagggttatattaactctcagtcataaggattaaataagaacttgtgggaacagtaatcctaattaacgcagggttaataatcatgaatattttaatttgtcgaccgctcgcgatacaacgccatccatggcgtcaaggctattggatcagcgacgatcgctgtttgtcacggggattgtcccagatgccatagaagcgtcccgcattgctggcggtataccagacggtgtggcggatattgcgatgcccgagataatcctgaatcaagcgggtatcgatccccatattcgccaacgcaaagccacaggagtgccgcagcatgtgcgggtggatctccagtggcagccccgccagtccccctgaggacgcgataatctgataaaactgttggcgggaaaggggattacctttgcgggagagaaacagccattcgctggcggcctgcggccagctgctgcgaatggccagccagcgctttagggcgtagatctctttatccagcaacgggtgggtagtcgaaaacccttttttaagccgatggatgtaaacacatcgggcagcaaggtcgatatccgatattcgtagacgacagatctcgctggcgcgcagaccatggatgaagcacagtaacgtcaggcaataattacgtgcagcataaggaccggtatcggccgctttaagtaaagactcaatttcattctgagtcaggaagttccttttttttatgtcggcgttattcgtcatggttttcccttttattgcaggcatatttttggttttccgagcctgcgtcaggtcattgttaaatttgactgcctttttattttgaaacagcgtggtgataacgttttaatttgctacgagcgcgagcggtatcatgggctagctccattgctaacgataagaggccgcgatctgaagggtaaagaaagggtgagctggctgaactgatgaatctttcctgggggtttccacgtcctgtacatccctgatcctcttgatgatacccgcatgatgatgaaggcttgggcttccggccacggcaaggcggctatcaatgccgtcatgattgattgcctgtttactgggcaatgtcaccccagtaaaccagcctccctcgccgacaaccttcgggaatggcatgagaaatttctcagacaaaatacaaccttaagtcgtctggatagcattcactgcaaaactacaacagtgattaaaccatactgcaaaaagcctggtgataatagcattgtctgtaatagagcacattacgccgtatttcaacgggtaagcttaatctggtacatgcggttgaatgagatgaaaactcgtcacggtcaacgtatacaggaagatatcaatgggaggtatagaggacaggtaagtattgcgacacggtctggcggcgggttggaatgctcgcttcggcgcgggaaggactcacatccaggatacgccgaagcctgccggttcaccacttttcgtcacgtgcctcctggcgcttgtcgctgcgccaggtggcctgtacggaaagcgatggcagcagtaaccagggtaagtaagcctcttttcatggaagtgatcctgctgaagagtacaataaatagcagttaaagaatattcttgccggaagcgcagcataataactgacaaaaaatgctcgccaagaaataacttatttatttttatctgtgattttttgagtaattattcctgttaaaaggtattggtaaccaataacgcataaaaagatatagctgtggtatgctcaagatattgaggcattctgcgctaatacggtgtcgggaagatagcgatcggtagataatgcggagcctggtgactacgtacaatcccgtgaacagcttcgacaaattcctcacccttaagcgctgacaccttcgctcgcctgtcgtaaagttgctgtcaggcggtttacgtttactacaatggtataacgatgacgactccgattgcgctccgcgactggcgcctgctggcggccgggtgcggcggccttctactgctggccgccgctatcaccttgcacagccactggggtgactttctccagtggtgtctcgccacccaaattaccctgcatcgctatctggtgatgtaccttctgttgctgaataaccatcagtacagcggcggtatctggctgctggtgggggcctttctctatggcgtgctgcacgccgtcggaccgggacacggtaaatttatcgtgacgacctacctgagcaccaatcaggagagcctgacggcggcgcgggtggtgccctttctcggcagcctgttgcagggcgtcactgcgatactcttcgtctttattcttgcggtggggctgaatctggccgccggcgatcttagcgccagccgctggtacgtcgagaagatcagcgccctgaccatcggcgtctttggggcttatgttatctttcgcgctctgcaaagcctgtggccggcaaaacaggtgattcgccgtctgacgccagcgcatcagcatgacgcctcgtgcggctgcggccatcacggcgtggggcaggatctgcagggcgctgactggaagacgcgccttggcgtggtgctggctatcggcgttcggccctgtagcggggcgatcatgattttattattcgccaacgcgttggggattgttagctggggcatcgccgcggtgatgagcatggcgctgggcaccgcgctctcgatcctcggtctgtcgctactggttcactatgcgcgccatcggacggtcaaacgattggccacgaatcaccgcccgcggccctggctggttccgctgatgaagatcctcggcggtctggcgctgatcctctttgccgtgggattgtttttcagcgtggtgccgatcagcgccaacggcgactttatcgccgctggctgttagcccgtttccagcagtcgcatcaacacccgcagcgcctgatccaactgctggcgttcaccgtcactgagtcctgccagcagttgccgttcgttgtcgacgtgggtttccactgcggcatcgatccgttcgcgtccggcaggggtcagggcgaccagcatactgcgggcatcctccggattgggcaggcgggtaataaacccgcgtttctccagcgccttcagacgatgggtcatggtgccggaggtaatcatcagcgtggagaagagctgggtgggcgaaagtacgaaaggcgccccggcgcgccgcagcgtcgccagcatgtcaaactcccagcgcaccagatcgtggcgcgtaaaggccacttccacctgcggctccagcagcatagcgcatcgtttcaggcgacctatcggccccatggggctgcagtcgaggtctggccgctcccgctgccactgggcgaggatgcgatccacggcgtcgatcggcggtgatttgtccattagtgctcacttgtcttgatatcaagatacttggcggtacatacttcactcactaatttaccttgaagtgaagataaaatcatggcttttctctcacgtaatctgattctcgacctgctgctcaccgcgctggcgcccgctatctgggggacgacctacatcgtcacctcccagcttcttcctcctgaccgcccatttattgctgcgctgctgagggtgctgccggcaggtatcgccctgctgatctggagccgtcgttttccgcagcgcggcgaatgggcaaagctgatcgttaccggcatcttaaatatcggcgcgtttcaggcgctgttgtttatcgccgcctatcgcttacccggcgggctggcggcggtgatcggcgcgatccagccgctgctggtgatgctcctcgcctggtgcgtcgaccggcagcgctcgccctggctggcggtgttctccgccatcgccggcatactcggtatggccatgctgctgctgtcgccgcacaccgtcctcgccccgctgggcatcggcgcggcgtttctcggggcgatcagtatggcgctgggcacctggctctcccggcgctgggcgctctccctgccgatcgtcgcgctgaccggctggcagctgacgatcggtggagtggtgctgaccccggtggcgctgatcgttgaccctcctttgcatcaggtaacagtgctgcaggcggccggctatctgtggctgtgcctggcgggcgccatgctggcctatggcctgtggtttcgggggattggccgcctctcaccggtggccgtgtcggcgatgagtctgctgagcccggtgaccgccgtggtactgggatggatattcctcggacaaaagatccaggggatggcgctgatgggattgatcgtggtgctggcgagcgtgatgtctatccagcgcgcgctggcgcgtcaggcggcgggagcaaaaacgaaaaaagccccgtaacggggctcgacattgctgcgtgcggggtgagcggcgggagccagaccagccacccgcaggcggcctgtccggcagctccctctgcaaccattcgcttatttagacagctcggcggtcatatggacctggttgccggtataggcttcggtgatgtggtaggaagcgccttgttctttcgcaatggttgcgattttcgcttctgcgctgtccagggtgtctgctgtcacgctcaccggatgagcgaagctagcgaaagagaccagggagagcataccggcagcggcgagtaattttacgtttttcatggtgtttgtccttttaacttttatggtggaaagcatgtttgctttcgatggacttataataagtctgctaactataacgcgcgtggcaaaaagtgcgatttagatcacatttttatggcggtttgatggcgtaaacatgatcgtttatctattttttaatttaaaaacaatgaattaatgatttacttctgaaaggggggatcacatgggctgcccttgttcagggagaggaatgcgcctcattcatgctttcatcattcgttgtgtgaattgtttggtgctgttttcaccaccgcaaaggcagattcagacttatcgcgatggccttccgagggctttttctgcatgctgttgcggtcactgtctctcgctctggcgttaggcttgctgcgctgtaaacaaccaccctcgcgttttcatctatcaatgactgtttattaatagccgatggttatctgttatataacttaatgaaacgtgaacaaatgtatatttgtcggcgaataaatagcattctttgacgccgatagcaccagcgaacttatatttttaggttcgttacctgacgccttaaatattgcggctcccggtcagtcgaagattctattagcagtggcataaatcagcatcgcctgatgtttctggttctatgcgaattcacagtgtgctcattgattcgtaattcactctgacaaggaaatggcaatgaaaaaggttcttctctctgcagcaatggcaaccgcgttttttggcatgactgctgcccatgcagctgataccaatgttggcggcggccaggttaatttcttcggtaaagttaccgatgtatcctgtactgtttccgttaacggccagggcagcgatgcgaacgtttacctgtctccggtaaccctgactgaagttaaagcggcagcagcggatacttacctgaaaccgaaatctttcaccattgacgtctctaactgccaggctgctgatggcactaaacaggatgacgtaagcaaactgggcgtgaactggaccggcggtaacctgctggctggcgcaaccagcaaacaacagggctacctggcgaacaccgaagcttccggtgctcagaacatccagctggtgctgtctactgacaacgctaccgcgctgaccaacaaaatcatcccgggtgacagcactcagccgaaagcgaaaggcgacgcttccgctgtagctgatggcgcgcgtttcacctactacgtaggctacgccaccagcgcgccgaccacggtaaccaccggtgtggttaacagctacgcgacttacgaaattacttaccagtaattccgtcagaaaataaaactgccccgcgatggggcagttaataacaataataaagcggcaatgtccgccgcttgtatttttattctgaggtcagcatgaagcgtattgccctttttttctgtttcatttttagttttgcggcccatgccaacaatattattgttaacggtacccgctttatttatccaggaaatgaaaaagaaataacggtacagctttcaaataacgccgaccgtccggcgctggcgcaggcctggctggataacggcgatgccgatgccacaccggataccattaccaccccgtttattatcaccccgccgatttcgcgcgttgacgccaagagcggccagacgctgcgtattaagctcggtagcagcgccggtctggcgaaagataaagagacgctgtggtggctgaatctgctggaaattccgccagtggtggccaatcagaaaaatgaaggccagaacgtgctgcagctggcgatccgttcgcgctttaaatttatttatcgtcctgccggactgggcaaccgcgatgcggcggccgagaagctgaccctgaccgccagcggcagtagtctcgccatcaacaacccgacgccgttctacattaccgtcagccgtatttcccgcgacggcggtaaagccctgaacagcaaaaccgtgatgctggcgccgcagtccagccagacggtggcgctctcctccgccgtcaaccgcggcgaaaccctgaccgttaacaacattaatgactatggcgccgatgtcgcagtgaaagtggccgttaaataagggaaaagctaatgaagcagaggtcattctgcccgggaagattaagcaccgcgatcgccatcgcgctgtgctgctttccgccattttccagcggacaggaaaacccgggaacggtatatcagtttaacgacggctttattgtcggcagtcgcgaaaaggtcgatctgtcgcgcttttcgaccagcgcgattaccgaaggcacttactcccttgacgtctacaccaacgacgagtggaaagggcgctacgatttacgcatcgcgcgcgataaagatggtcggctgggcgtctgctacaccaaagcgatgctggcccaatatggcatcgcggcggaaaagctcaatccgcagctgagcgagcaggagggctactgcggtagcctcaaatcctggcgcaacgaagaaaacgtcaaagacaacctggtccagtcctccctgcggttgaacatttcggtaccgcagatctatgaagatcaacgcctgaaaaactatgtcagcccggagttctgggacaaaggtattaccgcgctcaatcttggctggatggcgaacgcctggaacagccatacctcttcggtaggcgggtcggataacagcagcgcctatctgggcgtcaacgccggtctgtcgtgggacggctggctgctgaagcacatcggcaacctgaactggcagcagcagcagggtaaagcgcactggaacagcaaccagacctatctccagcgccctatcccacagctcaactccatcgtcagcggcgggcagattttcaccaatggtgaatttttcgacaccatcggtctgcgcggggttaatctttccaccgatgacaatatgttcccggacggcatgcgctcgtatgctccggaaattcgcggcgtggcgcagagcaacgccctcgtcaccgtgcgccagggcagcaatattatctatcagaccaccgttccgcccggaccatttaccctgcaggatgtctatccttccggctatggcagcgatcttgaggtctcggtgaaagaagcggatggctcggtagaagtgtttagcgtgccttacgcttccgtcgcccagctgctgcgtccgggaatgacccgctacgcgctctccgccggtaaagtggacgacagcgcgctgcgcaacaagccgatgctctatcaggcgacctggcagcacgggatcaacaatctgttgaccggctacaccggggtcaccggttttgacgactatcaggccttcctggtggggacagggatgaacaccggcatcggcgcgctctcttttgacgtcacccattcgcggttgaagagcgatgcccatgatgactcgggtcagagctatcgcgcgacctttaaccgcatgtttaccgatacccagaccagcatcgtgttggcggcgtatcgctactcgacgaaaggttattacaacctcaacgacgcgctgtacgccgtcgatcaggaaaaaaatagtcgcagcaactacaccctgtggcggcaaaaaaacggcatgaccttcacggtgaaccagaacctgccggacggctggggcgggttttatctcagcggccgtatctccgattactggaaccgctccgggaccgagaagcagtatcaggtcagctacaacaattcatttggtcgtctctcctggtcggcgagcgcgcagcgcgtctatacgccagacagctccggtcatcgtcgcgacgatcgtatttcactcaacttcagctacccgctgtggtttggcgataaccgcaccgccaacctgacgtcgaacacctcgttcaataactcgcgctttgccagctcgcagattggtatcaacggttcgctggacagtgaaaacaaccttaactacggcgtgtcgaccaccaccgccaccggcggtcagcatgatgtggcgctcaacggcagctaccgtacgccatggaccaccctcaacggcagctacagccagggcgaaggctatcgtcagagcggcattggcgccagcgggacgatgatcgcccacagcggcggcgtggtgctctcaccggaaagcggctcgacgatggccctgattgaagccaaagacgcggccggggcgatgcttccgggatcgccgggcacccgtgtggacagcaatggttacgccatcctgccgtatctgcgcccgtaccggattaacgccgtggaaatcgacccgaaaggcagccatgacgacgtggccttcgatcgcaccgtggcgcaggttgtgccgtgggaaggcagcgtggttaaggtcgcgttcggcactaaggtgcagaacaacctcaccctgcaggcgcgccaggcgaaccacgagccgttgccgtttgcggcaagtattttctcccccgacggcaaggagatcggcgttgtcggccagggcagcatgatgtttatcagcgatgcgaacgccaaacgcgcgattgtgaagtggagcggcgggcagtgttcggtggatctgggacagcaaacaacaaaggatagcgtatgtcgctgaggaaattactaacgctttttatcgtcttaatggcgctgggaaccacctcgtcctgggcctcctgtacgcgtctctcatcgccaacggtgatgctggacatggtggtgggcagggtggtggtgcccccggatctgccggtgggctcggtgatccttacccgcgactggacgatgagcgctcccggcggggcaagctatcgctgtacttccggcaccaaccgctttgcggcgaagatcgtgtcgccaggggccacggaccttggaaataaaatctactccaccaacgtgccgggaatcggcatgcgtttcagccgcggcggcgcaacggtaaatatcgtctatcccgacgtcttttcgtcccgggtatataacaccaccaactattccctcgaagggtcgcgctttacgctggagattatcaaaaccgcggcaaccaccggcagcggcaccctggcggcgggtaagtacacctcctacgactgggagagcggcggtaacccgatcctcgaaacctatctgagcgccaacgccatcaccgtggtctcgccctcctgttcagtgctgagcgggaaaaatatgaatgtcgatgtgggttccatccggcgcaccgacctgaaaggggtcggcaccaccgccggcgggaaggattttaatatcgacctgcagtgcagcggcggcctgagtgaaacgggatatgccaacattagcacctcgttctccggtaccctggccaccagcactaccgccaccatgggcgccttgctgaatgaaaaagccggcagcgggatggcgaaaggcattggcatccaggtgctgaaggatggctccccgctgcagtttaataagaaatacaccgtcggccgcttgaataatcaggagacccgctacatcaccataccgctgcacgcgcgtttttatcagtatggcccgacgaccagcaccggcgaggtggagtcgcatatgatctttaacctgacgtacgattaatacgggagggggaatgaagggattgccgaaaaacactatcgcgtggctgctattttgcggcagcctcgccgccccctcggcgtggggttttgagaccaattacgatcgcggacgggtcgattttgccgggcgggtgacggatatttcctgtagcgtcgcgctaaacggcggccagcatgccggcagcggtaatgtctggctggcgccggtcagcctggcggaagtccacgatcgcggggccggggcgtttatgaaaccgcagccgtttaccctggcactgtcaaactgccagctgcgccatgatggtggggcagcctcgcaggatgaggtgcgtcgggtcagcgtgcgctgggtcgatggttttttactgacggcggtcggtaacgaaaatgccgggtatctggccaataccttgccggatggagcgcagaatatttatctggccctatcgactaacgataataatactctggataagagtaataaaattgtcccggcggacccgcagcaaaatcaggtgcgtttgcaggaaagcgcggtcagcggcggcctgttcacctattacgttggctatgtttcgccaacgccgaaaagcgccaccagcgggccgattaccagctgggcaacgtgggaattagtttataattaagtgacgttaaaaagccgggaattcccggctttttttacatggcaatatcatcggcgaccagttgttcaatactgacttcccgccagtaatgtccctggatagcaaaccactccattccctgcagccattctttatgggcttcgctttccacaccttcaataatcacattatgatggttgcgcgataaaaaggtcaccagcgcatccatcagctggcggccggactctttgcgcatcaggtgccagaaaaaatccttatcaattttcacatagtcaaagtgataaccgcgaatagcgttaattcccgcgtagccggagccgaagtcgtcgagccacagtgaggtatcctgtgggctctgccaggcggcaagagaattatgcagcagattctcggcgttttcggttacctcgaaatggacgcaggtcagggcggcgactttggcttttatatccttctggcgcaacaggttcaggatatggtcatcaacgttaattgttgcggaaatatggttacgtaaaaaccaggctttatgcttttcaatcagtgccagttgttcgagaaaaatacgttcacgaacggcggcggtagcatggcggaaaaaatcttcgggggaaatagaaagattatcaaagcggcttaagcattccaccgcgaccagagtaccttgtggggaaaacattttctgaaagacgtagcgtacagcgatatcattacgagataaaatgttgtcttcgaatattttagtgttcattatccctcttcacgaggttagtcagacaataggcagaggatacattaattataggctacctgatgattaatgggaatggcgggaaatgtaaatcaacagcgaataagtacgctttatccgctactgatttaccgggagaacatttagcattgatggagagcggcaatacgctgattcatagtgcgggaattatcaatacccagtttttgcatgatatggatgcggtggctatgaaccgttttatgagcaatgccgagcagggcggcaatacgcttattattattgttggcaatgagcagttcgaggatctgacactcccgtggtgaaagctgtttgcgcaatcctcgcggcggcagttcgctgacgcctttggcgcgctggacgatagatgaaaaaagagttagcggagatttctcgctaataatcatagcgttgtcaaagtttatcaactctctgcacagcccgacaatgtcgcttttcaccattagcaccggctgctggcagcgcagcagggaaaggcggagcgcattcagcagatcgacgattctgatggcagaaatatccttattaattaaattgaaaataatcgtctgggccagtggcagatgtttctcatggatgacatcggcataactcagacgggtggcattttcatggctatcaataaggtagtgatagattgagtgaccaatgagattgtcattggtgtacagcaatatactgtccaaggttgtcagattctctttttgcgcttggcttctaagatcaggtccagcagtatcttctctattctgcgctggtcatcgagatggcggaacttaaactggcaggatatctgatagtagctctcactctcttcattagcgttatccagggtgataacaatgacatttttgaccaccaggtcgatggtgatctcgccatattctgcaagcataagtacggcgtttttcagtaaggcgttgtggctgagaaatttaagattcggcgttttggtcatcaatgcgcaaccgccatctgaaatgtctttgatatcgaaaagatagttttcgccgtttttatggcggccgcggcaataaaagtcatgctcatggcgtaaacgaaagcggggatcgcggcgacgctgcactacctgcaggcattcaggcaatgaaaaagcgtagcggatacctttatcgacaccgctattgtcatgttttgtcagggccgcattaaactctattttccctgaatcgctatgcaggagaaagcgaattttatgcccggacgggattttgcgatgggtctgaatatgaaactcggcaaagtccacgcgcgtcagttgggttatgatactggtgttgttaaaaaatatttcaatttcagtacgtttgcgcaactcctctctgaaaatagcaataatttcatacttactggtctttatcgttccctctgtcatatgcatcccttgtaaatagttgtcgtgaggcgtttgatttttcttatagcaatagcaacattctgattgggttaatcagatgtttttatgagcgtttgatgttattgactatctttgcagccagattgatatgtataaacttggaatttgatattgtatttcctgtaatcaagagtttcgaattttggtcatgacaaaaacgacaacggcctccaagctggagaccggtcgaaggataaaaacttaagtttaattaacggggataatgagagaacgatcgtcgatcacgccccatttgtaggatctatagtgccagtagcggtgaggtttttccaggcaaatattgaggagggatagggttccctccattttgtctggcaggtcagcggcgcgcggcggtggcgatattatcgagggtacgcagcgcttccgcgggcaggaccagctcagcagcggcaatattttctgcgaggtgcgtgcgggaggaggtgccggggatcagcagaatatttggcgctcgctggagcagccaggcgagggcgacctgcatcggcgtcgcctcaagcgaagccgcgacctcgttcaactcctgcgcctgcaacggcgtaaaaccgcccagcgggaaaaagggcacccaggcgatgtgctgggcggccagcgcatccaccagcgcgtcgtcggcgcgatgggcaacgttataaaggttttgcacgcagacgatgggcgtcattttctgcgcatccgcgacctgctttgccgtcacgttgctgaggccgatatggcggattaatcctcgctctttcagttccagcagggtggcgagtggcgcctccagcgaaccctccaccgggccgtgcgggctcagcatactgcgcagattaaccacttccagtacctcaagccccaggtgacgcaaattgtcttcaacggcctgggtcagttcggcgggcgacatggccggtagccagttgcctttctcgtcacggcgggcgctgaccttggtgacaatgcacagatcgtcagggtaggggtggagcgctttgcggatcaactgattggtgacatgtggaccgtagaaatcagaggtatcgatatggtttatcccggcctcgacggcggcctgtagtacgcgcaccgcttcttcaggatctttgggcgggccgaaaacaccggggccggccagttgcatcgcgccgtaacctaagcgatagacctggcgatcgccgagcgtgccgcgaccggataaggtgacactggacataagaactctcctcacggtggctaagccgtaagtgtaatccgctcacaaggaaggcaagggggagaatattgtcagaatgtgcgacagcagctcaggcagccgctgtcgccagaggggattagccgaagaacatcaccgacacgcagagcaggccaaccaccagcgtaatggcgttacccaccgagcggtacggcttcagcgccggaatgagccatgtcgacagcgtgggcatgataaacaggatcatggcgataagcggtccgctgatagcgtagatcattgagatcgcattcgggttgataaagcacaccgcaaaagtgaaggcggagaccagcaggatcgacatcgcgcggttgaaagcgcggctcttacgcacgcccagcaggcccagcgagcttttgacgatttcgctggcgccctcaatcactccgaagtaggttccgagaaacgacttcgacatagcgacgacggcgacgatgatgccggtcaccgccagccatcccggcgcgcctggctccatcgacagggcggagaggatagtcaccccctgatcgcgggcggtctctatataggttgccgggatcgccagcagacaactgaagacaaaaaacagcacgctggcgcagatgatggtgtaggccaccttcatgatttttttgcatttacccatggccaggtcgccgtgtttctcctgctgatcgatagcaaaagtcgagatgatcggcgtatggctaaaagcgaaaaccatcacgggaatagagatccagacctggtggagcgtctgcgggctgaactgcatctggctggtgagatgctccggatgccagtcgcggattaaatagagggagagaaacaggaaacaggcgataagcgggaagaccagaaagcccatcaccttgatggtgacctgccgtcccatgagaaagatcaggttgaggaccagcacgacccccagactcagcagcgcacgcagccctggggtcatcggcgtgcgatgcgccacctgttcggccagcgagttggtgatggccacggcgtagatgagcaccaccacaaagaaggcaaggaaatagaggccggtgatcaggttgccaattttcttaccatagtagtgattaactgcgccggtgatcccggttcccggcgcgatattggccgagagaataaactggctcagcgctttgtggggccagtaagtgagcggccaggcgaccagcgcggtgatgaacagcacaatggcgccagccgaacccagctggatcggtagaaatagcgtcccagcgcctactgcagtgccatataaggcaaaactccatagagtttcttctttagaccaaattttagacattatgcgactttatcaaccgtcaaaccaaaaaaaaggagtgcaatttaccatatttatggttcgtctgttgcgatagtttttggtgataaagtcgcggcggatcgtcgaagatccgcgccgggattaaccgcgcgccgtctggcgcgggcggcggtgacgaataacgcgctcgcgcagggtgtcccatatccagttaaaggccatggtgtagggcaggaagaaaagcataaaaccgatctccagcataaacgcctgcagcagcgagacgcccagcacgatcgccaccatagtgacgccaatgatgacgaatccggtttcgaaaccgagcgcgtgcagggcgcgtactttcagctggcgggggaagcgggagaccggccacaggcgatcgaacgccgcgttatagataatgttccataccatcgccagggtggcgagcagaatgctcagtccgcccatctccactaccgagcgctgcatcagccaggcggcggtaggggcgaggatcagcgtcgccagtccttcgaaggtgatggcgtggataacgcgttcggtgagcgtcttgcgctgatgtggggtctgttgcatggcgagctacctccagttttagcctgaacaggaaattacccggcagtttatggaaaaatatgataaacaaaagataggacccatcgatattgtagatacatcatgcgttattcaccggaagccttaaccgcctttgtcgaggcggtcgacagcggatcgttctccgccgccgcccgccgcctgcggaaaagtcagtcgacgatcagtaccgccatcgccaatctggaggccgatctcggcgtaatcctctttgacagggcaacgcggcaaccgacgctgaccccgcagggggagcaggtgctgagctatgtcaaagcgattcttgccgccagcgagcggctggacgaactggctgtgtcgctgtccggcgagacggagccgcggctgaccttcgtgctctccgatactctgcacccggacgtgctggaagatctgctggtacagtttgaccgccgctttcctcataccgagtttgagtgtttgattggcgaagacgaggatgtgatcgatctcctgcaaaaatcccgcgcccaggtggggctgattgaggcgagggagcgctaccccaccgatatcggcagcacccgcctgccgctgcagacggcgatgggcatttatgtagcccctggccatccgctggcggcgcagggtaaggtcgcctgggatgagctgcgcagctggcgcgagctgcgtttgagcacctttctggccagcgccaccgaacctgccgcaggccaggtctggtcggcgccaaactacctgctgctgctcagcatggcggcgcaggggttcggctggtgcattctgcccagcgcgctggtggcggagtttgcgccgcagggcgggctggtggcgctcgatatccccggctggccgcgggcgatttcagtcgatctgctgtggaataagaaagcgccgccgggagcggccggcagctggctgcgtcagcatctgcagcggcgtgaacgttaacgaatagctatttctttgtgattggcttcactttttttaaacaattacaaagttttttgataacaattatctagtatatcgctgtttctttgcgcaaatgcatgggcaggggtagaggatgaaggatgtcgtgatcgtcggcgcgctgcgaacgccgattggctgctttcagggcgcattatcgcgccattcagccgtcgagctggggagcgtggtggtgaaggcgctggtggagaagacgggaatcgatccgcacagcgtggatgaggtgatcctcggccaggtactgaccgcggggaccggacaaaatccggcgcgtcagtccgctattcgcggtgggctgcctaacaccgtatcggctatcaccattaacgatgtctgcggttccggcctgaaggctctgcacctcgctacccaggcgatccagtgcggggaagcggacgtggtgatcgctggcggccaggagaatatgagccgcgctccgcatgtgcttaccgacagccgcaccggcgcccagctgggcaacagccagctgattgacagtctggtgcatgatgggctgtgggatgctttcaacgattatcatatgggcgtcacggcggaaaacctggcccgggaatttggcatcagtcgcgagctgcaggacgcctgggcgctcagctcacagcataaggcgcgcaaggcgattgattccggtcgctttcgcgatgagatcgtcccggttgtcaccgagcataacggcgcggcgcgcaccgtggataccgatgaacaaccgcgggtggatgccagcgcggaagggctggccagcctgcagcccaccttcgatcgccttggatcggtaaccgccggcaacgcctcaagcatcaatgacggcgcggcggcggtaatgatgatgagcgaggctaaagcgctggagctggggctgccgatccttgcgcggatccgcgccttcgccagcgtcggcgtcgatccggcgctgatgggcattgccccggtgcatgccacccgtcgctgtctggagcgggccggctggcggctggacgacgtcgatctgatcgaagccaatgaggcctttgccgctcaggcgatctcggttggccgggtactggagtgggatgagcgccgggtcaacgtcaacggcggcgcgatcgccctcggccaccccatcggcgcctccggctgccggattctggtgtcgctggtgcatgaaatgatcaagcgcgatgcccgcaaaggtctggcgacgctgtgcattggcggcggtcagggcgtggcgctggcggtagaacgcgcatagcgctatacctcgatttccatggcctcctgcgggaggccttttttatgcgccgtgctttgccgaccccttattttttcccctccctctttcactctccccggcgaaattattgagcttcgtcacgtcttgttgtgccaccttttttgaaacaaataactacgatcctggtcactaaaactatggtgtctaaaaaataaaatgatgtttcataaaaacgaaatgtcattttatttattgtaagggtaccctatgttaaaacgctctctggttctcgccgccctctgcggtatgtcttttgcagcaaccgcggtaacgatagatttacgtcatgaatttattgatggcggaaagagtgataaaagtaatgctgaccgcgtctccgtttctcaccgctttgccaacggcttaggctttaccgtcgaggccaaatggcgttcgggtggcgacaacggttcgcaaccctattcggacgtggtgggcaatggtcatgaagacaccatcagctggcgctggaaagcgacgtcgaactttttcctcacccccgggtttaccattgagagcaacgacagccgctccatctacaagccgcacctgcacgcgcagtacagcttcgacaacggcttctatgtcgccgctcgctatcgctatgaatacacccgctatccgaacaacgccggcaaagatgatgacaaagttaaccgcggcgacgcgtgggccggatttgtcctcggcgactggcgtacagagctgaactatgtctatgcccgcagctcggaaggggtcagccgcaacgacaataaaccctactcgcaggaatataacgtgaaggtggcctataagctggataataactggtcgccgtatggtgaaattggcaacgtcggggtgaacgaccgcagcgatcgtcagacccgcttccgcgttggggtggcctactcgttctgaccgaccattcatccctcatcgtttgttttccccggcgccgtcagccggggtttttttatgggggaaagagaagggacaaaaaagccctccgcgaaggagggcaaggccagttacagaaaaaagtgtggtgtggatcaggcgctcagcattgacgggtgcgcgggtaatttcgcgatatagatggccggtttaccgtctttatcggagctgaacagaatggcgctatcgtccggggtaaatgaggggtgcgggtgcgttacctggcggctgttggccaccgtcgcccacgaggtatcatggcgcgcgacgcggaagtagcgcttttccgccacgttaaagacatacagccagggatcgttatcaatggagtagccgccggtatccttgacatccaccggtgtacctgagccatcgcctaccagcagcgtgccatcgaaattgctcatcagatgcgagcaggccggcatcgtcatcagggcctcgttgacgccgctttcgggatcaaagcgatagatcgtccgcccctgctggcctttcagataggagacgtagatcagcgccgaaccgtccggcacccaaaattcatgagtacagctttcgcctggagcatgcgctttgactttgcgaacatggctgccatcctcgttgaccagccacatgcgggcgtccaccagatcgtgcggcccttcatggcagaaggcgacggtatggtcgtcgaagggacgatagatcgggtgtcccagccagattttttcctcatggatcacctggctctcaccgctgcgcaggtcgacgcgcagcaggcggcagtgcggtcctttatggaagaaatcatggaaaatctgccagtcgttgagtggcgtccagtcgcttttggcaatctcaatgcccaccagtttgctgcaatcgctgtttgccacccaggtgccataccctacccagtcatcgctaacgcgataaacttcgcgctcggcgagggtggtcaggttgacttccagcaggatacggtcatttttcacgtaataaagcgacttatcgtccggggagaggaagccgccgaaggtgttatccccggcgccttcggttagctggacggcctcggcgctggcgatattcagcagatagtagttccagtggccgtcaaactcgccggcgaacagtaaatggctgccatcgttaaaaaagcacttctgatagaagtagttgcgatgacaggtgacctccgggggggttaagcgggtgacttccgccccggtatccggatcgtggctgacgtgataattcagtttgacccgcatgcctttagccatgtagtgctcctttctttcctgcgatgccgctggaccagaggcgtgtcgctgagtgatatgttttaaaagacgggtattaatttatcaaaacatcgtttcattatttgtgatggctcacgcagttcagcgtaattcccgcgttttcagcgggctgctggcttcgcttcggcacctctgcagacaatcggttgaatcttcatcttttcaaaaccttttccggcctggcgcgtgccgggaggctccttcgctttttctttttttgtaatcgtcatcataaaaaatgaaacatcgttttaaataatattgaaaatggctgggggcggggctaagatggcacccatcagcaaaacggaactctgttttaatttcattatggtgggctatgcccgagagttcgccccacgctcagtcgcgccgccggcgcggaccgggccgagagaaccttgcctgcaaacagcaggctctgaacgactaaggaacataatatgattcttgatgcattctccctgcagggaaaagtggccgtcgtgagcggatgcgataccggtttaggtcaggggatggccctcgggctggcggaagcgggctgcgatattgtcggtatcaatatcgtcgaaccggtggagactatcgagcgggtaaccgcgctgggacgccgttttctcagcctgaccgccgacctgcgccagatcgacggtattcctcagcttctggagcgggcggtggcggagttcggccatattgatattctggtcaacaatgccggcctgattcgccgcgaggacgcgctggcgttcagcgaaaaagactgggacgacgtgatgaacctcaacatcaagagcgtattttttatgtcccaggcggcggcgaaacactttatcgcccagggcagcggcgggaagatcattaacatcgcctccatgctgtcgttccagggggggatccgcgtgccgtcgtataccgcatccaaaagcgcggtgatgggcgtcacccgcctgttggccaacgagtgggccaaacacaacatcaacgtcaacgccatcgccccggggtatatggcgaccaacaacacccagcagctgcgcgccgacgagcagcgtagcagcgaaatcctcgatcgcattcccgccgggcgctgggggctaccggccgatctgatggggccagtcgtgttccttgcctcctcagcctccgattacatcaatggctacacggtggcggtggacggcggctggctggcgcgctaaccgtccgcgatggccggggtctgtggtatcgctccggccttctgagcaattattgtccatacgcaaaagtgcggatcgtccatactcctgaacacaggtataatgttaccgctctgtataaacagggttattaactattggaaacgcattttttgttactttgaaagtttaatgtccatcacaaaacccatcctgccagcaatatagtccatatctttggcttatcctgcctgacccattcatccaccagtcacgtactttcgtcttatgtcttactctgtgtggcaggaaaaaaatgacttcaatcagtaacgactctacattatcgccgcggacgcaacgtgatacccggcggatgaactggtttgtttccatcgccgcggcggtggcgggcttgctttttggcctggatatcggcgtgatatccggagcgttgccctttataaccgaccatttcaccttatccagccagcttcaggagtgggtggttagcagcatgatgttgggggcggcgataggcgcgctgtttaacggctggctgtcgttccgccttggccgtaaatacagcctgatggcgggggccgtactctttgtggccggctctatcggatccgcttttgccgccagcgtggaggtgctgctggtggcccgcgtggtgttgggcgtggcagtcgggattgcctcttataccgcgccgctgtacctctccgagatggccagcgagaacgtgcgcgggaaaatgatcagtatgtatcagctgatggtcacccttggcattgtgctggcgtttctttccgataccgcctttagctacagcggtaactggcgcgccatgctgggcgtgctggcgctgccggcggtgatcctgatcattctggtcgtctttttgccgaacagcccgcgctggctggcggagaagggacgccatatcgaagcggaagaagtgctgcggatgctgcgcgatacctcggaaaaggcgcgcgacgagcttaacgagatccgtgagagcctcaagctgaagcagggcggttgggcgttgtttaaggtcaatcgtaacgtgcgccgggcggtgttcctgggcatgctgctgcaggcgatgcagcagttcaccggcatgaacatcatcatgtactatgcgccgcgtatctttaaaatggcgggctttaccactactgaacagcagatgatcgccaccctggtggtgggcctgacctttatgtttgccacctttattgcggtgttcacagtggataaagcgggccgcaagccagcgctgaaaatcggctttagcgtgatggcgctgggcactctggtgctgggctactgcctgatgcagttcgacaatggcaccgcatccagcggcctctcctggctctccgtcggcatgaccatgatgtgtattgccgggtatgcgatgagcgcggcgccggtagtgtggatcctctgctccgagatccagccgctaaaatgccgcgacttcggtatcacctgctcgaccaccaccaactgggtgtcgaacatgatcatcggcgccactttcctgacgctgcttgacgcgattggcgccgccggcaccttctggctctacacggcgctcaacgtggcctttatcggcatcaccttctggctgatcccggaaaccaagaatgtcaccctcgagcacattgagcgcaacctgatggcgggcgagaagctgcgcaacatcggtaatcgttaatgtgaggcgcgcggcaaccacgggctggcgactttgcgcgtctcccgatggttgtcgccgtgaatgatatgcagggcgctcaggcgcccgatgtcataatgcggcagttgcactgtggagagcggcggtagaaacagatcgccaatgcccaccatgttgtcgtatcccactaccgccacgtcctgtggaatgcgtaacccctggcccagcagcgtctgatagaccataaacgcgatgcgatcgttgccgcagatcactgagtcaaagccaggtttaccctcgcggatatgcgccagcaccaccgccgggatatcgtggtaatgctcatcgccctggcccatatacgaatggctcagatggtccggttcgataccggcctcccggcaggcgcgctccagccccaggcggcggcggatcgtcgccggctggctggcgggtaagtgcaggcacagcggacgacgatagccagcggcaagcagggctttcaccgcgtcgtactgcccctgttcatcgtccgggatatagctggccaccggctggctgaggctttcgcagttggccagcacgcagggcagagtcagcagtttttccggcagcggtacctggcgcaggcccatggtggtaaagataatgccgtccggacggtgggagaggagcaggtcgaccaccgcttccggacgatcgtcagaaaacatattgaccacaaagctgttccagccgtgggcgcgggccgtctcttcgatcgagagggtgatctccaccgaaaagggcgtggtgacggtatccagcgccagcacgccgatggtgctgggggtggcgcgcgccccgcggatcttcttcgccgacaggtcggggacgtagttggtctcggcgatggcggcctgcacgcgggccagtgtctcaggcttcagccgctccggggtgttcagcgcccgtgagacggtcatcagagatacattcgccagttttgctacatctttcagggacgccattttttcctccgccattgccgcagagtacaggctatacaactaagtcgctgatgtaaaagagtgaaacgattttctgctatcgccgtcgtgagctatgttgcggttgatttttgatcgcgatcgcatcttcattatgttaacgttaacttttgtgattaacatcatatatcgcagcgaatccacctgcgttttgttttttgttaacgttaccataattgcattcctctaacacgagaatgtcatgatgaaagcgcctcactcacacagctacccgttgctcagtgccttactatttttcttttttgtgacctggtcgtcatccggctccttgctctctatctggcttcaccaggaggttgggctgaaggcaggcgataccggtattatctatgccgtactgtcggtttccgcgctgtttgcgcaagtttgctatggatttatccaggacaagctggggctgcgcaaacatctgctctggtatatcaccgcgctgctgatcctctctggtccggcgtatctgctgttcggccacctgctgaaaatcaacgtcctgttgggcagcatttttggcgggatctatatcggtttgacctttaacggcggcatcggcgtgctggaatcttacaccgagagggtggcgcgtcagagccagtttgaattcggcagggcgcggatgtggggctcgctcggctgggcggtggccaccttcttcgccggcctgctgtttaacatcaatccgcagctaaacttcctcgtcgccagctgttccgggctggtgttctttatcctgttggcgcggctgcgggtctcctcggcgccgcatgcgatgcaggaggcggtatcgggcggtaaggtgaccctcgaagatgcgctgcgcctgctgacgctgccgcgcttttgggcgctggtcttcttcgtcatcggcacctgcatttacggcgtctatgaccagcagttcccggtctatttctcatcgcagttcgcgaccctgcaggaaggcaatgagatgtatggctacctcaactccttccaggtgttcctcgaggcggccggcatgttctgcgcgccgtggctggtgaaccgcatcggcgccaaaaacggtctgattttcgccggcatggtgatggcgatgcgcatggtggcctccggtctggtggaggggccgctgctgatctccatcaccaaactgctgcacgcggtggagttgccgatactgctggtggctatctttaagtacaacagcctcaacttcgataaacgtctctcctccaccctctatctggtgggcttcgcctgcaccagctcgattatcgccagcgtattgtcgccgctggcgggctacagctatgaaaaatatggcttcgcccagtcctacctgatcatgggcctgctggtgttctgcaccacctttatttccatcttcttgttgcgctccggcaaatcctccgccgatccgctggtgtcgcaacctaccgctatctgaatcaaaaagagtgaaaatgatgacttacacaatctcccgggctgaacaggtactccagacacaacgccaggcgctgaacctgcgctggtatccgcactatcacctggcggcccgcgccggatggatcaacgacccaaacggtctggtgtggttcgacggctggtaccatgccttttatcaacatcacccgtactccacccagtgggggccgatgcactgggggcacgcgcgcagtaaggatctggtgcactgggagcatttgccggtagccctggcgccggagggcccggaggataaagacggctgcttctccggctcggcggtggtcgatggcgataccctggcgctgatttacaccgggcataagttccacggcgatcctggcgacgaagccaatctgtatcaggtgcagtgtctggccaccagccgcgacgggatccactttgagcgccaggggatggtggtcgacaccccgccgggtatgcaccacttccgtgacccgaaggtctggcgtgagggagatagctggtacatgatcgtcggcgcgcgcgaaggcgataccggccaggtgcggctgtaccgttcagccgatctgcgccagtggcaggacgcgggggtgctggatgaagcggaaagcaccatgggctatatgtgggagtgcccggacttcttcaccctcaacggcaaacgcgttctgatgttttccccacaggggatgcaggccgcggggttcagcaaccgcaatctgttccagagcggctatctgatcggcgagtggcagccaggccagcgttttattcgccatggcgaattccgggagatggataacggccacgatttctatgccccgcaaagcttcgccacccccgatggccggcggatcgtgattggctggctggatatgtgggaatcgccgctgccggagcagcaggacggctgggcgggcatgctctccctgccgcgcgagctgagcctgagcgcggatgaccgcctgcagatgcgcccggcgaaagaagtggagagcctgcgcggcgcctggttcccgtggccggtcagcaccctgaacaaccagcagacgacgatggtcgacaactgcgaggcgatggaggtgaatctgcgctgggactgcgcccgcagcagcgccgagcagtatggtctgcgctttggcgatgggctgcgcatctacgtggatgcccaacagcagcgtctggtgctggaacggcattatccgcagtatggcctgtgcgggacgcgcagcgtgccgttgaccgccggggcggatctcaacctgcgaatatttttcgatagctcttcggtggaggtttttgtcaatgacggcgaagcctgcctgagcagccgtatctatccgcaggctccccgccgtgaattagcgttatttgcctggagcggcgcggcggcattaaccgaagccggcgcctggcagctcgaataataataaggctgttgtcgttaataacccgtctttgacgatgggcgggttattattgcctgcatcgtcgtgcgttacccattaataaaaaattcagttcattccataataaaagggtttaccgatgaataaaatctgggtcgggtgttttctgacgtctctgtatctgccatccgttatggcgcaggcgccgttatcgctggaggagcgactggcgcaaatggagcagcggctaaaggcgacggaggcgcgcgccgccagcgcagaggcggaaattaagacgctgaaaggccagcagcaggccgcgacggtcgcccgcgcggcgcctgcttcgccgcgtttgcagctaaatgacaatggcgaattaaaattttatggcgacgtcgaatttaacctcgatggcgccagtcgcaccggcagtctgacgtcggtcaaaaccagcgcgaataaaagctgggcgcccggcgataaagagcgctgggatattaacggtcgtattctgctgggtttcgatggcagacggaatggcgccgacgggcaatatgccggattcagcgtgcagcctctggcggatatggatggcaaaatgaatcttgatgatgcggtatttttcttcggccagcaggatgactggaaaataaaaataggccgctttgaagcctgggatatgttcccgctgaatcaggatacctttattgaatattcaggtaataccgccaacgatctctattccgatggctatggctatatttacatgatgaaagaggggcgcgggcgcagcagcagcggcggtaaccttctgtttagcaaaacggtggataactggtatttcgaagttaacaccctggtggaggacggcagttcgctgtttgtcgatcagaactatcatggtaacgcgctggaaaaccgcaaaaatgtggtgtacgtgcggccggtggcggcgtggcagtccggcgcctggtcggcggccgcggcgatagagagcaatctcgtcaacaatgcttacggctatcagagccagagcggacgctgggtcgaccagtcaaaccgcaccggctacgggctgaccatgagctggaacaccctgaaaagcgatccgcaggatggggcggtggtcaatctgagtaccgccctgctggacgcggcggacgaaaccgacttcagcgccgggatcaacgccctttggcatcgcgtggagctgggctatatctatgcgcacaataaaatcgaccagttcaatatggccggggtgaccagcgaatgcgatggcgattgcgctatcctggcgccggggcgctatgacatccataccctgcacacctcctggcagttgccgaatatcatggcgatgccgaacttcaatatttaccttggcgcctatgcctcgtggctcgattccacggcagcgaagagcgggaatcccgatgaacgctacggcgcccgggtgcgctttaaatatttcttctgacagggccttctggcagaccctcccgcggcgtgcgccgcgggagagttcagacgggcaggttagcgcatcgcgcggcgcagaatgcggtcggtctggcgctggaagtcctcggccgcttcttccaccgactttttaccgtagtcgatgtactgcagggtggtgccgaactgggcgacgatctgcggatcgtcgaagtacggggagaccggcagagcggtgggcagggattgcgccagcttcaggccggacaccgccggatcgtcggctttgattaccccatcctcggtcaggtaggtgaccgccgctttactcagcggcacgccgcgctccagtccaagaatatccaccccttctttgctgttcagcaggaagttaatcactttcgccgccgcctgcgggtttttcgtcgatttgccaatcgacaacatttgcgcgggcttgaagaacagtccagcatcggtggcgcccggcagcatcgggtattcccccagcaccagcttcgccggcggcttcaggttatcggaatatttgttgatggtggagttccacatgtaggtcccgccccattcgccctggatccacggcttcatttcgtacatgttgctcttgccgaaggaggcatagtagcgggtgtccggcatcacatggctgtcgataagcttcttatacataccgaagaaatccgcccactgcgctttgctgtaggagaattttcgccctttctcatcgatggccggctgattgtatttttgcaccatataagagttgagcagggccagcacgtcctggtgttcgagcaccaccgggtagtactgtttcccgagcttgctttcgaaagtttttcccgccgccatgagttcatcccaggttttcgggaaggggatgcccgcctttttccatgcttcgtcgttaaagtagaagacgcgggcggtgacggaaattggaataccgttaagcttgccgttgaccgtggtggactgcagttctttggcgtcgaactggctgaggtcgatctcgtctttcagggtattcagatcgtaaaagccatcgccatttttcgaaaagatcggcagccagttccagttggtctgcatcacgtcaggctcggtaccgccggcaatctgggtggtcaggcgtgaaagatggccgtcccagccggtgtattctgctttgacgttgatgtctgggttttgtttgtggaattcctccagcgccttgagggtgacctgatggcggccgttgcccccccaccaggacatacgcaggtcgacgtcctgcgctagcgaagagaaggcgctaaggcccagggtggcggagagggtggcgcttatcagcacgtttttcattgttatgctccagggttcacagagagaggttctgttcggttttggcgtcaaagatgtgacacttgttgagatcaaaggtgaaatagactttgcgattcagtcccttggcaatcatcggcttcgcatcgtccgacggcacgcgggcggtcagctcataatcagcaaccctgagataaacaaagaattcatgtcccatgttttctacgcgtaccatttcacccgcgcaggaaccttcggcaaacggttcatcggagagagagacaaactccgggcgcacgccaaagaacacctgctgattcttatgggtttcaactttgttttgcagccgatcgttgagcggcagccgctgatcgcccagcgtcaaatacaggcgaccaccgtgctcaaccagctggctgggacgaatattcatctccggcgcgccgataaacccggcgacaaacatatttttcggctggtggtagagattgtccggggtatcaacctgcataatgtggccgagcttcatcacgcagatgcggtcgcccatggtcatcgcttccgtctgatcgtgggtgacgtagacggtggtcgccggtttgccagattttttcaactgcttatgcagatcggaaatgcggatccgcatcgaggcgcgcagcttggcgtcaaggttggagagcggttcgtcgaacaggaagacgtccggttttttgacgatcgcccggcccaccgccacgcgctgcgcctggccgccggagagctggcgcggcaggcgatcgagcagttcttccagttcgagaattttcgccgcttcttccacctgtctgtcgatttgcgccttcggcagcttgcttagcttgaggccaaaggcgaggttttcgcgcaccgtcatatgcggatagagggcgtagttctggaacaccatcgcgatgccacgggatttaggcgccaggttgttgacgattttgtccccaatccgcacctcgccgccgctgatggtctccagacccgccagcatgcgcagggtggtcgatttggcgcagccggaggggccgacgatcaccataaattcgccatcggcaatcttcaggtcgataccatgcaccgctttaaacccgttggagtagactttttccagtttgttgaaaatcacttcagccatgatatttccctcttaacctttgattccgctgctggtcacgccctgcacgaagtagcgttgagccaggaagaagacaatgatggacggcagaatggagatgctcgccattgccagaatttcgttccacggcgcgccttccgtgacgtcgatagacatttttagcgccagcgcgatgggatacttatcgacgctgtagacgtagatcagcggaccgataaagtcgttcatcgaccacataaactggaacagcgccaccgagataatggccggcttgaggatcggcaccaccacataccacagcacctggatggagttgcagccgtcgatctgcgccgcctcttccatatcgcgcggcacgccgcgcagaaactggatcagcatgaagacgaagaatccctgggtggcgaaggccagcggcaggtacagcggcagatagctgttcagcatccccatttcgcggaacatcaggtactgcgggatcagcaggacggtgctcggcagcaacatggtggtgataagcgttgcgaaccagaacttcttccacgggatctcaaagcgtgcgaagccgtacgccacgatggtggaggaaatgatcgttaacaccactttcgggatcacatacttaaaggtgttcagcatatagtggccgaaatggtattcggtgccggtcttccagccgttgataaacccgtcccaggtggcgtgggcaggccacagcccgagggtggtgaagatctcatggttcggcttgaacgaggcggagaacatccacgccagcgggtagagcatcagcaggccgacgaatatcagcacgacgtagcgcaccacccggctcaccttttcccggcgcagcgtacgggcgacctcacgatcggcgtcgctcatcaccggcgccatctgttgaatatcagccatttttgcctcccttatcggcggagtagaagacccagtatttcgatgacttaaaggcgatcgacgcaaagaccgccacgacgaggaacagcacccacgccagcgcggcgccatagcccatgtcgaagtacttaaaggcggtatcgtagatatagagtgagaagaggtaggtgtaataggtcggaccgccgccggttatcacgtacgggccggtaaactcctggaacgcctgggtggtctgcataataaagttgaagaaaatcaccggggtgatcagcggcacggtgaccttcatgaacatctgccactttgaggcgccgtcaatcattgccgcctcatactgcgactgcggaacgttctgcagcgcggcgaggaagatgaccatcgcggagccaaactgccagacgcgcagcagggtgaccgacatcagcgccagggagggttcccccagccagttgatggcatcaatgccaaagacggcgagaaaactgttcagcaggccgtcaatggcgaacagggcgcgccacagcacggcaatcgccaccgagctgccaaggatcgacgggatgtaataggcggtgcggaaaaagccgatgccgcgcagtttgaaattgagcacaaaagcaatgccgagggcgaaagccagttttaaggggatggttaaaaagacgtaggcaaaggtcacccccatcgatttccagaacaggctatcctcggtcaacatatagcgatagttttcgatgccgttaaataccggcgggctcatcaagtcgtactcggtaaaactgagaaagaaagatgaaacaaagggaaaagcggtaaagacgatcagcccgatgatatagggcgatatccatgccaatcccagcagcttgttttcattcatacatacctacctggcttacgagttgtaatacggatccggtgacgccgcgctgtcggccttttacgcctgacaacgcaaaaatgtctgaacgcttcctctgcttaacatgtccttgttaattaatggggtattctttaactggtctagcaggtaagggctgtcagcccctttttttatgcggaactgttttttataaaacaccgttttaatttcattttattgcgatttgtttctgcgtcatgcagatcaggatggaaatgtgatcaaagtcgaaacgatgtttcaaaaaggtgaggtggtaagcattttggccgtaaagggcgtctgaaaggaatgaaaaattaggcttaactgagcgggaaatataattaccaggataatgattgtggccgcatctttttattgaagggcgccgggcagtaaccggggacggcgaacgcccccgttatggattagccttcaagaaaatcttcgcgaatgggagtaaaggtatcgagcagcgtgccgggctgcaggcagacgcaaccgtgcataatccccggccgcttatacaacgtatcgccggcgctgacgacgcgcgtctcctcgccgatggtgaactcgaactcgccggaaagcacgtaggtgagctgttcgtgaggatggttatgcatcgggccgacggcgccggcggcaaaattcacctccacggccatcattttgccgtcgtgggccagaatgcggcgggttacgccattgccgaggtcttcaagggtggtgtctttatgaaaaataaacatctggcgatcctgttgttaaagtgaaacattgtttcatttaacttatcccactcttcatgaaaaagaaatacgcggccagagaagtggaaagttgatcacaagtttgcttcactggcagaaacgacataaggagcagaagatgaaaaccattggcctgttaggcggcatgagctgggagtccacgatcccctattatcggttgatcaatgagggcgttaaggcgcgactgggcggcctgcactctgccagcctggtgctgcacagcgtcgattttcacgacatcgaagcctgccagtccgccggcgactgggatcgcgccggagagatccttgctgaggccgcggtcgggctgcagcaggcgggggccgaaggcattgtcctgtgcaccaacaccatgcataaagtcgcagatgccatcgccgcccgctgccaggttcccttcctgcatattgccgatgccaccggacgggcgattgccgccaaaggtcagcgccgggtcgcgctgctgggcacccgctataccatggagcagaccttttaccgcggtcgtctgcaggagcagtttgccatcgagacgctgatccctgaggctgacgatcgggcgcagatcaatcagatcatcttcgacgaactttgtctcggcaccttcagcgaggcgtcgcgggattattatctgcagacgatcgccgccctggcggagcagggggcggaaggggttattttcggctgtacggagattggcctgctggtgcctgccgagctcagcccgctgccggtctttgacaccgcggcgatccacgcggaagacgcggtcaactttatgctctctgcaggaccgacgccagcggcgtgaggatctgcggcagactctgctgcaggtgggcaacaaaggcgtcgaccagcgccgagcgcgggcggtggagggggcggatcaggctgacggtaaacggcacctcgacgctgaagcggcgcaccaccacgccgctatcggcatagtccagggcggttaacggattcaccaccgagatcccggcgccggcgcgcaccatggcgcagatcgaggccgcgctgtgggtttcgaccaccatccgccgtttaacctgatgctcaaggaacagggcgtcgagcagctggcgatagctgtcggtgcgcgacaggctgatatagttttcgccctgaaaatcggcgggggtcagcgtcgcctgcgccgccagcggatggccggcgggcagcacgcagacttcattcagcgtcagcagcggggtgcgttcggtgcccgcgggggtatgcagggtctccgtcaggccaaggtcatggcgctgggcggagagccactcctccagcagcggcgactcctgggggacgatctgcaggctgacctccgggtagcgagcgagaaacggcggcaacagcagcggcagaaaggactgggaaaacaccggcagacaggcgatcgacagctcgccctggcggaactcgcgcaggctctcggcggcgctgacgatacggtccaggccataccaggagcgctgaacctcctcaaacaaacgcaggccctgcaccgtcggctgcaggcgaccgcgggtccgctcaaacagctgcaggccgagcaccttctcaaagcgcgccagctcgcggctgaccgtgggttgcgaggtgtgcagcatcctcgccgcttcggtcaggttgccggtggtcatcaccgcgtgaaagatttcaatatgacgcaaattgacggctggcatgcggtctccgtgaggctcggctggaaccatatcatttttgcatagagtcgcgataaaacgatattttttattcgtctgtcactgtggcgtaatcagaaaaaacagcgaccaacacacgtactgcaccggagttcttatgccacactcgctttacgccaccgatactgacctgaccgcggacaacctgctgcgcctgccggcggaatttggctgcccggtctgggtctatgatgcgcagattattcgccgccagatagcccagctcagccagttcgacgtggtgcgttttgcgcaaaaagcctgctctaacattcatattctgcgtctgatgcgtgagcagggggtgaaggtggactcggtgtcgctgggggagatcgagcgggcgctggcggcaggctacgatccgcagcagaatcccgaggatatcgtcttcaccgccgatctgatcgacgacgccaccctcgatcgggtgaaggcgttacagatcccggtgaacgccggctcgatcgacatgctgagccagttgggcgaggtgtcgccgggccatcgcgtctggctgcgcgtcaacccgggctttggtcacggccacagccagaaaaccaataccggcggtgagaatagcaagcatggcatctggtacagccacctgccggcggcgctggaagtgatgcgtcgctatcagctgcagctgatcgggatccatatgcatatcggctctggcgttgactatggtcacctggagcaggtgtgcggcgcgatggtgcgccaggtcgtcgactttggccaggatctgcaggccatctccgccggcggcggtctgtcgattccttaccgcgaaggtgaagaggccatcgacaccgcccactattatggcctgtggaaccgcgcccgggagcagatcgcggcccatctggggcacccggtgaaactggagattgagccaggacgcttcctggtggccgagtccggcgtgctggtgtcgcaggtgcgcagcgtgaaagagatgggcagccgtcacttcgtgctgattgacgccggctttaacgacctgatgcgcccggcaatgtacggtagctatcaccatatcaccgctctggcgggggatggccgggatctcagcgccgcgccgcaggtcgaaaccgtggtggccgggccgctgtgcgaatccggggatgtctttacccagcaggaggggggcaaagtcgagacccgcctgctgccggcggtggcgcctggggattatctggtgctccatgacaccggcgcctacggggcttcgatgtcgtccaactataacagccgtccgctgctgccggaggtgctgtttgatggcggtaaggcgcggctgatccgccgtcgccagaccatccaggagctgctggccttagagcttatttaaaaaaaggtcccgtcgtcaccgactcgcgaagcaccagcgtgccggtaaacggcgggatcgtttctatcggctgctgattggcaagcttgatcgcctggtcgatagccgtagtgatcatgttgtcgatcggcagataaaccgtcgacagccccggctccagccatttcgcgcttggcgcatcgtcgaagccaaacagcgacacatcctgtggaatacgcagccccgcctgatgcagcgcctttgacgcccccagcgccatatcatcgttacaggaaaacagcgcgctgaagcgggctttctcgtccagcagttcccggcacagttcgtagccgcgggtcatcgtcgagtccccatacttcacccggctcggatcccactcaataccatgttttatcagcgcgttgcggtagccctgcaggcgagcctggccggtaggggtatgcatcgggacggtgatgcaggcgatatcgcggtggccctgggtaatcagatactccacggcctggaaggcggcttcctgctgttcgaagaacacgcagcgttcgcgggcctgcgccacatcgcggttaatcaccaccagcggcatggcgatcgagttaatcagcgacatgatcgccttctcgctcatgtgccgggtatagaggatgatcgcatcgcactgccggtcggcgagcatctgcaccgcttcctcttcgcgctccggcgtatcatggccgtcggtgacgataagctgctttccccaggcttcggtctggcgtgacgcctgctgcagcagacggccaaagtaaaagccgtcaaaggtggagacgaccagcccgatactattgctggtctgattggccagcgagcgggcaaggaaattgggccggtagcccagctcttccatcgctttaaagacctgttgacgggtgctctctttcacctgacctgtgccgttcaacacgcgggaaaccgtcgctttcgagacgcctgcgcgaattgagacatccagcattgtagccattcatcgattcctgatttcacgtggtaaagcgcagtttatcacagaccgaaaagggacatatcgacggggcggggcggaaaaaccatcgcgatcacgcttttggcaggaactgacgagccgacagactctggtatgccaatgtcgattttatcggatatttgggataccactgtgcgcgttgcgagcgctgtcacagaactatttttgcctggcgactatgttttggtatgccaaaagtctctggctgttcacctggccgcattaagccctttacactgaggtactcttttatggcattacaggacaaactgatcgacgcgctggggcgtttcgcgacgacattcaacagctatcgctacattatggcgatcaaatcggcgtttattaccctgatgccggtgatcatcgtcggggccttttcggtgctgatctccaatatggtgctggatccgaaaaatgggctcgccagcttttcctcgctctcctttcttgcggcgctgaagccgatcaccagcgcgcttaactacgctacgctcaacttcctcaatatcggcgccgtgtttctgatcggtattgagctggggcggatcaacggcatcaaaagcctgtttcccggcctgttggcggtgatctgctttatctgcgtcacgccgaccacggtggagatgatggtcgatggccagatgcacgtggtgaaagatgtcctgctgcgccagttttccgatacccgcagtctgttccttgggatgttcatcgccattctgtcagtggagatttactgctggctggaggggcgcaagggactgaagatcaaaatgccggataccgtgccgccgaacgtctctgcctctttttccgcgctgatcccggcgatcatcaccaccaccgcgatcgccacctttggttttctctttcaccagctgacgggaatgtatctctacgatgcggtctaccaggtggtgcagcagccgctggagcgggtggtgcagagcctgccggggatcctgctgctgatgttcgtcgcccagctgttctgggtgatcggcattcacggcaaccagatgatcaagccgatccgcgagccgctgctgctgggagcgatcaccgtcaatatgagcgcttttgagcaggggaaagaggtaccgaacatcatcacgatgcccttctgggatgtctacatgagcatcggcggctcggggctgaccatcggcctgctgattgcggtgatgatcgccaccaggcgcaaagagatgaaagagatcgccaagctgtcgataggcccggggctgttcaatattaacgagccggtgatcttcgggatgccgatcatgcttaacccgatcctcgccatcccgtttatcatcaccccgctggtgaccggcagcatcggctatttcgccaccctgaccggcttcgccggcaaggcggtggtgatggtcccctggaccacgccgccgctgatcaacgcctggctctccaccgccggctcgatgggggcggtggtgacccagcttatctgcatcgtcgtcgcggtgcttatctatctgcctttcgtcaaaatcgcctcccgccgtgccgatgccgcgcagcgtcaggtagacaatcaacaaaccgccaaccctgtctgaggagcctatgactaccgtacggatgaccattcccgatgattttatccttggcgcggcggcttccgcctggcagaccgaaggctggagcgggaaaaaaccagggcaggactcctggcccgatctctggtacaaaaacgatcgccacgtctggcataacggctatggcccggcggtggccaccgattttatcaaccgctttcaggaagatgtgcagctgatgaagctggccgggctgacccactaccgcacctcaatcaactggtcgcgctttctgaccgactacgaaaacgtcacggtggatgaggagtatgcggcctattacgaccagctgttcgatgcgctgctggccaacggcatcacgccgatgatctgccttgagcattatgaattgcccggctatctgctggaaaagtatggcggctgggggtcgaaaacggtggttgagctgtttgtgcgctacgcggagaaggtgtttgcccgctaccacccgaaggtgacgcgctggtttacctttaatgagccaattgtggtgcagacccgggtctatctggatgctctgcgctggccctatgagcagaacaccagcacctggatgcagtggaactatcataaggtgctggcgaccgccagcgtcgtgaagcggtttcgcgagctcggctatcccgggaccgtcggctgcatcctcaatccggaggtgacctacccacgctcacgcgccccccatgacctgcgcgcggcggagatctacgatctgttctacaaccgcatgttcctcgacccgctggtgcacggcgtctggccgccggagcttctcgcgctgcttgagcagcatcaggtgacgtgggagaccagcgaggaggatctggcggttatccgcgagcacaccgtcgatgagctggggattaatctttactacccgcaccgggtcaaagccccgtcgcgggcctggcatccgcacaccccgttccatccggcctggtattatgagccgtttgagctgcccggccggcggatgaacgcctcccgcggctgggaaatctacccgcaaatcatctttgatatggcgatgcggataaaaaatgactatcgcaacatcccgtggttcgtggcggagagcgggatgggggtggaaaacgaaggccagttccgtaaccgcgaaggcgtcatcgatgacagctaccgcattcgttttatcagcgaacatctgtggcacaccctgcgcgcccgcgaggcaggggccaactgccagggctatatgctgtgggcgtttaccgacaacgtatcgccgatgaacgcctttaaaaaccgctacgggcttatcgaaatcgatctgcaaaaccatcgcgcccggcgacccaaagcctcggcgcactggtttcgtcaactgggcgaacggcgtgaactggtgctggatatcgatgatgaataccgctagccgggggcaatatttgctaagatagcggcgtatttgactcgcaggcatgtaacgcacaggtgattttgtggaaaaagcgatagttccgccggaaaagaagccctatcaggagattggtgatgacctgcgcgcccagatcgcgcaggggcgctacccggtcgggtcgcgtttgccgccggaacgccatattgccgaaacctatggcgtcagccggaccatcgtgcgcgaagcgctgctgatgctggagctgcaggggacggtggatattcgtcagggatccggggtgtatgtcatgcgcattccccacgagaacgacagcgaagaggagcagctgctcagcagcgacgtcggcccgtttgaaattctccaggcgcgccagctgctggagagcaacatcgccgcctttgccgcgaaaatggccacccgcgccgatatcgacaatctgaagcggattattgaacaggagcagcgggcaatcgctctcaacgacaccgcgcaggataacgctcgtctgttccatctggtgctcgccggggcgacgcagaaccagatgctgttggcgacggtagagcggatctggctgcagatggacagcagcccgctgtggcagcagttcaatgtgcatattgccagccgcgcctggcggctgaaatggctcggcgaccggcagactctgctcgccgcgctgcggcgtcgcgatgtgatgggcgcctggcaggcgatgtggcagcatctggaaaacgtcaaaaacagcctgctggagctttccgatgaggacgcccccgactttgacggctatctgttcgactcagtgccgatttttcaggggaagctggtatgacgatcctgccgctgtacgctgcgccgcagtacgtcccgcaggtgaccgactggttgtggcaggcctttggcggcgagacgctgccgcggcaattcttcgccagcatcgtgcagcatagccagacggcggaggcgctgccgttgacctttattgcggtggaaggcgagcagttgctcggcacgattggcctctggcgctgcgatttgatcagccgccaggatctgtttccctggctggcggcgctgtacgtcgcgcccgccgcccgcggtcaggggctggccggaaaactgcagcggcatgtgatcgattatgcccgcctcgcgggctttcgggagctctatctctactccgcctgccgggatttctatgaacgcttcggctggcgctacatcggcgagggactggattacccggccaccgccgtgcacctctatcgctatgacttatcgccttcctgcggggcgaccaccgagtgacgacggaccagcgtcgggctgaacagatgggtgatctccggcgccggccgttgctccgccagggctaaagccagctcggccgcctgggtcgccatcgtaacgatcggatagcggacggtagtcaaccgcgggcggacatagcgcgaaatcaggacatcgtcgaagccaatcagcgaaatctcccgcggaacgtcgatgccattgtcattcagcacccccatcgcgccggcggccatcgagtcgttatagcaggcgacggcgctaaagtggcggccgcggccaagcagttcggtcatcgcctgttcgccgccgctttcatccggctcggcaaacgtgaccagccggtcgttgcacggcaggccgctctcctccagcgccgcgtagtacccctgcagccgatcttccgcatcggagatatcatggtttgagcacagatagccgatacgcgtgtgcccctgctggatcaaatggcgggtcgccagccaggcgccgtagcggtcgtccagcgccacgcagcgggtttcatatccgggcaggatgcggttgatcagcaccatgccggggatctgtttcattaaccccgccagttcctcatcggggatcattttggcgtgcaccaccagcgccgcgcagcgatggcggatcagctgctctatcgcctggcgctccttctgcacgttgtggtagccattgccaatcagcaaaaaattgccggtgcggtaggccacctgttcgacggctttgaccatcgcgccgaagaaggggtcggagacatcgcccaccaccaggccgacggtttccgttgactgctgggccagcgcccgggcgttcgcgttggggtgatagttcagggtttccatcgccgcgcccacggactgacgcgaggcttcgctggctttgggagagttgttgatgacgcgggagacggtagcgacggagactcctgcgagtcgggctacatccttaatagtcgccataccatgccttttctagggtaagcgtttacatactgctatgttacgggaaagagcggcagattcaaggcgcggcggcgaaggaatggcgcaaatgtgattcagcgcgggcttatcggtgacctgtttacattgacgcgatcggtaattgaaaccggcgcagggaaatacaaacctttgcttacactttgcgatgcgctgttgcgaatgttcgctggtttgttcgcggatccggttgatattctggctatcccagaggtattgataggtggagtcaacgtcacgttgaccactttacttacaccagcctgcgcagatgcgcaggtttttttttgcccgctatcggcgttgttacagatagcgaaaatcgtaatacctcgttgcacttaggctcactcccttgcgttttcccgctggcccgttacggccaaaaaacgtgacaatcgagatcccagaggtattgataggtgagtttctcaggtacgctcttcgtactgaacgtcttacaccgacctgcgcggatgcgcaggttttttttattccgaaaatccccccgctgcactgctttcccatgccttctcgtgtaacctgctttgactcatcaaccggtcacatggagttgttatgcttttgggatttttcagactgctgttcaaggggttataccgggtcagactgaccggcgacacgcaggctttataccagcaaaaggtcttaatcaccccgaaccacgtctctttcctcgacggcattctgctggcgctgtttttgccggtccgaccggtttttgcggtctatacctcaatcagccagcgctggtttatgcgcgcgctgacgccgattatcgattttgtgccgctggacccgaccaagccgatgtcgatcaaacatctggtgcgcctgattgagcaggggcggccggtggttattttcccggaagggcgaatttcggtcagcggctcgctgatgaaaatttatgacggcgccgcctttgtcgccgccaaatcgcaggcgaccattgtgccgctgcgtattgaaggcgccgaactgacacccttcagccggctgaaggggctggtgaaacgtcgcctgttcccgcgtattcagctgcatctcctgccgcccacccatctgccgatgcccgaggcgccgcgcgcccgcgaccggcggaagatcgccggggagatgctgcaccagatcatgatggaagcccggatggcggtgcgcccgcgggaaaccctgtatgagtcgctgctggcggcgcaggaccgcttcggcgcgcgcaaaccctgcgtggaggatatcaacttccagccggatacctatcgcaagctgctgaccaaaaccctgtttgtcgcccgcattctggaaaaatacagccagccgggcgagaagatcggcctgatgctgcctaacgccggcatcagcgcggcggtgattttcggcgctatcgcccgcgggcgtattccggcgatgatgaactataccgccggggtgaaagggctcagcagcgcgatagccgccgcggagctcaacaccattttcacctcgcgcaccttcctcgataaaggcaaactctggcacctgccggagcagctgacccaggtgcgctgggtattcctggaagatcttaaaggcgatatcaccctcgctgacaaactgtggatttttgctcatctgctggcgccgcgtctggcgcaggttaagcagcagccggaagacgcggcgatgatcctcttcacctccggttccgagggcaatccgaaaggggtggtgcacagccataagagtctgctgtccaacgtcgagcagatcaaaactatcgccgactttaccgccaatgaccgctttatgtcggcgctgccgctgttccactcttttggcctcaccgtcggcctgctgacgccgctgcttaccggggcggaagtgtttctctatcccagcccgctgcactatcgcgtggtgccggagctggtctacgatcgcaactgtacggtgctgttcggcacttcgaccttcctcgccaactatgcccgtttcgccaatccgtacgatttctaccgcctgcgctacgtggtcgccggggcggagaagctgcaggagagcaccaaacagctgtggcaggataaattcggcctgcgcattctcgaaggctatggcgtgaccgagtgcgcgccggtggtctcgattaacgtgccgatggcggcgaaggtcggcaccgtgggccgcatcctgccggggatggacgcccgcctgctggcgatgccaggcattgatcaaggggggcggctgcagctgaaagggccgaacatcatgaaaggctacctgcgggtggaaaaccccggcgtgctggaagcgcctgcggcggaaaaccagcacggcgagatggaagcgggctggtatgacaccggggatatcgttaccttcgacgagcagggctatgtccgcattcagggccgcgcgaagcgcttcgccaaaatcgccggcgagatgatctccctcgagatggtggagcaggtggccctcggcgcgtcgccggacaaaatgcacgccacggcgattaaacaggacgccagcaaaggcgaggcgttggtgctgtttaccaccgataatgaactgactcgtgaagccctgctgcgctacgcccgccagcacggcgtaccggagctggcggtgccgcgagatatacgctggctgaaacagctaccggtgctcggcagcggcaagccagactatgtcaccctgaaaaatatggtcgacgaggcggaaacaacccatgagtgagtcagtacatactaacccttcgctgtactcgaaagggatggtggcggtgatctgcgcccagttcctgtcggccttcggcgacaatgcgcttctcttcgccaccctggcgctgatgaagcagctctattatccggagtggagccagccggtcctgcagatgttgtttgtgggcgcttacatcctctttgccccctttgtcggccagttcgccgatagctttgccaaaggccgggtgatgatggtggccaacggcctgaaactgctcggcgccggctgcatctgcttcggcgtcaatccgtttatcggctatacgctggtggggattggcgccgccgcctattcgccggccaagtatggcattctcggcgaactcaccaccggcgataagttagtgaaggctaacggactgatggagtcctcgaccatcgcggcgatcctgctgggctccatggccggcgggatcctcgccgactggcacgtgctggcggcgctgatcgtctgcgcgctggtctacggcggggcggtagtggctaacctgtggatacccaggctgccggcggcgcgtccggggcagtcgtggcgttttaagccaatgacgcacagcttcttcagcgcctgccggacgctgtggcgcaacggcgaaacccgcttttcgctgatgggcaccagcctgttctggggcgctggcgtgaccttgcgtttcctgctggtgatctgggtgccggtggcgctgggcattaccagcaacgccatgcccacctatcttaatgcgatggtggcggtggggattgtgctgggtgccggggcggcggcgaagctggtgaccctggagacggtgtcgcgctgtatgccggccgggattttgatcggtatcgcggtgatagcctttgcggtgcagcagtcgctgctgccggcgttcggtctgctgctgctgctcggggtgttcggcgggttctttatcgtaccgctgaacgcgctgctgcaggagcgtgggaaacattcggtcggggcaggtaacgccattgcggtacagaacctcggtgagaacgtggcgatgctgctgatgctggggctctattccctggcggtgagcgtgggcgttccaccggtcgccgtggggataggctttggcgcggtattcgccgtggccatcgccgcgctgtgggtctgggggcggcgtaaataacctcccggcttacgctgcgcttgactgggcgagggggtcgccaatatctgctcttcggtagcccgggtaaggcgtatacgccgctacccggggctttgcttttttacggcgccgggtaggtataaacctgatgcaccgcctcaatctccgctaatacctcttcgctcagctcaagctgcaaactttccacgttggcctgcagctgcgtcatggtcgtcgcccccagcagggtgctggcgacaaacggctgccgacgcacaaaggccagcgccatttgcgccggatcgaggccgtggcgtttggcgatatccacataggccgctaccgctttctgcgactgctcgctgctgtagcgcgtaaagcggctgaacagcgtattgcgcgcccccgccggcttcgcaccgttgagatacttgccggtcagtgtgccgaaagccaggcaagagtaggccagcagctccacgccttcgaactgactcacttccgcgaggccgacttcaaagctgcggttcagcaggctgtaaggattctgaatagtcacgatccgcgggaggtcgtgcttatccgccaggtgcagataacgcatcacgccgaaggcggtttcgttcgacacgccgatgtagcggatcttcccggcgcgctggaactcggtcagcgcttcgagggtatccagcagcgtcacggcgggcgcggcgtcggcccaggtatagcccagcttgccaaagcagttggttggccgctgcggccagtgaacctgatataaatcgagataatcggtctgcagccgcttcaggctggcgtgcagcgcctcgcggatatttttgcggtccaggacgtgattgggccgaatgctgctgtcgttattgcgcgcgggcccgctgactttggaggcgagcaccagcttttcgcgattgccgcgtttcgccagccagttgccgacgtaggtttcagtcagcccctgggtttccgggcgcggcgggaccgggtacatttcagcgacatcgatcaggttgatgccgttggcaaccgcgtaatcgagctgctggtgggcatcggcctcgctattctgttcgccaaaagtcatggttcccagcccgagggtgctgatttcaagagaactgtgtgggatacggtgatactgcatagccagcttcctttttatttataaggtcaggcattccccgacaaaggagtatcaacatggcagagggtgagaaaaagaggaagtaaaaaatcaaaaaagccgggtgacgaggaggggcggtgggtgaaacccgcggcgtcctggtatatcccgactcttctcaaaagactggtggtcggtaagcgcagcgtcaacagaagctggggccgacagggaaagattaacgcttaatgatttgcgaaacgtcgtcacgattgatctgcattttattaccctgctgatcttcgtaactgattaaaccggtatcgtcatccacggtaggtttaccgtcggtcaggatcattcgcccatctttggtcgccatgacgtaatcgctgctgcaaccggaaaccgagaacgccagtcctacggcggaaatcaatactgcccatttcttcatcgtcaacacctcttcagtagctgcaccccatacccgtctattaatagcctgatttgtgagacataaaaagcagtaaagtctgaaaaagggttgcagcctgtgaccaggctgcaattttgtggtttacagcgggtttttcttattacgcagcaggttaaggctctccaccgcgatagagaagaacatggcgaaatagatgtatcccttcggcacatggacgtcgaagctttccagcatcagggtaaagccgacgaggatcagaaacgacagcgccagcattttcaccgaaggatgacggtcaacaaaatcgccgatgggtcgcgcggcgaacatcatcacccccaccgcgatcaccactgccgccatcatgatgaacagatgatccgacaggccgacggcggtgatcactgaatcgaggctaaagatgatatccagcagcatgatctgcacgatggcgccgaggaaggagtggacgttggtcttcagcccctcctcttcaccttcgatagattcatggatctctttactggctttccagataaggaatagcccaccgagcagcaagatcagatcgcgaaacgagatctcctgaccgaaaacggtaaagagcgggttggtaagcttaacgacccaggcgattgaggccagcagcgccagacgcatgaccatcgcgcccatcaaaccgatccggcgcgcatgggcgcgctgggcggtggggagcttagccacgaccagagagaggaaaataatattgtcgatcccgagcacgatctccagcagcgtcaatgtgcccagcgccagccaggcgttaggatcggttatccatgcaaataacattgttcaaagtcctgcaaaatagaaagcagcaattatatgcaacccccaacgcagaacaaaaaattaatcgtgttgtaacaagaaatggcgggcaagcagagcggcggtaaaattctttttcagatagaaaccgcgcggcagcgtgaggattgtctccccgcgggcaccgatggcttcggtcagcgccttgctgttggcggctttcggtcttaactgcagcacctcgccgtggcgggcggtaatgcgctctacctcaccgagaacaatgagatccatcagctcttcccagtccatgcgcagctggcgctcctcgtcttcgtccgggctccacagcagcggtgcgccgacgcgccgcgccgccagcgggatggtgcgttcaccctccaccgggatccacaggacgcgctgcagcttatgccgtacatggctgctctcccaggtgacgccgctattgccggttaacggggcgacgcagacgaaagtggtctccagcgggcgtccccggctgtcgatggggatcgttttgagctcgacccccagcgcggcgaaatcctgctcgggtttactgcctgcgctggcgcccagccacagctccagcagaatgcccgtccagcctttatcgcgcttcagatcgcgcggaatggggatccccgccagcgccgccagctcgcccagcgaatagccggccagctggcgggcctgggccaacagctgttcctgactttgcggcggtgaggcgagcggagcgatagcgggcatagggcaatacctttggttaaaaagtgagcgctaattttgcgcgttgtggatagagtttaccgttttctgagtaactataccaatctcatgatttatatggctttttaaactcatcatgcggcttatgaaaacggtgtaaacgggttttccagaactggtcactgacaataaacaggatcttacaccatgttatccacagaaaagtgggataactggggaaaagactcactactggttcgatttacagccttgacgtgcgacgaaaatcgaatttttagagaaaatctgccggtggcctgcgcgtaatctgtggataaaatcgacattgctcgatctttcatcagtcggcagatcgcatgtgtgatgatcgtcacgttatgctgtaatgtgtgaaaggaatatattctaactttatgaatatgatactattattttcagatgctagcgatgcgatgttcggattactctgggttttcccgggttaattccgtacttcttcacaactctatccacagaaaaagtgaataaaatcggctgtcacgcgctttcattgtttataactctggcaattactgtgagttattcaaatgttatccgttctcagtgtgcgaacagagtggtttaccgtttccggcgagtgtgaaacaatcattcacattgaagcttatcttgaggtagtccggtgattgatgacgatggctaccgcccaaatgtcggtattgtaatctgtaatcgtcagggccaggtgatgtgggcccggcgctatggtcagcactcgtggcagttcccgcaagggggcattaatccaggagaatccgcagagcaggcgatgtatcgggaattgtttgaagaggtcgggttaagccgtaaagatgtgcggatcctggcctcaacccgtaactggctgcgttacaagttgcctaaacgtttggtgcgttgggacacaaagccggtttgtatcggccagaaacaaaagtggtttcttttgcagttgatcggcaacgatgcggacatcaatatgcaaaccagcagtacacctgaatttgatggttggcgctgggtgagttactggtacccggttcgccaggtggtgtcgtttaagcgcgacgtctaccgccgggtgatgaaagagttcgccagcgtgaccatgtcgctggcggagagcgcacctaagccgcaaaacgcgcctgcttatcgacgtaaaagaggttaagccacgcacattatgctcactcggttgcgagaaatagtcgagaaggtcgcgagcgcgccgcgtttaaacgaggcgctggatattctggtgacggatgtctgccaggcgatggagacggaagtctgctcggtttacctggctgacaatgaccgacgctgctattacctgatggccacccgcgggttaaaaaaacctcgcgggcgcaccgttgcgctggcgttcgatgaaggcctggtggggctggttggccgcctggcggaacccatcaacctcgccgatgcgcaaaaacaccccagcttcaaatatatccccgccgtcaaagaggaccgcttccgcgccttccttggcgtgccgatcattcagcgccgccagctgctgggcgtgctggtggtccagcagcgcgagctgcgtcagtttgatgaaagcgaagagtctttcctcgtcaccctcgccacccagatggcggcgatcctctcccagtcccagctgaacgccctgttcggccagtatcgtcaaacgcgcattcgcgctctgccggcctcttccggggtggcgatcgccgagggctggatggacgtcagcctgccgctgatggagcaggtgtatgaagcctcgacgctggacaccgcctcggaacgcgaacgcctgaccggtgcgctggaagaggcggccaacgagtttcgtcgctacagcaaacgctacgccgccggggcgcaaaaagagacggcggcgatcttcgatctctactcgcacctgctctctgacgcccgcctgcgtcgcgagctgtttgccgaagttgacaaaggcgccgtcgccgagtgggccgtcaaaaagatcattgagaagttcgccgaacagtttgccgcgctgagcgacggctatttgaaagagcgggccggcgatctgcgtaccctgggccagcgtctgctgttccatctcgacgacagtattcaggggcccaacacctggccggcgcgcattatcctcgtggcggacgagctgtcggccaccaccctcgccgaagtgccgcaggatcgcctggccggcgtggtggtgcgcgatggcgccgccaactcccatgccgctattatggtgcgggccctcggcatcccaacggtgatgggcgccgatattcagccctcgctgctgcatggccatacgctgattgtcgatggctatcgcggtgagctgctggtggatcctgaacctgtcctgttgcaggagtatcagcgccttatcagcgaagagaacgaactcagccgcctggcggaggacgatctccagcgcgcgtcggagctgaaaagcggcgagcgagtgaaagtcatgcttaacgccggcttaagcccggagcacgaagagaagctcggcagctttgttgacggcattggcctctaccgcaccgaaattccctttatgctgcagagcggcttcccctcagaagaggagcaggtcgcccagtatcagggcatgctgcagatgtttaacagcaaaccggtgaccctgcgtaccctggacatcggcgcggataaacagctgccgtatatgccaatcagcgaagagaacccgtgcctcggctggcgcgggatccgcatcaccctcgatcagccggagatctttttgatccaggtgcgggcgatgctgcgcgccaacgccgccaccggcaacctcagcattttgctgccgatggtgaccagtctggaggaggtggatgaggcccgtcggctgatcgatcgcgccagccgggaagtggaagagatgatcggctacgccatcccacgtccgcgcctgggggtgatgctggaggtcccgtcgatggtctttatgctgccgcagctggccagccggatcgattttatctcggtagggacgaacgacctgacccagtacctgctggccgtcgaccgcaacaatacccgggtcgccagcatgtatgacagcctgcatcctgcggtattgcgggcgctggcgatgatcgcccatgacgcggagcgctttggcatcgatctgcgcctgtgcggcgagatggcgggcgacccaatgtgcgtgacgatccttatcggcctcggttaccgccatctgtcgatgaacggccgctcggtggcgagggtgaagtatctgctgcgccgcattgatatcgaagaggcgcaggagctgtcgcgtcgcagcctcgatgcgcagatgaccgccgaggtgcgccatcaggtggcggcctttatggagcgtcgcggtctcggcggcctgatccgcggcgggcggtagcgccagcccgggtgaggcgtaagccgtaacccggggatcctctgctcgcaccctccggcaaagtagggtaccgccgggaaaacggcattctgttagcatccgtatacatatcttttacacgttcggcgcggatcgctcttgtggcttatgctatgattcgcctccttcggcgtgcccgttttgttcgggtatggatcatcaccgctgtccactttcggcggaataacaagtctttatggtgacagatgaatagtggctacctgcattttccggagttcgatccggtcattttttctctaggcccggtctccctccactggtacggtttgatgtacctggtgggctttgtctttgcgatgtggctggccacccgtcgggcgaatcgtccgggcagcggctggacgaaaaatgaagtggaaaacctgctctacgcgggcttcctcggcgtcttcctgggcggccgtatcggctacgtgctgttttacaacctgccggtatttcttgccgatccgctgtatctgttccgcgtctgggacggcggcatgtcgttccacggcggcctgatcggcgtgatcctggtgatgattatcttcgccagacgcaccaaacgcaccttcttccaggtctccgattttatcgcgccgctgatcccgtttggtcttggcgccgggcgtctgggcaactttatcaacggcgagctgtggggccgcgtagacccgagcttccactacacgatgattttcccgggctcccgtgccgaagacctggcgctgctgccgacgcatccggaatggcaatcgctgttcgatacctacggcgcgctgccgcgtcacgcgtcgcagctgtacgagctggcgctggaaggcgtggtactgttcctgatcctcaacctgtttatccgtaaaccgcgcccgaccggctccgtttccggtctgttcctgattggctacggcctgttccgcatcatcgtggaattcttccgccagcccgacgcccagttcaccggcggctgggtgcagtacatcagtatggggcagattctttcgatcccgatggtgcttgcgggtatcattatgatggtttgggcttaccgccaccgtccgcagcaacagaattcttgaggaaccatgaaacagtatcttgatttgatgcagaaagtgctcaccgagggcacgccaaaaaatgaccgcaccggcactggcacgatctccattttcggccatcagatgcgttttaacctgcaggaaggcttcccgctggtgaccaccaagcgctgtcatttacgctccatcatccatgaactgctgtggttcctgcagggcgacaccaacatcgcctatctgcatgagaacaacgtcaccatctgggacgagtgggcggatgagaatggcgacctggggccggtctacggcaaacagtggcgttcctggcctgcgccggacggccgccatatagaccagatcagcacggtgatgaaccagctgaaaaacgacccggactcccgccggatcatcgtctcggcatggaacgtcggcgagctggataaaatggcgctggcgccgtgccacgccttcttccagttctacgtcgccgacggcaagctctcctgccagctgtatcagcgttcctgcgatgtgttcctcggcctgccgttcaatatcgccagctacgcgctgctggtgcatatggtggcgcagcagtgcgatctgcaggtcggtgatttcgtctggaccggcggagacacccatctgtacagcaaccatcttgagcagaccaacctgcagctaagccgcgaaccgcgtccgctgccgaagctggtcatcaaacgcaagccggcgtcgatcttcgactaccgctttgaagacttcgagattgaaggttacgatccgcacccgggcattaaagcgccggtggcgatttaaccccccagcagagatgactaaccggcgcccgatggcgccggtttttttatgcccttcgcaccacccgatgggagcgctttccgttaccaccgggagaaggttgttttcacctgccccccaggccacaggtggttgcggtgggcgaagttgggtagacgttcgcaaaaaaatgttcttctgtcgagtatgcaaagcttttttgcgtatctggccgggaaagctattttccgtcgtcgcgccagggccaatcgccgcggcatactcgacgccatgaacagagaacatggctacaccctgatggaaaccctggtaacgctgacactgatgatgctcctcagcgtcggcggcctgtacggctggcagcgctggcagcagcagcaacgactgtggcaaaccgccgtccaggtgcgggattttctgctctttctgcgcgatgacgccaacgcctacaaccgggaccgcgtgcttcgcgtcggccaggacgaagtgggctggtgcctgagcgcggagggggaggggcctgactgcgcctcggggacatccttcacgctgcgcccgcgctggccggggatcacgctggctggcgttacgcctggtctggggttttatggtctgcgcagcaccgcctgggcggggaatctgcggctgcagagcgcggccggcagctggagcattgtgatctcacactgggggcggattcgtttatgccgcagcgacagcgcaggagggtgtcagtgagccgccgcggattttccctggcggaggcgcttatcgccatggccatcggctcgctgctgccgatgggggcctgccgctttctgcctgccctgcagcgtcatattctgcgccagggcgaacagctggccctggagaacgagctgtggcagcgtgtgcatgccgtgggaaaacatctgcagcgcgccgggtactgccggggagcgtgcggcggagccgggctggagctagccgctggcggcgagtgtctgattgtgcgctgggatgcgaacagcaacgggagatgggaaacctcccccgcggcagcggcggagagcaccggctttcgcctgcgcgacggcgcgctggagaccctgcgcggggccagcgactgccgcggcggcggatgggagaaaatcaccaacccggccgccatcgtggtgacgcgcttctcggtacaacgtcaggtcaccccgggcttcgcgccggagctgagcgtgacgctggcggcgcgctccgcgcaacagacgggcctgacgagcgaggttgagcagcgggtgacggggtataacctgtgatccgccagcgtggaatgtcgtcgctgctgatggtgctcctgttgctgaccctcggcagcctgttactcgaggggcttaacctgcagcagcgggcgctgctggcgcaaaccgccagcgaaacgcaagcgatccgcgatacggcgatagcccattccgcgctgcagtggggaaaacagcaggtctggtcggcgcaggtggcgctggcctgccgggagcaggcgccgcagggctggcgcgcctgtctgcgtatcttcggcgacggttcactggtgctcagcagcgccagcggcgaggtgcaggtctggcagtccggcgaggtgcgcggcgggcaggtgcgtttttccgcccacggctggagcgatttttgcccgctcagggaggcgagcttatgtcaaatgccctgaagcgtcagcgggggtttagcctgccggagaccgtgctggcgatggcgctgatggtgctgacggtcaccgcgctgggcggctatcagcgcggaatggcgcaaggaattgtccagttgaaccagacccgtcaactgtggcgcgacgcgtggcgctatagccagctctccgcgccgccgtcgccggcacgcgggcaggtaagccgtatgcagacatcgaggcaaagatgtgtcagcatcacggtaacgatcagtagacccgttgcaaagcgggtgcagatgacccggctgcattgcccggtcagccagtagtcaggagcaattatgttaagggtataccactcaaaccggctggatgttctcgaggcgttgatggagtttatcgtcgagcgccagcggctggatgacccttttcaggccgaaatggtgctggtgcagagtaccggcatggcgcagtggctgcagatgaccctggccgtgcgcttcgggattgccgccaatatcgagttcccgctgccggcgagctttatctgggatatgttcgtgcgcgtcctgaaagatattcctggcgaaagcgccttcagcaagcagagcatgagctggaagctgatgaccctcctgccgcagcacctggaggaagacgattttatcctgctgcgccagtatctgagtgatgacggcgacaagcgcaagctgtttcagctggccgcccgggtggcggacctctatgaccagtacctcgtctatcgcccggagtggctgatgcgctgggaggccggccagcgggtggaaggtctcggcgatgcccagcagtggcaggcgccgctgtggcaggcgctggtgagctacaccgccgagctggggcagccgcagtggcaccgcgccaatctctaccagcgctttatcagtaccctggaaaaagcggacgaaccgcccgccgggctgccgtcgcgcgtcttcatctgcgggatttccgcgctgccgccggtctatcttcaggcgctgcaggcgctgggtaagcatgtcgatgtctatgtcttgtttaccaacccctgccgctactactggggagacattaaggatccggcgttcctggcgaagctgctgtcgcgccagcggcgccatcaccgcgaggcgcgcgcgctacccctgtttcgcgacaccgagcaggcgccggggttgtttaatgacgccggggaacaggatgtcggcaacccgttgctcgcctcctgggggaaactggggcgcgactatatctacctgctggcggggctggagcgctatgaggagctggacgcttttgtcgacatcgcccccgataacctgttgcataacctgcagtcggatatccttgaactacgcaacgcggcggtggccgggcagagcgcagaggcattcgcccacagtcgcgacaaacgtccgctgacgctggatgaccgcagtctgagcattcacgtctgccacagtccgcagcgcgaagtggaggttctgcacgataggctactggcgatgctggaggcggatccgacgctcacgccgcgggatatcatcgtcatggtggcggatatcgacagctacagcccctatatacaggcggtgtttggcgccgccagcggcgatcgctggctgccgtgggcgatctccgaccgtcgcgcccgagagtcgcacccggtgctgcaggcgtttattacgctgctctcactgccggacagccgcttcgccagtgaagatgtgctggcgctgctggacgtcccggtgctggcggcgcgctttaatatcacggaagaagggctgcgctacctgcgccagtgggtgaacgagtccggcgtccgctggggaatggatgacgacaacgtccgtgagctggacctgccggcgaccgggcagcatacctggcggttcggcctcacccgcatgctgttgggctacgcgatggacagccgcgagggagaatggcagtcggtgctgccgtatgacgaatccagcggtttgatcgccgagctggtgggcaacctcgcgtcgctgctgatgcagcttaatctgtggcgacgcggcctggcccagcagcggccgctggcggagtggctgccggtctgtcgcgatctgctgaatgactttttcctgccggacagtgagaccgaagcggcgctggcgctgattgagcagcagtggctggcggttattgatagcggtctggaggcgcagtatggcgagcaggtgccgctgacgctgctgcgcgatgagctggcccagcgcctcgatcagcagcggatcagccagcgctttcttgccggcccggtcaatatctgtaccctgatgccgatgcgttcgatcccctttaaggtggtgtgcctgctggggatgaatgacggggtttatccgcgcacgctaccgccgctgggctttgatttaatgagccagaagccgcagcgcggcgaccgcagccggcgcgatgatgaccgctatctgttcctcgaagcgctgatgtccgccgagcagacgctgtatatcagctatatcggccgttcgatccaggacaacagcgagcgttttccttcggtgctggtgcaggagctggtggattatatcggccagagtcactgtctcgccggtgacgaagagcttgactgcgacgccagcgaagcgcgggttaaagcccacatcacccatctgcatacgcgcatgccgttcgacgttgccaatttccaggaagacgagaacaagagctacgctcgtgaatggctggcggccgccggccagcagggagaggcgcatagcgattttatacagccgctcaccgcgccgccgattgacagcctgccgttcgatcagctcctgcgcttctggcagcacccggtacgcgcgttctttcagcagcgtttgcgggtcaatttccgcgccgaagaggacgatattccagacgacgagccgttcactcttgaagggctgagccgttatcaactgaatcagcaactgctcaatacgcttattgaggagcaggacgtctcggctatgttccgccgctttcgcgccgccggcgagctgccgtatggcgcctttggcgagctggtctgggagacgcagcgcctggagatgcaggcgctggccgagcgggtgatggccgagcgccagcaggcgcagagcatggagatcgatctgcagtgcggcggcgtgaacctgaccggctggctgcagcaggtgcagccggacggtctgctgcgctggcggccttcgctgctgagcgtctcccaggggatgcaactttggctggaacaccttgtctactgcgccagcggcggcaccggcgagagccggctgtttgtgcggaaagagggagagtggcgctttccggcgctggcgcccgccgaggcgcaggcgtaccttaacgagctggtggatggctatttgctggggatgtcgcagccgctgctgctgctgccggaaagcggtggcgcctggctgaaagcctgttacgacgccgaaaaggatgtcatcttaatggacgaagagacgcagcagaaagcgcggagcaaattcctgcagacctacgaagggaacatggtggtcagcggggagggcgccgatatctggtatcaacgcctgtggcgttcgctggagccggcgcattacgaagaaatcattgcccagacgcagcgttatctgttaccgctatatcgttaccatcggtccacacaaatttaaatagtataaaaattgcgcagtgaatgacggttcatttaatatgcgcaacgtatcacggactgatggacataaaaggctgcacgctgtgcagcgcaagtttgttaatgatgaggttcgtgaatgccccgcagtttatggttcaaggtttttgttgtgctggccgccctctgggcgccgtttagtcaggccgacaccggatggcagccgattcaggagacgatccgcaaaagcgaaaaagatacgcgtcagtatcaggcgatccgccttgataacgacatggtcgtgctgctggtttccgatccgcaggcggtgaaatcgctgtcggcgctggtggtgccggtgggatccctgcaggatccggcagatcatcaggggctggcgcattttctggaacatatgacgctgatggggtcgcaaaaatatccccagcctgacagccttgcagagtttcttaagctgcacggcggcagccataacgccagtaccgcgccctaccgcaccgcgttttatcttgaagtggaaaatgatgcgctggacggggccgtagatcgcctggccgacgccatcgccgcgccgctgctggataaaaaatatgccgaccgcgaacgtaacgcggtcaacgccgagctgacgatggcccggacgcgagacgggatgcgcatggcccaggtcagcgcggagaccatcaacccggctcacccggcggcccacttctccggcggcaacctcgagacgctcagcgataagcccggcagcccggtgcttgatgcgctgcacaccttccgcgatagctggtactccgccaatctgatgaaagcggtgatctacagcaacaagccgttgccggcgctggcgcgcatggctgcggacacctttggccgcgtgccgaatcgtcagatcagcaggccggatattaccgtcccggtggtcacggatgcgcaaaaaggcatcattattcactatgtgccggcgatgccgcgtaaagtgctgcgcgtcgagtttcgcatcgacaacaacagcgatcgcttccgcagcaaaaccgatgagctggtcacctatcttatcggcaaccgcagcccgggcacgctctctgactggttgcaaaaacagggtctggcggaaggtatccgcgccgattccgatccggtggtaaacggcaacagcggcgtactggcgatctcagccaccctcaccgacaaaggcctggcgcaccgcgatgaagtgacggcggccattttcagctacctcgacctcctgcgtactcagggcatcgacaaacgctatttcgacgaactggcgcatgtgctggcgctcgatttccgctatccgtcgatcaaccgcgacatggactacgtggaatggctggcggacaccatgatccgggtgccggtcgagcatgcgctggacgtggtgaatattgccgaccagtacgacccgcaggcgatcaaagaccggctggcgatgatgaccccgcagaacgcccgcatctggtatatcagcccccaggagccgcataacaagacggcttactttgtcgatgcgccgtatcaggtggataagattagcgagcagacgttcgctgactggcagcacaaatcgcaggccatccagctgcagctgccggcgctcaacccctatattccggatgacttcacccttatcaaaagcgataaagcctggccgcatccgcagctgatccttgatgaaccgacgctgcgggtggtgtatgccccgagccagtattttgccagcgagccgaaggcggacatctccctggtgctgcgtaatccccaggcgatggacagcgctcgccggcaggtgatgtttgccctcaacgattatctcgccggcatcgccctcgaccagctcagtaaccaggcggcggtcggcggcatttcgttctctaccggcgctaataacggattaatggtcaatgccaacggctatacccagcatcttccggcgctgttcagcgatctgctgcagggatacttcagctatacgccgaccgaggagcagctggagcaggccaaatcctggtatgcgcagatgatggattccgccgagaaaggcaaagcctacgatcaggcgataatgccgatccagatggtctcgcaggtgccgtacttccagcgcgaagtgcgccgggcgctgctgccctccattacccttaaagaggtgctcgactaccgcgccaacctgaaaaccagggggcgtcctgaactgatggtgatcggcaatatgaccgccgatgccgccacgaccctggcccgccagatccagcagcagctgggcgccgacggcaacgaatggtgccgcaataaagacgtggtggtgaaccgacagcagctggcgatcttcaacaaagcgggcaatagcaccgactccgcgctggccgcggtgtttgcgccgcccaacgtggatgagttcagcagcaccgccgccagcaccctgctggggcagatcattcagccgtggttctacaaccagctgcgtactgaagagcagctcggctacgcggtctttgccttcccgatgaacgtggggcgccagtggggcatgggcttcctgctgcagagtagcgataagcagccggccttcctctggcagcggttccaggccttcttccccaccgcggaggcgaagctgcgggcgatgaagccggaagagtttgctcagctccagcaggcggtgataagccagatgctgcaggcgccgcagacgctgggcgatgaagcctcgaaactgagcaaagatttcgatcgcggtaatatgcgttttgattcacgtgataaagtagtggctcagattaaactgctgacgccgcaaaaacttgccgacttcttccatcagacggtggtggatccgcagggcatgacgatcttgtcccagatttccggtagccagaatggcaaagcggactatgcccagccgaaaggcggcaaagtgtgggaaaacgtcagcgcattgcagcaatccttacccctgatgcgagagaatgaatgaccgacaccgctgagtctttggatcccctgcgcttgcccctgatcggcgagcgcctgatagaagcctctgcgggcaccggaaaaacctttaccatcgccgcgctgtatctgcggctgctgttggggctgggcggtgaggccgcctatccccgcgccatcagcgttgaagaactgctggtggtgacctttaccgaggcggcgaccgaagagctgcgcggccgtatccgcagcaacatccacgaactgcgcatcgcctgcctgcgcggcgaatccgacaatccgctctacagcgcgttgttggcggagatcgccgataaagacgacgccgcgaagacgctgctgctggctgaacggcagatggacgaggcggcggtattcaccatccacggcttttgccaacggatgctgagccttaacgccttcgagtcgggcatgctgttcgagcaacagctgatcgaggatgaatcccgcctgcgctatcaggcctgcgccgatttctggcgccgccactgctatcccctgacccgcgatatcgctgcggtgatccacgacgtctggaaagggccgcgcgatctgctgaagtcccttgaccgctggctgcagggcgaagcgccgcagcttaagtcgccgccagcccctaacgagacgctggccgaacgccatcagcagatcatcgcccgcattgactcgctcaagcagcagtggcgcgagcaggtgggcgagatcgaaggcgtgctggaaaattccggccttgaccggcggaagtttaatcgcggcaaccagggcaagtggatggagaaagtgaacgcctgggcgcaggaagagacgttaagctaccagctgcctgacgcgctggagaaatttgcccagtcgtttctgctcgagcgcaccaaagccggtggcgaaccgccggtgcatcccctgtttagcgccgtagagtcgttgctggcctcctcgctgacgctcaccgatctggtgctggcgagagcgatggtcgagatccgcgatgcggtcgcccgcgaaaagcgccgccgcggcgagctggggtttgacgatatgctcagccggcttgacgaggcgctgcgcggcgacagcggcgagacgctggccagcgccattcgccagcgttttccggtggcgatgatcgatgaatttcaggacaccgaccctcagcagtaccggatttttcgccgcatctggcgccggcagccggagacggctctgctgctgatcggcgatccgaagcaggccatctacgcctttcgcggcgccgatatctttacctatatgaaagcgcgcggcgacgttgccgcgcactacaccctcgataccaactggcgctcctcgccgggcatggtgggcagcgtcaatcggctgttcagcctcagcgataaccccttcatgttccacgagatcccgttcctgccggtgaaggcggcggcgaagaacaaggggctgcgctttaccgttgacgcggcggacgtaccggcgatgaacgtctggctgatgcccggcgccactgtcgggtctggcgattatcagacctttatggcgcagctctgcgccacgcagatccgcgactggctgagcgccggtcagcaggggcgcgcgctgctgtggcgcggggaaacctcgcgcccggtacaggcttcggatattaccgtgctggtgcgcaaccggctggaggcggcgcaggtgcgtgaagcgctgcagacgctgggcattccctcagtctacctctctaaccgcgacagcgtttttgagacgcttgaggcccaggagctgctctggctgctgcaggcggtgctggccccggagcgggaaaataccctgcgcagcgcgctggcgacgtcgatgtttggcctgaccgcgctggatattgaaaacctgaaccaggacgagcaggcgtgggacgcgctggtggaagagttcagcgaataccgccagatttggcggcagcgcggggtgatgccgatgctgcgggcgttgatgacagcccagcatatcgccgagaacctgctggcgacccgcggcggcgagcggcgtttaaccgacattctgcacatcagcgaactgctgcaggaggcggccagccagctggaaagcgagcatgccctggtgcgctggctggcgcagcatatcgccgagccggacagcaacgccgccagccagcagatgcgtctcgaaagcgataagcacctggtgcaaattgtcaccattcacaagtcaaaagggctggaataccccctggtctggctgccgtttatcgcccggtttcgtaaacaggaccaggcgttttaccacgatcgcgagacgttcgcggcggtgctggatctgggccaggatgaggccagcctcgagctggcggaggcggaacgactggcggaagatctgcgcctgctgtacgtcgccctgacccgcgcggtctggcactgcagcctcggcgtggcgccgctcagcagccggaaatccggcaacagcgatttccacctcagcgcgctgggacggctgctgcaggcgggcgaagccatggacgccgccgggctggctgcgcggctggcggacttctgtcatggcgatattgcattacagattccgggcgaactggatctcaccccgtggcaggcgcccgcggcgaccatcccgcgattgtcggcgcgcgagctgcagcgccgcatcgccgacgactggcgggtgaccagttactccggactgcagcagcatggtttcagcggcgggcaggatttgctgccgcgtctggatgttgatgccgccggcgtcggcgaagtcgtggaagagccgcagctgactccgcaccagttcccgcgcggcgccgcgccggggaccttcctgcacagcctgtttgaggagctggacttcacccagccggtgccggaagggtggatggcggagaagctgcagctgagcgggtttgacgcgcagtgggcgccggtgctgaccgactggctggggggcgtgctgaagacccgcctgccggggccggatatcgcgctcaatcagcttgcggcgcgggataaacaggtggagatggcattttacctgcccatcgcccagctgctgacggcggagcgccttgacgcgcttatccgccagtacgatcccctctctgccgacacgccgccgctggatttccgccaggtgcgcggcatgctgaagggctttatcgatctggtcttccgtcacgaaggccgttattacctgctggattacaaatccaactggctgggggaagatcgcgaggcctacacccggccggcgatggagcaggcgatgcgtgcccaccgctacgatctacagtatcagctgtatagcctggcgctgcaccgctatctgcgccaccggctggccgattatgactatgaccgccacttcggcggcgtgatttatcttttcctgcgcggcatggacgggcaggagggggggcaggggatcttcaccacccggccggtgcgaccgctgattgacggtctggatcagctttttgccggagaaactcaggaggaggcctcatgactttcgaacaactactgctggcggcggtggagcagcgtctgctgcggccgctggacgtccagtttgccctgatggtggcgcaaaacgacccgccggcggtcaagctggcggcggccttgctgagccgggatgccggcgaggggcacgtctgtctgccgctctcgcggttgagcggcgacgaggcgctgagcggtaaagcgggggagatccgcgatcggctgctggccgaagccggcgcgccggaggactggcccgggctactgctcgcttcgtcggcggtgagctgcggcgatgctccggcgccgatgattttgtgcggcgaccggctctatctgaatcggatgtggcgcaacgagctgaccgtcgcccgcttcttcaatgaagccaaccgggtgctggagatggatgaggcccggctggcgtcaaccctgaatgccctgttccctgccaccggcgaaaccgactggcaaaaagtggccgcggcggtggcgctgacccgccgcatctcagtgatctccggcggtcccgggaccgggaagaccaccaccgtggcgaagcttctggcggcgctgatccagatcgaagacagcccgcgctgtcgtattcgcctggcggcgccaaccgggaaagcggcggcgcgtctgaccgaatcgctgggcgcggcgctgagaaaattgccgctgaccgacgcgcagaaagcgttgattcccaccgaggccagcacgctgcatcgtctgctgggcgcccagccaggcagccagcggatgcgctatcacgccggcaacccgctgcatctggacgtgctggtggtggatgaagcctcgatgatcgacctgccgatgatgtcgcggcttatcgacgcgctgccggcccacgggcgggtgattttcctcggcgatcgcgaccagctggcctccgtagaagcgggggcggtgctgggggatatctgcgcctgggcgagttcgggctataccgccgcgcgggcgcaggagctgacccggctgaccggttcgccggtgccggcgggcgagggggctatcgcgggcgcgctgagagacagtttgtgcctgctgcaaaagagctatcgcttcggcagtcactccggcatcgggagcctggcgcgggcggtgaacgctggcgcgcgcgcggaggtgaaggccacgctgcgccagccgtttgacgatatcgcgcttcatcccctcagcacgaccgaagagtacgaagccatgctcggcgcggctcagcagggctatgagcgctacctgcagctgcgccgcgagcgggccgaaccgcaggccatgctggccgctttcagcgaattccagctgctgtgcgcgctgcgcgaggggccgtacggcgtgagcggcgtcaatgagcggctggagcagcggctcaaccgccagcgggcgatcgccctgccgcgccactctcgctggtatgatggccgaccgatcatgatatcgcgcaacgacagcgcgctggggctgtttaacggcgatatcggcatcgccctggagcgcaacggcgagctgcgggtgtggttcctgatgcccgacggcgccatcaagtcggtgcagccgagccgtctgccggagcatgataccgcctgggcgatgaccgtgcataaatcgcagggctcggagttcgaacacgcggcgctgatcctgccggcgcgcagcgtcccgctggtgacccgcgaactggtctacacggcgatcacccgcgcgaaacggcggttgtcgctctatgccgacgagcaggtgctctcccaggccattgtgacgcgcaccgaacggcgcagcggcctggcggagattttcgccgggcgcgaagccccctgagacgccgggtccgggcgatggaaaatgctgcagccgttgcccgggctggcggaaaaatcagtaactgaagaacagagggataagccagagcgccgagatcgagttcatggcgaaaaagcggactgctgcgccgccggccagcggtggggtggaacagcgggcacaaaaaatcaccagcgaggagatgagaagattcatgccggacgtcagggccagcagaaataatatcgcgatggcggcgccgagcgcggcatagccatgctgatgatggcgctggttatcccagaggagcagtatcatcagcaaccacggatagagggcgaccgcggtggtaatgagattaatatgtctgaccagccagttcggtttggtttccattctttaagcgatccttgctgggcgggtggcggccgcggcgccagtcgacgtcctgtcgacagccaatagcatatcggtgagccagcgagaaagaaatggcctgcgcggaaaccaggaatttcgcccgcgtgcgtacgccaggctggcgggaagaggggcgggagaccggccggggataaagcgataagcgtcgcgctatcccgggccgttagatagagaggagaagggcttaagcgaggtcggccatcagcaccttcgaccggcgctgatagttatacatctgctttttactctccggcagcaggtcgatatccaccggcgtgaagccgcgctcctggaaccagtggatgctgcgggtggttaacacgaacagcttgctcagtcccatctgcctggcctgagcggcaatacgctccagcagcacctctccccgcgacgagctccggtaatccggatgcaccgccacgcaggccatttcgccgatcttctcttccgggaaaggatagagggcggcgcaggcgatggtggtgttatcgcgctgaataatggtgaatttgtcgatctccatctccagctgttcgcgggaacggcgtaccagaatgccctgctgctcgagcgggcttatcagctcaagaataccgccgatatcattgatggtcgcccgacggatctgctccgcgctctccatgacgatctgggtgccgatgccgtcgcgtgaaaacagctcctgcagcagcgcgccattttcctgatagctgatcaggtggcagcgccgtacgccgctgcggcaggccttcaccgccccgcgcaggaagcgcacggtgccggagttatagtcttcgtctgcttccagctcttcgacgcgggcttgcgcctcattagggaacagttcggagacaatttccccggcctggttgtaaaccccttgcgacgaacagaagccgatcattttctccgccttcagcttgatggccagctgggtagctatctcttccgaagtcaggttaaagctctcgccggtgaccgacaccgcgaccggccccatcaggacaatggcgccgctgtcgagctgacgatgaatcgcctcttcgtcaatgcggcgaatgcgtccgctgtggcaataatcgacgccgtcatcgacgcccagcggctgggcaatgataaagttgccgctgacaacgttgatatgggccccctgcagcggggtgttgttgaggctcatcgacagacgggcggtgatctccagctgcagcatccccgccgcctgcttaaccagctccagcgttttggcgtcagtcactcgcgtctgcttgtgatagaccggctcgtgatggtgctcggcgaggttagcgtcaatctgcgggcgggcgccatagaccaccaccaggcgaatgcccaggctatgcaataatcctatgtcattgacaatatttgagaaattttcatgctcaatggcttcgccgcccagcatgatgacaaacgtttttccccgatgggcattaatatagggaacagaatggcggaatccttctaccagttcagtgcgacgttccttcaccatgacaaaccctcaatgcatgattattcgtaattattgtatttttattctgttttgccgttaaacgcaagccccaatttgaggctaagccgcgaaaaacatgtgacccggcgcagggtgtcaatgaatgtttacccttttatagatgacaggttatatgcctttcgttaaagtttctggtcaatctgtttgttttgggtataaatgcgtttttattgcttgggagtggcatgtcgggaaacaactctggattaagccgtcgccgtttattgcagggggcgggcgccatgtggttaatgagcgtgagccctgtcgggctggccgccgccgcgcgggtggtcgctgttcgcgtctggccagcatcgacctacacccgcgtcacggtggaatcgaatcatgtgctgaaataccggcagtttgccctcagtaatccggaacgggtagtggtcgatctggagggggttaacctgaactcggtactgaagggcatgggggggcagatccgcgctgacgatccctttattaagtccgcccgggtgggccagtttgatccgcaaaccgtgcgcatggtcttcgaactcaagcagaacgttaagccgcagctgtttgccctcgcgccggtggccggctttaaagagcgtctggtgatggatctctaccccgccaacgctaccgatgttcaggatccgctgctggcgctgctcgaggattacaacaaaggcgatctggagcggcaggtgccgccggcgcaaagcgggccgcagccgggcaaagccgggcgcgaccggccgattgtcatcatgctcgatcccggacacggcggcgaagactccggcgccgtgggaaagtatcgcacccgcgaaaaagacgtggtgctgcagattgcccgtcgcctgcgggcgctgatcgacaaagaaggcaatatgaaggcctatatgacccgcaacgaagacgtgttcatcccgttgaaagtgcgtgtcgccaaggcgcagaagcagcgcgccgacctgttcgtgtcgattcacgccgatgcctttaccagccgccagcccagcggctcttcggtgtttgccctctccaccaagggggccaccagtaccgcggcaaaatatctcgcccagacgcagaacgcctcggatctgatcggtggggtcagcaagagcggcgaccgctatgtcgaccacaccatgttcgatatggtgcagtctctcaccatcgctgacagcctcaaatttggcaaggcggtgctggagaaaatgggcaatatcaataacctgcacaagaaccgggtagaacaggcgggctttgcggtgctgaaggcgcctgacatcccctccattctggtggagacggcgtttatcagtaacgtggaagaagagcgaaagctgaaaacggccaaattccagcaggaggtggccgagtcgatcctcgccgggattaaagcctactttgccgatggcgcgacgctggcccgccgcggataaccacacaggaaagggacatggccttactgaaaagcgcccatggcggtaacacccgcgaggccgccgccctgctgggcattgcgcccggcgagctgctggattttagcgccaacattaatccgctggggatgcccgcctcgctcaggcaggcgatcgttgacaacccaggctgcgccgaacgctaccctgacgtcgagtatcaacagctgcatcaggcgctggctgcccaccatcagttgccggcggcgcatatcctcgccggcaacggcgaaactgaatcgatcttcaccctcgtccacggccttaagccgcggcgggcgatgatcgtcattcccggtttcgcggagtaccggcgggcgctgcagacggtggactgcgaggtggtggagtatgccctgcgggagcgcgatggctggcagctgaccgacgcgatcctcgatgccctgactccggcgctggactgcctgtttctctgcaccccgaacaaccccaccggcctgctgccggagcggggcctgctggaagccattgcgcagcgctgccgggcgctgaacatcagcctgatcctcgatgaggccttcctcgactttatccccgaccagccggggtttattcctctgctggcgcagcatccgcacgtctgggttctgcgatcgctgaccaaattttatgccattccggggctgcgtctcggctacctgctgaacgctgatgcccaggcggtggcccgactgcgcgcgcgacaaatgccgtggtccatcaacgcctatgccgccctggccggggaaattattctccaggatcgggcgtatcagcgggccacctggcagtggctgcaggaggagggagcgcgtttctatgcgcagctgcaggagatggccgggctgaccgtgtggcccgggcgtgctaactacctgttcttgcgctgcgacagagccgattttgacctgcaatatgccctgctgcgccagcatgtgctgatccgcagctgcgccaactacccggggctggatagccgctatttccgcgtggcgatccgcagcgccgaggaaaacgaccagctgctggcggcgttgcgccgggtgctggcctgaggcctactgcaggatgacgcccccgggcaccatcgccagcagatgctgctgcggccagtgggcggcgatgtcgctgtctgccagccgccattgcagaaattcgacgtcatgccgacggcggtccagcagcaggccgacgacgctgccgctgtgcgccacgttgagaccatagagccctgcgctttccaccaggtccagcagcgcgtcaaaccccggcttaggcaacagctgctggctggcaatggcgctgatggttgctgcttcgcccagcagctgcgggctgccgcagtggcaggcctgttgaactttctcccacgccagctgcagccgggaggcgtttgccaacaggcccggctcgcgcggcagctggtgatagtcggtggtgcgcagtgtcagcgggctctccagcactaacaggtcgagcgccggcggagggggacaggcgatttgcgtggcggcggtattatggtcgaacagcgtcagctggcgaaacagggtgctgtcggtaggctccagcgcgacgcacaggcgcgccagcgtcggctcatccagtagatggcccagatgatgggcggtggcgacggcggtggcagcgatatcggcggtgctgctggccatccctttggccactgggatcgttgagtgcagggtgatgcggatctgctggctcagcgctggggggtagccccagtgggccagcagctggtcgaccatcgcccgcgacagcggccgctcgtcttttcgcggtactccggtctcgacctcgacggtgctgtaccagtccaccggacaggagaccagcttttcgctgccgaggatccagccctggataagttctccgcacgaggcgggacattgtgcaacagccacgttttcacctttccgcttaccttcgccagggcgcatagtggcatggcgacccgccggttaccatgattctccgcaagaggaggcgcgtcgtttatgccgacaccgccagctcgcgcgcctgcggcaatgcaagacgcatgacgtcgcgggcaatcataagctcttcattggtgttgatcaccgccactttgaccagcgcattatccgcctgaataaaggtcgcgctccgctggtttttctcgtcgtccagcgcgaggccgagaaaatgcaaattgcggcagatcgccgcccgcgcccgggcggaattctcgcctatgccgccggtaaagatcagcgcgtccagacctcccatctgcatgatatagctgccgatagtcgcgcgaatgcgttcggcaaacagcgacagcgccagagccgcccgttcgttgccggcgtcggctgcctgttcgacgtcgcggtaatcagaggacacgccggagacgcccagcagcccggattcattattcagcagctggctgagctgctgggcggatttcccttctttctccaccagccagggaagaatcgacgggtcgatatcgccgctgcgggtgcccatcatcaccccggactggggagtaaagcccattgaggtattcaccgattgcccgcctttgatggcgcagacgctacagccattgcccagatggcagcttactacccgcagggcgctcagcggtacgcccagcttttccgccagcgcgctgctgacatagtgatggctggtaccgtgaaaaccgtagcggcgaatgcccagctcggcgtaataacgccaggggaggggatagagccaggcctccggcgccagggtctggtgaaaggcggtatcaaaaaccgccaccgccggtaccgcgggtaacagctggcgaaagagacgtatgcccagcgcattgaccgggttatgcaacggcgccagctccgccaggcgctcgatctcccgcagggtatcgtcgcagaccagcgcggcgtctttgaagcgttcgccgccgtgggcgacgcggtggccaacgccgtcgatctcctgcaggctgctgaggatcccgcggccggtcagcgcctccagcagcagggtcactgcctcatggtgatcggcgatgggcagcgtctcctgccatttctgtgccgacgttttcagcgtgaagcgggcctcgggcaggccgatacgttcgatcaacccctgacagagcaacgccccctgcggcatgttaagcagctgaaacttcagggaggagctgccggcgttaatcgccatgattttataggtcattgatattcctctgcattcaggcaggcgaacaggtcatcaagcccgtcgccggttaacgcgctggtgataaaaatatgtccggcgcccgccgcctcgagccatgtccggacctgttgcagacggggcggggcggctaaatcggctttggtgatcaccccgataaccgggcggttcatcggggcggtaaaccccggagaaaagggtgaccagggcgcatcggcattcagtaccagcgcgatgacatcggcctcgcaggcgctggttaacagcgcgctgtacaggcagcgattttccagatattccccgggggtatcgatggtggccggcgtccagacgatggcctgggttttctgatagcgcagggtttcgccgcgcaatacctgggtcagcgaagttttgccgcactggctgggtccgataagcatcaggcgtttcatgggctcaggtccgggtaattgggcaggcggtgaagcgcatcagctcaccgagggtgcgggtgacctgcctgagcgcgtactccacggcggagacatcgccggtcaacaccaccgcgccggtgaagcgatcgagaaaaccgatctccaccgcgccggacttggtagcgatgtcgcaggcgataatcgatgcttcactgggggtaatggtaagaatgccgatggcggagaccgcgtccggcagacccagctttttgaacagatctttgccaggattggcaatgagatgcgccagagtaacctgtttgcccgggacatactcctggatcatgcgttcggtaggggtttgcggttccattatccctccatcagctgttgccacagcgcatcgtgcggtcgcgggatcactgcccggtgaaccagtaatcctttctcgcctgcgctgtcgctggccaccgtgacggcgttgtcgacatcggcgatatcacccgccaccaccatgtagcatttgccgccgataccaaacgccatatggacccgcaccagggtgacgttggccgctttcaccgcgcggtcggcggcgctgatgcacgccgccacgctccaggtttcgacgatccccgccgcctgccgctgcccgaccacgttgagaccgctgatcgccggtagtacgctggggtgaatgttggccagcaccaggctgtccaccagcatctccccggcgcgcgcggtgccggcggcgattgcctgctgcacggcgccgacgtcgccgccgagcatcagcaggaatttcccggggcaaagggttctgcagagcaggagctgtacgttcgcgcttttcagcatgacgtcgcccagctccatccccctggcgatgctggtcagttctaaaattccgatagcctgggtcatgattaacctcttacaagcgtaatggcctgctccgtgatggcggagaccaggccgtcaatactggcgtgcaccggcgcgccgagggcgtcggtggggatatccgccagcacctggccgcgcgttacccgctctcccggcgcgacgcagggcacggcgctgatgccgatatgctggcgcaggggcagggtgacgcaggccacctccggttccaccgccctcagcggcgcttcctgataccagggatcaagtcccagtttgctgatgagccgcttgaccggcaccaggcggtgcttcgccatctcgtccgccggacgcagcggtccgtcgtagcgcaggtttttcgccctcagctcacgtttcagcagacggttgatgcgcatgggggaaatacccaccgggcaggcgacgctctcgcaaacgttgcactccgaacaggtcagggcgctgagcagcagcgacggggtggccgcctggcgatagttcactgcccgcaccagcagatgaggggaaagctcatggccgatcaggtgccgggggcataaatctgtgcataaacggcactgttcacagacggtgcgggcgatggcgagcagcgttcgttcatcctgccgccgtcgctggatcaatggatggttgcccgggagcaccagcaggccgccggtggttttggtgaccggtgtctcgagggaggtaataagcgagcccatcatcggaccgccgttgataaaccccggatcgtcaaccgtcgcgccgccggccagatccagcacctcgcgcagcgatatacccagtggtacggccagcgtcagcggacgggcgacggcgccattgacggtcaacgtccggcgagttaccggatagccctgttccacggctctggcgatattgagcaccgtctgcacgttattgaccaccacgccgacgctgaccggcagcgcggcaggtggtacgcggcgtcccgtcgccagccagatagtgagcacctcatccccggccggatagacgtcaggcagaatatgcagccgggcccattccgggagtcgtggggttaatgccgcaatcgccggagcatatttcgccttcagggcaatgatcccttcccgggcgccagtggcggtcatcgcgtaacccaggccgcgaatcagtcggtcagcctgctgagccatcagctgttggtcaaccttcagcatcggttcgcattcggcggcgttcaccagcacggtgtccacccgggcctgcagtttgatgtgggtcggaaagcctgcgccaccggctcctacgacgccagcggcccgaacgcgttcgcggatctccgctgcatcaatgcttgatagtggcactatcgcttcactcattgcaggttctccagcagttgcgcgatggccgcgccatcgaccggacgcgggttggtgcgcagggtggcgtcggccagcgtggccggcaccatggcgggaattcgcgataagaaaaggggatacttttcctgcagcgcgcccttgagggtgggaatggcgcactgctgtttcagcgtttccaccgcggtaagcagcgcctggaaagcctcctgttcgccagcttcgggcgggcagaagcggcaggccctggccaggcgcgcatagcgcttagccgctcgcggctcgccggcattgaagcggatcaccgcggtcagcagcagcgcattggccaggccatgggggaggtgaaactggccgccaagctgatgggcgatcgcatgattgagcccaaggccagcctggctaaaggccataccggcgagggttgatgcattgtgcattttgctgcgggtcgcaatgcagtcgccctgacgaatcgcaacgggcagggcgcgaaacaccagccttacggccttttccgccagcgcatcggtaaaatcggtggcctgcggcgagacccatgcctccagggcgtgggtcagcgcgtccagcccggtatgggctgtgatggtgggcggtacgctaaccaccagcgtcgggtcgatgatcgccatgtcgggacagagcgcctcatggaacagcgggtatttgatccctttttccgggtcgctgatgacgcaggcgctggtcacttccgaaccggtaccgctggtggtggggatcgccacgcaggtgtcgacaggcagaccgccctgctggctgaaccagacgatagccttggcggcatccatcgccgagccgccgccgaagccgatcaccacctgcggacgcagggcctgcatctgcgctatccctttcgccacggtgtgaatggtcggatccggcgtaatatcgctgaacacgctgacgcggttgctggcgggcagcgcggcgcgcagtcggtcaagcagcggcgagcgcgccaggaagccgtcgcagacgatccagatgtgctgatggctaaagcgctgcagcgcggccaggctgcccgggccgctgtagaggcgcgtttgcagagaaaaggtatgcatggcgcccccggttagcgaatggaaaaaccgttggtcaacacgcagcgccgcaggcgggcgaacgtccgcgcggaggtggtgccttctccggttggcgtggcgatggtgaaggtggtaaacccttcgccgccgacgccgattcccgcgtaagacgggccatttttgacaaaaatggaggtctgcagcgtgcgtgccgccagattgagccgcgagacattctgcgagtgcataatggcggtgtggtgcagaccctcctcaacgcgcagggccagcgccagggcgctgtcaaagtcggcgaccctgacgatcggcagcaccggcatcagctgctcgcaggtcacccaggggtcgttcgcctccacctcggctatcagcaggcgaggagggcgaggcggaacggcgagacccgccgccgccagcagcgcagccgggcttttaccgaccagttttttattcgccgcgccgtcgggcaggcagacggcacgcagggtatcggcctcctgtcggctcaacagcagcgcgtcaaaatcctgcatctgctggatcaggcggtcagcgacggaggcgacgacgatcaggcttttttcggcgatacagggcaggttgtaatcgaaggcggcgccgctgatgatatcttcggcggctttgacgagatcggcggtttcatcaacgatgcacggcggattgccggcgccagcgccgatcacttttttaccgcttttcatgcccatcgccacaatgccagggccaccggtgatagccagaacggcaatcagcgggtgggacatcatttgctgggtggcttcaaaggtcggctcggcaacggtcaccaccaggttacggatcccgctgcagcggtaggcgatctcttcgatcctggcgataagcttcaacgagacctttttcgcgccgggatgggggctgaaatagacgctgttacccgccgccagcatgctgatactgttgttgataatggtttccgttgggttggtgctgggcgccacggcgccaataaccccgaacggcgagtactcaaacagcaccatcccgccatcgccggtgagggcgctggtagtgagatcctctatgcccggcgtgttttcaagagcggctttatttttcagatatttatcttctttgttgcctatgccggtttccgtggcgctctcttccgccaacgtcgccagctcgggggccagcgtctcccgcagggcgctgataatggcgctgcgggtttttagcggacactgctgatagcggagaaaagcctgatgagcggcgtcgatggcgctgccgacatcgcagaaaatgccctgctcttgctgaggggcagggggcgtcggcgcgagcttttcactgaggatggtgcggataagggtttccagttctgctgtattcattgatgagttctcacgttaatggccgccatggcagcctgtgcaatagccatatcctgctcgacgctgccgccgctaatgccgatgccggctattagctggccatcgcgccacagcggatatccgccgccaaaggtgacgactttgccctgcagatggctctccagaccgtacagcgcagcgcctggctgtacggtcgtcgcgagctcgtgggtggcggttttcatggcgacggcggtccaggcttttttcggcgccagctcgctgctgaccagcagcgcatcgggcattcgccaggtcacggtttcggtgccgtgtgcgtcaacgatgctgaccaccaccggcacctgcagctggcgggcgtgttcaatggcctgacggatgagctgatgcagctcgtaaaaggagagcgacccggcctgggctttgggcgcgtcgggcgcaggcgacccgctggcggccagatagcgggccgcgatctccgtcacaaggcggcgctggtgagcggcatgatcctcgctgcgcgccagggcatacaggcagtcagataagcggttcagataacgcagcagtatctgacggatagtaacctctgccgccagctcgaccagccggcgctccgcccgtctggcaacggtgcgggccaggtgcagacggctggcggcttcacagcgtccgggcaatacaaactggtgcagcgccggcacgcgggccatctcgcgatcgatggtctgctccagcagggcaatctcttcgctgctgatatagcgcttacccggtgatggctgttcgctgtcgctggcgagctccgcgctgaaccaaaaaatgtgctgctgcagggcttcgagcagggtgcgctgttcctcttcagcgacggcgcagacgcacaggctcagcatggcgttcagttcatccagggtgccgtaggcttcgacgcgcggatgcgtcttgctgacccgctggccggtaaagagtgatgtactgccggcatcgccggttcgggtatagatagccacaggcgcccccttagcgtgaaagtgagtcaacaatgcccacgacggcaagatcgatggcctcattcgggccgctgaaaacgtggcgtgcgctcgagccgctgcagagcagcaccagctcgccgacgccagcgccaaccgaatctaccgccacttcatcgccgctcgtggggagaatcggacgatcgtcgtccgcgcttacccggcgcaccagcagcagttttttgccgttcagagagggcgatttttgcgtcgagacgacggcgccggtcacgcgtgccagatgcatagttcactcctgcttaatcaattgaacatgccgcgcgacggccgcttcgcgggcgagggcggtgataatgggacggcggcgcagcaccagatagccgccactgaaacgggctacgtcggcataggtgagcaccgacgcggcgtgaagcctgacgggctggccaagcggatcgctgaacgtcagcggcaagcgggcgagtttttttaccgccagcgcggggagcagggcgggaagcagcgttagctgtacccgaacgccccaggccatcgcctcatgcagtgcgcaaccggctgccgccagcgcacgctggccggcaagctgctccagcagcggtaaatccacctgcacgatgcgcagcgaagcgtgctggcacagcaggctgcggatatccgcttcgccgagctgggccacgctgagcgtggccgtgctgagggcgcgatggcgcagacgggcggcgacctcttcgacgatacgctgcagcatcgcgtggttcatggcttcgtcaccagcgttgcccaggcttgcgcagcgtcagcgcctgccgcattggcctcgtcagtatcgatgtgcatctcaagacgcatatccggggcaacgcggaccgccacgttgtcgaagataagccgcctgtcgctgccttcgatcgccaccgcgacgctatcgccatgggagacgcgcaggatcaacgcatcaagtggcgacatatgaatatgtcgctgggcaacaatcgtcccgccgctcaactccagttcggcaaaggggcttatcaggcggatccccggcgtgccctgcagattgccggacatgcgcagcggcgcggcgataccgaggatccgggcgtcggtgcgtgagatttccacctggctggtctggcgcaaagggccgagcaggcgcacgttgtttaatcgccctttggggccaaccagggtcaccgtctgctctgcagcatattgtcccggctgcagcagcgcttttttcggctggatgggctgcgcgggaaaaagcctggcatagtcagccgccgctaaatggatatggcgactggagataccgattggaatgggacgctggcgcatctcatccagcactttgttgactgtcgaagccaactgttgtttatccattacgcgtcacctcgtttaccggcgtgcaggcactgcgagcggggatcgcctttttgtcgtgggcagtgtgggtccaggcccaggttgcaggtcacccgctccgtagagtgggagggggcgtctgtgagggccgtgttctcctccgtcacggcgacgtcaggcgctggtgaaggcgcctggacgcgggccggcagcaggccttccccgggcctggcgataaccttctgcgctaccagcccctgctgccgttcggcgagttcggccccggtcatcaccgccgcctggacagaggccacatcaccggcgatcttcaccaccatccagccggaaccgttggtcttttccagggcgagcagcgtgatggcggccgctttcgccatagcgtcggcgcaggtgatggccagggccagaccgctgacctcaagtaatcccagtgattgcttcacgctgtgctccttttttgagggtcagacggatttcggcagaatggcctcaacatcgctatgcgggcgcgggatcacatggctggacttgacctcgccgaccacgctggccgccgcgctgccggcgtcaacggcggctttgaccgcgccgacgtctccgcggaccatcacggtaatcagcccggagccaattttttcgtaaccaatcaactgcacgttggcggatttcaccattgcatcagcggcttcaatggcgccaaccaggcctttcgtttcaaccagtcctagtgcgttattcatactgcgttctcctgtggattaagcatggcgatcccgaaatgggatccctttgacgagacgagccgcattgttgccagtgtttcgccgggccagcctgttctggtgatacatcagcgaaaacaacggagttgatgcgggtaaatttttgtagtgcacgatgagccgttcccggtcgcaggcgatgcctacctgcagcggcgaacgctgcgccgcctgccaggcgtgatggataagatcgccgccggtctgcggctgcagaacaaaaggaatgccttcctcttcaatgcccagcaggacatcgcgccactgttcgctgcattcgtcagtgacggcaatgacgatggcgggggcgactacgctactctccatgtgtgcctcctttttgccaggaaaggagtaatccgctggcgaccgcattgcgtgggccttcacagccgcggatgttgccgcgcccggcaaccagccggtagtgcgccagcgcgtcggtgaccagctgggggatctcgaaatcgagggacgagccgcccaccagctccacgaacgggatgtcgcgaatgttgccggtagggctcacctggcgtaacgctcgcagggcgttggtgataaagacgcgtgatttggcgctacggcgaatggcgcgcactttctccagcggcagatcgccgggcaggggaaccagttcatccggtttcaccacgcagacgcgggcaaataccgtcggtggtaaggccgacggaaaaaactggacgctgccgtcttcatgacgcagatgaaacaggctttcgactttagccagcggatattttttgatctcttccgccaggtagcggtcctcaagccccagctcgcgggcgatgatcatcgtgaccatatcgccggcgccggccaggtgagtggcgctgatctctccctgcgcattgataatggaggcgtcggtcgacccggcgcccagatcgaggatcgccagcgggcgcgtggtgccgggagtggtgagcgccccaagaatggccgcctccgcttcggcgccgcccacctgaaccgcaatctgcagtttgtgctcaatttcacgggcgatgagggccatctgcaggcgatccgacttgaccatcgaggcgatacccaccgcctgctccagcgagaactctcccgcaagaccgccggtcacgctgactggcaccgccgtatcaacggccagcagatcctgaatgcggatctcctgagctggcttattggtaagctccgccatggtctggcgcacgtgctcaagcatgccgccgatattggtgcccgcttctcccgcgacgttgtccagtttgccgcagccgtcaaccgctttcatgatggcttccgccccggcggccacatcaacctgtacgctgcgcccctgagcgatgagcagcagattacctgccggaatagcgcgggccttgacgtcgccggagggggttttcaccaccacggccgagcggttgccaatcagcgcccgcgccattggcacgatatttttggtctcctcggcgttgagatcgaaaacggtcgcaataccgtaagggttggagagcgtttcgatgatcttaccgggtaaagcgacctcgacggccgccagcatgccaagtggaatccggtcgatatgctgaacttcgtcgatcaccggtagcggttgctgtagccggttattgaccagcacgccgtcatcctgctgcaaaataatgccggttatctgatagcccgctgccgttgccgcattgaccatcgcggcgacatcggcaaagtcaaaggccgaggagaccaccagaatatagggagtgtccgcggagcaggacagcagcgcctctggtgtgatggtgatgccgacccccagtccgacgccgccgggtgtcttcgggttatggccgatcatggtggactcggtgatgatggtttccgtgatggtttccatcgccacatcgccaatgaccggcgtggcttcgttaatgcgaataagcgaaatatcgctgagctgaatgccggccgcttttgccgcctgcgttagcgcctcctggataccgaacacatttcgtaatgtgccttttatacccgtggtttcagccaacgcgctgtggcgaatgttcagcacacctgcgtcatcgaccgtcgccagggcgacttctgtcgaggagttgccaatatcaatgccagcgatatagcgcatgcttacccccctgttaatcgtcgcctttgagtttcttacgctcgatgtacagcccggccgcttcccgaacaaaggcggcacagagtcgtgcctggtagcgatgctcgaggtcatcagcgatcgccagtagctccgcctgggtggaacggtatgggcgcagggcgttgtagatctcaaggattcggtcgtcgggaaccgcggtgagctctgcggcccgctcaaagttcatcgccagccgatcgcgtccggcatcctgggcgatcgccgcctgcatacgcagcgtttccggagtgatgcgcatgtcctgcgccgtaacgcgatcgcttaatacgttctccagcgtcaggtcatcgagcgttttattggtagcggttttgacccactccggatggcgggtcgctaacgggtagtcgctaacttttggctggcgaacggtgtcgtttgtcggcgcggctggcgcgggcgttatcccgtcctgtaggctgttcatccggctcagcacgtcgcgtaccatggattcaattgcgtcggtattcatcgggatatcctttgttaaagcgccacgcgcagttcctgcgggtttttgcccgtcaccacgtatttggtctctttaatgtgcaaaatggccgacttcgcctggtatttgggacgagccatctgatcgttaagcgtcggcaccggctgcggcgactcgcgtttggcgtagcgcgcggcgtttttgccaatctgacggtaggtttccagcgtcagcagcggcgcctgcgggaagagttccaggttggaaagcggcggcaggccgcgctggtggatgacggtggtgcctttcgactgaataccgatcgagatgccggagccgctcaggcggttgccttccactgccacgaaggcgacgtcagaagacttaaagcagcggatcacccgggctttgatgccttcttcctcaatgccggcgatcacttcgcgcagaatatttttatgcggaatgccgacgatattggcggtttgcgccagaccaaacgctggcccgacggcaataatgacttcatcctgctgcgtgccgggtttggcttcgccgatttccgtcaggaagctgtcgccggacacaggcgcaacggcgaccggcgcggcagaggcgacagaagccgcagacgcgctaaaggagaccggcttatctgcgcctgatttcatctccgacagcacctcttcgataatctggcgcagcagcgtttcgttaatttccatttttcaccccttagccaagttcattgggatcgagcgcgcccgggatatttttaatctcttcccagcgctcgccttgcaggcggtagcctgttgccggaccggcataatcgttcacgtcattcacggccgagagcacctggccctcgccaacaatgatggcggaggtatgcaggtagtcgccggtgagcttggctttctgaatattgagcatgtcctgggcgacatcggggaagccgcctttcgccagggctttcaccacctccaggccgttgcggttcttgttgatgatctcctgagcaaacttgatgtcctcgacgatattgcgctcaggcatatcttttgaaccgtgggcgtaggtagcggcttctacctcttcatccgtaataggcggcaaacccatgccggcaaataccgcctgcagcgcgcgggcggctttgttgcgaatggcgatcacgtcctcttcacgcaccggccgcaggccgccatcgaccttcaggtcgcgctggatcacgttgtagtcatcgaagtcttcggcatcttcgttggaaccggcgaacatgttgtcgtagttcggcaccgccgagtaaccggaggagataaagtcggttcctggcaggaactgcatcagcagacgcgcggtacgccgcatatccgagtgggtaaaggtttgatcgttgctggaggcgcactccagatccagcgctgagcagatcaggttttccgccagtacggcgcggatcccggacggcacggcggacggcacgccgatacagctgacggagccattctgcaggccttgcaccccggcggctttggtgatgtagatgcagcgcgcttcgagataaagcatcgatttgccttcggcatagcccatctgtacttcagaaccggaaccggaggtaaagcgcattttcaggccgcgcgaggcgtaggaggaggcgaggaagcctttcgaccatggagtgtcatcgccatcggtaaacaccggttccgtaccgtagaccgaaatggtttcggcatagcaggtgtggcccagcatgcccagtttcagctcggtggcttcttccagcgaacactgggtgaggacgccggggcggccaacctgtgaacccaccagcagggcgatggcgttgaacggcgcgtagcgcgccacggcgacggtggtctcctgttcgtcaaagccgcgccatgcgccttcagcggcgtcggcggcaatctgtaccggattatctttgatattagtgacatgcgcctgctgggacggcgtgcggcgggcgcgcattttttgcatcgccatcatcatctcgaccacgttcatatgcgacaccacttccacgattttcgccggggtcatcgcggtagtgagcggcacgatgtcgctgcgtttaacgttcgggtcgcagagcatgttggcgagcttaaccgaatccatggccatcacttcttcggcccgggcgagattaatgccgtagcgcgcgataaagtggtcaatcaggtcgaactgctcaaccggtttaccgtcgagttcggtcaccgcgccgttgacgatgcggatagaaggtttgggatcgttagggctttccatcgcgataaagccctcttcaatccactccttaacgaaaccatcctgattcacagggcgtttcgccagtgcttcaaatcttttcgatctcatgaatcagcctcgcgggtattaaatgtaggaggggcgatcgtttttcggttcggcgcccagcgtcgccagtacggttttgccgatttcccgggcggagatcaccgcctggcgcaccgcgccggagtcgccggaaatcaccagaatggcttcgttgctgaaactggtgccgtgggccggtgagctgtaagctaccacctcgacgttggctgatttcagcgcggtatcggccatcagcacgccaacggacgccggggcgccgacgataatgccgcaggcgcggcccagtggggcgccgaacgctttttccagggcataactggcgcgcgcggtatactgcagctcaatatgacccgcttcgttgccgtagacatcgccgaaggtacggtccagctctttcagcgcgacctcaatcccgcgtttgacgtcggaaacatcattcccgcccagcacaatcagcgagccatggccggcgccgcctttggtgtcgcgaggaagctcaatgctgaccacttcggtgttggtggctttgaccgcttcatcggcggccatgatgtgcggcccggcgccggtgcgggcgccgaggatgccgatagagcgatagcgtttttcgagcttcatcgcctccagcaacgcggcatccacgttggcgatgaccagcccgagggtgtcgccaatggcggtcccgacaaattccgttaagctgcagcttttctctgccatagccgtctctcctgtgggatggggggtatcgggaagcgcctgctgctctggcgtcgctacacgggctatgacttgcgccatgatctgttcaaccagctcattgctgctcattggctattccccttcggtaagattttttcaacatcggtatgggggcggggaatgacgtgtacggctttcacttcgcccacgtggcgggctgcggcggcaccggcgtcggtggcggctttaactgcccccacgtcgccacgcacgatgacggtcaccaggcctgaaccgatcctttcatagccaactaataaaacgttggccgacttaaccattgcgtcagcggcctctatggctgcggttaagcctttggtttctaccattcctaatgcttcttgttgcataaagacctcgcaggatatgtgccagtgagggaactatatggcggagcggcgaaaaagaatggctgagttgatggtggagagcgaaaaaatagtggtttttatataatataaaatggatttattttattttatatcgttgtttttatttgattttattgtttgtataaatgtgattatattgcaattaacgctccgtatttacattttaagaggtgattttttaaattgtttttgctatgcgatattttgcgtgatgtgatatttgttggaaaataagcactgcgctttcgcaattttttatcatttagttggaaattaaaataccccctgaacgcccgccattgctgcatggattcgcgaacaaatagcaataaattattcttcttcggcgactttacgccgcccgatttccgcaggatgccaacactttgccgctgccggtttctatagtgggcctcgccgtacccaacgagccagcggatggttggctggcctggacacgaacttcgtcacgaggtgtcacaatgaatggttctttacgcgcgcaatgtatcgccgagtttttaggcaccgggctgtttctgttttttggtatctgctgcctgagcgccctgaaactgaccggcgccagcctggggctgtgggagatctgtattatctggggactgggtatttctctggcggtgtacctgacggccggcatttcggggggacatctgaaccccgcggtcaccgtcgccctgtggctgtttgcctgcttcccgggcagaaaagtggtgccctatatcctggctcaggtcgccggcgcgtttggcggcgccgtgctggcctggatactttacagcaccctgtttacgcaatttgaaacggtgcatcatatggtgcgcggcagcctggaaagcctgcagctggccagtatattcagcacctacccggcgcctgagctcagcatctggcatgcggcgctggtggaggtggtgatcacctcgatgctgatggggatgatcatggcgctcaccgatgatggcaacggcgtacccaagggcccactggcgccgctgttgattggcattctggtggcggtgatcggcgcctcgaccgggccgcttaccggcttcgcgatgaatccagcacgcgattttggcccgaaattgttcacctggttcgccgggtggggcaatatcgccatgaccgggggaagagatattccctattttatcgtgcccattatcgcaccgttgttaggggcctgcctcggcgccgcaatttatcgttttcttatcgccaataatctgccctgtcatacctgcgtggaggaagaaaatacgcgttagcgtcataaggggaatgtatctgtgaaatagccaggctaatttcatgaaccgatatcacgaaccgctcaaaaagtctccccgggttgggagacttttgttattgtcaatgcacttttttatcgtcgatgggatctgatgctaaaaaaggtaaatatgaaaaatatgttttatttataacaaaaaattaactgaggggttttatcatgatttctgcgagtaccctaaactcagaactcatcaataaaatcgcacaggattttgcgcaagccaccagtctggcggttgtggtcgtcaatattcacggtgatgagatttctgaattgtttaatttcacgccgttttgccagctgatgcgtcagcacccggagcacagcggacgctgtcgcatgagcgaccgctgcggcgggctggaagcctcgaaaaaagaccagctgtgtatctaccgctgtcatgcggggttaaccgatttttccatcccgctggtgatcgccggccacctggtcggcttcgtgctgtgcgggcaggtgcgtctgagcaatgatgttgaactggttgatatcttgaacgtcgatgaccgctggcaggacgatccggcgctggtccaggcgtttcgcgatgtgccggagatggactattcgcgggttatcgcttcggcggatctgctgaagctgatcgtcgagaattgcctgaaaaaacagctcaactttgtggttatcaaagataacccgtcgcagaacgacccggcgcaggccagccgggcgccctcgccgcacgatggcaaaatgaagaaggcgctgcgctatatcgacgcgcatctctccgatgagctgcgtctggaggatgtggcggcgcatgtctatctcagcccgtactacttcagcaaactgtttaaaaagtatcaggggatcggttttaacgcctgggtcaatcagcagcggatggcgagcgcaaaagagctgctatgccacagcgactggagcatcgccagcatcgcgcggaatttaggtttttcgcaaaccagctatttttgcaaagtgtttcgccagacctatcaggtaacgccgcaggcatttcgtcagcaaattaatgccggatcacaaactgagtctttttaaatgacaatattttgctattgccgatttttgatatccccgagtatcttcatcaatataaaatgaaaaaaacgacagtagagcaataaattgtcatagcgcaacaaaatagtgatattcgagggataaactacaccagtttttatttttgtgatgagatagagtgtccgttaatacgagacagctgattatcacaacaccgctttccttcactgacgtcattgtgacgagtgatgaaacggtaaaagaaaacataaagtaatacccgtcgatgcagggcgcatcggcgaaacaaaccgacaggttcgacaccagtttggtgtcagggaagggggtgtaaatcccccgcagcccccgctgctgtgatgctgacgaccccgcaaaaaccactgatcgaaagattgggaagggcgggcgagaacgaggctaagccagaagacctgcctgccggtaactgaccaacaacttcggtgggaagtgggtggcttagcggtgcgtggtcgcaggaccaggcatgcgcgtagctataccctgcccgccagaacaggacagggtatggcaaccaggcgtgcgttcattcttgcgggtaccggcagcggttgtggcaaaaccaccgttacgctcggcctgctcagcttgctccaacagcgcggtatgcgggtgcaaccctgtaaagtagggcctgactacctggataccgcctggcacaccgccatcagcggcatcgcttcccgcaatctcgacagctttatgcttcccgccccgatactcaacgcgctgtttaccgaacagctacagcaggccgacatcgcggttatcgaaggggtgatgggcctgtatgacggctacggcaccgaccccaactactgcagcagcgcggcaatggctaagcagcttggctgcccggtgattttgctggtggatggcaaagcggtgtcgacctccatcgccgccacggtgatgggttttcaacattttgatccggctctcgacatcgctggcgttatcgtcaatcgggtcaacagcgacgcgcacttccagctgctgaaaagcgccattgagcgctactgtcaggtgccagtgctcggctatgtgccgcgcgtggaaggcgtggcgctgcccgaacgacatctgggactggtgaccgcccgcgagtcggtggtcaatcagcaggcatggcgggattttgccagcctgctggggcgcaccctcgacatagaccggctgctggccctcagcgaactggccgccatgccgatcggcgagtggggagaacagcttgccgccgatgccggcgaaggactgacgctggccctcgccgacgatgaggccttcaatttttattaccccgataacctggcgctgctggcgcgctgcggcgtgaagatggtgcgctttagcccactacgcgatcgccagctgccggcctgccagatgatctggctcggcggcggctatccggagctgcatgcggccgggctatccgctaaccacgagatgctgacacagcttcgcgcggcgcaccggcgcggggtggcgatctacgccgagtgcggcggcctgatgtacctgggcacgaccctggaagtcaccagcggcgagcgctacacgatggcggatattattcccggacacagccgaatggggacgcgtctgacccggttcggctactgcgaagcgcaggcgcagcagcagacgctgctggcagcccctggcgagtggctgcgcggccatgaatttcattactccgatttttctcccgccacccccgccgtactggcctgccgtaaacagcgagacggtaagacgctccagcagtggcagggaggatggcagttcggcagcgcctttgccagctatctccatgtccattttgcccagcgtcccaccatgctcaaccactggttgcgggcagcaaggagggcgctatgacccttctcgcctggtgtgtagcctggatacttgatgtcgtcattggcgatccgccgcactggccgcatccggtgcgctggataggtcgcctgatcgccgtcagccagcgtgtagtgcgacgcgtctgccatagcgaccgggcgctgcgcatcggcggcggggtgatgtggctggtggtgatcggcctgacatggggcgtggcctggggcgtactggcgctggcgcacgggatccacccctggcttggatggctggtggaagtgtggatgatcttcaccgcgctggcgggacgctgtctggcacagtcggcgatggcggtggcccggccgctgcaggccggagatctcgccgaaagccggcataagctctcctggattgtcgggcgcgataccttccagctccagccagcgcagatcaaccgtgcggtggtggagaccgtggcggagaacacggtggatggcattatcgcgccgctctttttcctgctcctcggcggcgcgccgctggccatggcctataaagcggtcaacaccctcgattccatggtcggctataaacacgaaaaataccgggcgatcggcatggtcagcgctcgtcttgatgatgtagccaacttccttcccgcccggctgagctggctgttgctcagccttgccgcggtgctatgccgggaagatggcgcccgggcgctgcgtacgggctggcgcgatcgctatcagcacagcagtcctaactgcgcctggccggaagcgaccgtcgccggcgcgctggggatccgccttggcggcccgaacgattacttcggccagcgcgttgaaaagccctggataggcgacgccgtccgcgacatcgcggtggacgatatttcccgaaccattcgattaatgtgggtggcgtcaagcctggcgctggcgctgtttatcggcgtgcgctactggctggtcggcgcggcctgaggagaacctgatgcagtacatccaacaaccgcaggcgatcgaggcgaaaagcttcgacatcatcagcgagatcatcgccgaaacgcgaccggactaccgtttcgccagcccgctgcacgaggcgattatcaagcgggtgatccacaccaccgctgacttcgactggctggatattctgtggttttctccggatgccctgatcgcgctgagtgaggccttgagccggccctgcacgctgtataccgataccaccatggcgctgtccgggatcaacaaaaccctgctggcccgctttggcggcgaatgccgctgctatatcagcgacccgtgggtggtgcgcgaggcgcaaagccgggggatgacccgctcgatggcggcggtggatattgcggtgcaggagcccggggagaaagtgttcgtcttcggcaatgcgccaaccgcgctgtttcgcctgctggaacatcgcgagaccgccatcggcggcgtggtgggggtgccggtcgggttcgtcggcgccgcggagtcgaaagcggcgctcagcgagagcggcctgccggccatcgccgcgctcggccgcaaagggggaagcaacgtggcggcagcgattgtgaacgctctgctttaccacctgcgggaggcgcaatgagcgatcagacctttgacgccccggtgtggcatcacggcaaagcgctgcgcaagggctacaccaccggctcctgcgccacagcggcggcaaaagtggctgcgctgatggtgatgcgccagcatctgattcatcaggtctcgatcgtcaccccctccggcgtcaccctgtgcctgaacgttgagtccccgcacgtcgaagggcagcaggcggtcgccgcgatccgtaaagacggcggcgatgatgtcgacgccacccacggcatgctgatttttgcccgggtcaccctcaatgacagcggagagattagcctgcagggcggggagggtatcggcacggtgacccgcaaagggatcggcctgccgacaggcagcccggcgataaaccgcactccgcggcacaccatcgagaccgccgtgcgcgaagcgataggtcctacccgcggcgcgcaggtggagatttttgccccggaaggcgcgcttcgcgcgcaaaaaacctataacgcccggctggggatcctcggcggcatctcgattatcggcaccacggggatcgttaccccgatgtcggaagagagctggaagcgctcgctctccctcgagctggagataaaccgcgccgccgggctggagcgcgtggtgctggtgccgggcaaccacggtgagcgctttgtccgcgagcagatgggcatcgacccgcagatggtggtcaccatgagcaacttcgtcggctacatgattgaagaggcggtccggctcggtttccgccagattgtgctcatcggccatcccggaaaactgatcaaaatcgccgccgggatctttcatacccacagccatatcgccgatgcgcggatggaaaccctcgtcgctcatctggcgctgcttggcgcgccgctgccgctgctgacgctggtcagcgagtgcgacaccaccgaagcggcaatggagcatatcgacgcctggggatatcagcgcctctataaccatctggctgagcgaatctgccagcgtgttcttgagatgctgcgcttcactcaacaaccgcccacctgcgacgcgattctgttttcttttgataaccaggtactgggcagcagccgtccgctggcggcgattgcccgggagctgacatgttgacggtcgtgggaatgggcccggcggggctgcagtggctgaccccggccgcgcgcgaggcaatcgccgccgccgaggcgctggtgggcggcagccgtcatctccagcagtttcccgacttcgccggcgagcgcttcgcgctgagggccgatatgccggcgctgctggcgtggatcgaggcccgtaccgggcgccgcgtcgtggtgctggcctctggcgacccgctgttctatggcattggcacccggctgattgcccattttggccgggaacgagtgcaggtgatccccggcatcagcgcggtgcagtacctctgcgcccgggcgggcatcgacatgaacgatatgtggctgaccagcagccatggccgggcggtgagcttcgatgctctggccgcccaccggaaagtcgccatggtgaccgacggccgctgcggaccgcgggagatagccgcccagctgatggcccgcggcaaaggccatcgctggatggtgataggcgagaacctggcgatggaaaacgagcggatccactggctgccggtcagcgccgtggaggacgaatatgagatgaatgcggtggtgatcctcgatgaaagatgagctgtttttgcgcggcgcccaggtgccgatgaccaaagaggccgtgcgcgcgctggcgctggcgaagctggagctgcaccgggcgcgccatctgattgatatcggcgcgggcaccggcagcgtcagcattgaggctgctctacagaacccggcgctgcgggtgacggcgattgagcgtcaggccgacgcgctgcgcctgctggcggagaaccggcagcgctttggctgcgacaacatcgctatcgtggcgggcgttgcgccgctggcggtcgccgacaaagccgacgcgatctttatggggggcagcggcggccacctgacggcgctgatcgactggtcgctggcgcagctgcatcccggcggccggctggtgatgacttttattttgcaggaaaaccttcatagcgctctggcgcacctgcggcagagcggcatccacgaggtggactgccagcagctggcggtctccaccctggctaccctgggcagcggccactacttcaaaccccataatcccgtttttgtcatcgcctgtcagaaggaagaaaaccatggctgagacttttgatccccattgcgtgtggttcgtcggcgccggtccaggcgatcgcgaactgattactctcaaaggctaccgtctgctacagcaggcgcaggtagtgatctacgccgggtcgctgatcaacaccgagctactggcctactgtccgccacaggcggagtgccatgacagcgccgcgctgcatctggagcagatcctcgacctgatggaggcgggggtgaaggcgggaaaaacggtggtgcgtctgcagacgggcgacgtctcgctatatggctcggtgcgcgagcagggcgaagagctgacccgccgcgggatccgctggcaggtggtgccgggcgtcagcgctttcctcggcgcggcggcggagctgggggtggagtacacggtacccgaagtctcgcagagtctgattattacccgtctggaagggcgcacgccggttcccgcgcgcgaacagctggaagcctttgccagccatcaaacctcgatggcgatttacctgtcggtgcaacgtattcaccgggtggcggagcggctggtggagggcggctaccccgcgaccaccccggtcgcggtgatctacaaggccacctggccggaaagccagaccgtccgcggtaccctcgcggacatcggcgacaaagtacgcgacgccgggatccgcaaaacggcgctgatcctggtcggccccttcctcggcgatgagtatcactactcaaaactgtacgcagcggattttagccatgaataccgtaaagcctgaatccattgccctgttttgcctgacgcccggcggcgtgcggctggcaaaacggctggcggccatgctgccgcttacctgttacaccagcgaagcgctgcaggaagaggggtttatccccttcaacggcggctttgccagcgctgcccgcgaggcgttcagcagcttctcggcgctgatttttatcggcgccaccgggattgccgtgcgggtgctggccccgctggtgaatgacaagctcagcgacccggcggtggtggtgattgatgagcgcgcccggcacgtcatcagcttgctctccggccatgccgggggggccaatgcgctgacccgctatctcgccgggatgctcgacgccgacccggtgatcaccaccgccaccgacgtcaacgagctggccgccctcgacacgctggccttccagctgaacgcccggatgaccgattttcgcgcggcggtgaaaaccgttaaccagatgctggtgagcggtaagcgggtggggctgtggtgcgacggcgaatttaccggggcgctaagccgctgcgaccggcgcgggtttatcccggtaagcgacctggcgcgcttgccggcgctcgacgccctgatctgcgtcaccctgcgccggtcgctgccgccgctgccggtgcctcactggaagctggtgccccagcgggtggtggcggggatcggctgtcggcgcgacaccccctgcgcgctgctcagtacgttgctggatcgccagcttgccgctcagcgtcttgacccgctggcgctgaaagcgatcggcagcgtgagcctgaaggcaaacgagccggggttgcgccagctggctcaccgctgccgggtgccgttcgaaacctttagcgccgaggcgctgcgcgagcacgagcaccgctttccggcctcgtcttttgtccgggagacggtcggcgtcggcagcgtctccggcccggtggcctggctgctgagtcagggaaacctgtccggcgaaaccctgcgtgagcagggcgtgaccattactttgggagtaacacactgatgttaagcgtaatcggaattggccctggctcgcaggcgatgatgaccatggaagccgtggaggccctgcaggcggcagagatcgtggtgggctacaagacctacacccacctggtaaaagcctttaccggcgacaagcaggtgatcaaaaccggcatgtgcaaagagattgagcgctgccaggcggccatcgagctggcgcaggccgggcacaacgttgcgctgatcagcagcggcgacgccggcatctacggcatggcggggctggtgctggagctggttaataagcagcagctggacattgaggtccgtctgatcccagggatgacggccagtatcgccgccgcctcgctgctcggcgcgccgctgatgcatgatttctgccatatcagccttagcgatctgctgacgccctggccggtgattgaaaaacgcatagtcgccgccggggaagcggacttcgttatctgtttctacaacccccgcagccgcggccgcgaaggacatctggcgcgcgcctttgcgctgctggcggccagtaaaagcgcagatacgccggtcggcgtagtcaaatccgccggacgcaaaaagcaggagaaatggctgaccaccctcggggagatggattttgccccagtggatatgaccagtctggtgatcgttggcaacaaagcgacttacatcgacaacggcctgatgatcaccccgcgaggctacgcgctgtgaatcacggcgacgtgctggttatcgggggcaccagcgatgcgcgggcgatctgccagcagctggacgccgccgacgtgcgctacaccctgtcggtggcgacccctaccggcgagcggctggccggcgatatccgcgggcagatacgctgcgggcgaatggagtggcagcagatggcggagtggctcagagcgcagcgcacccgctgggtgatcgatgcctctcacccctacgccgaggtggtcagccagaatattgtgcgcgcctgcgctagcgtcggggttctgctcagccgctatcaaaggccggagcagctgagcgatctgcgccatccgctacttcacgtggtcggcgatctgaacgaggcctgcgcggtggctcgtcgcttcggcgagcggatcctgctgaccaccggcagcaaagatctggcggcctggcgggcgggactggcggagaaaacgctgctcgcccgggtgctgccggtgccggaggtggttcagcactgtagcgatctggggtttggcgtcggggagatcttcgccctctgcgggccgttcagcgccgaatttaacgccgccttttatcgccagtgccgggccgatgttgtggtgacgaaagcctcgggggcggaaggaggctatcaggaaaaagtacaaccctgtcttgatgcggggatcccctgcatcgtcattacccgtccggcgccgctggtgacgggcgatgaactactgcaaagccaggccgatttcactgcgcggctgacgcgctggctgtcggcgacttgaggaagaggatatgaaaaaagcacttctggtggtgagctttggcaccagctatcacgacacccgcgaaaagaacatcgccgcctgcgagcgcgatctggccgccagctgcccggaccgcacgctgttccgcgccttcacctcggggatgattattcgcaaactgcagcagcgcgacggtattcatatcgatactccgctgcaggctctgcaaaagctggccgagcagggataccaggatgtggcgatccagtccctgcacattatcaacggcgacgagtacgagaagatcgttcgcgaagtgcagagcatgcgcccgcgctttcagcgtctgacgctgggcgcgccgctgttgagcggtcatggcgattacgtgcagctgatgcaggccctgcgccagcagatgccaacgctggcggcgacggagcgagtggtgtttatggggcacggcgccagccaccacgccttcgcggcctacgcctgtctggatcatatgatggcggtgcagggttttccggcgcgggtgggggcggtggaaagctatcccgaagtggacatcgtcattaacgaactctcccgccagggcgtgaccggcgtgcatctgatgccgctgatgctggtggccggcgatcatgccattaatgatatggcctccgacgaagacgattcgtggaaaacccgcttcaatgccgccgggatccccgccacgccgtggcttaacgggttaggggagaatccggcggtgcgggcgatgtttgtcgcccatctgcagcaggcgctgaacgacacgatggagaaagcagcatgagcggcaaactatacgccctgagcagcggcccgggggcggccgatctgatcaccgtgcgtgcggcgcggatcctcggccagctggatgtgctgtatgcgccagccggccgcaaaggcggcgacagcctggcgctctccatcgtacgcgagtacctgggcgcacacacggaggtccgctgctgccattttccgatgagcgccgacagcgcggaaaaagaggcggtgtggaacgacgttgccgcggcgctggcccaggaggtggcggcgggcaggcaggtcgggtttatcaccctcggcgacgccatgttgttcagcacctgggtctttctgctgcagcggattggctgcccggagtggctggagattgtccctggcgttacctccttcgccgccattgccgcacgggcgaaaaccccgctggccatggagcagcagtcgctggcggtgatctcctgcaccgcgccggaagcggacattgccgcggcgctgcgccagcatgacagtctggtgctgatgaaagtctacggccgcttcgcccgcattaaggcgctgctggcgcaggcggggctgctggatgcggcgctgatgatgtcagaggccaccctgccgggcgagcagtgctggcgccgtctgcgcgaggtcagcgatgaccagccgctgccctatttctcgaccatcctggttaacaaacagtgggaggaggcgtaatgaatcaggtgaaatcgctgaagcagctttcgtatggggggctggcggccgctgttctgctgatcatcgtcccgcaggaggcgttcgccatgcatatcatggagggctttttgccgccgatgtgggcgctggcgtggtggctgctgtttttaccctgcctgtggtacggcctggtgcgcctgcggcgtatcgttcaggaagagagcaatcagaaggtgctgctggccctctgcggggcgtttatttttgttctttcggcgctgaagatcccatcggtgaccggcagctgctcgcatccgaccggcgtcggtctggcggtgatcctcttcgggccgggcgtggtggcggtgctgggggcgatcgttctgctgttccaggcgctgctgctggcgcatggcggcctgaccacccttggcgccaacgggatgtcgatggcggtgatcggcccgatggtcggctatctggtgtggaagctggcctgtcgggcggggatccgtcgcgatgtcggggtctttctctgcgccatgctggcggatctgatgacctactttgtcacctccgtccagctcggggtggcctttcccgatccggcaaccggggcaggtggatcgatcgccaagtttatgggcatcttctgcctgacgcagatcccgatcgccatcgcggaaggcttgctcaccgtgatgatctacgatcagctaaccaaacggcgactgatcgccgcggagggacattaatatgaaaaagaccctgatcctgttggcgatggtggccgccctgatgatcctgccattttttattaaccacggcggcgagtttggcggctcggacggtgaagcggagagccagatccaggtggtggcgccggattatcaaccctggttccagccgctatatgaaccggcgagcggcgagattgagagtctgctgtttaccctgcagggctcgctgggcgcggcggtgattttttacattctcggatatgcgaggggcagacagcgccgtgatgaccgggtttgaccgactcagctaccagagccgctggctgcaggtggcgccagagcggaagtttctgctctggctactgctgatggcgctggcctttacgctgccggcgtggggccaggcgctgacgctggcgctgaccgccgcgctgacctgctggctgctgcgggtctcattctggcgctggtgccgctggatggccctaccctttggctttttgctggtcggcgtgctgaccattgtgttcagcgtcagccgcgacccgcagatgctgttagccagcatccgactgggcgctttctcgatagggatttccgccccggggctggccgtggccggggagaccttctggcgcagcctggcggcgatagcggcgacgctctggctggtgcttaatctgcctttcccacagctgattattttactcaagcgcggtcgcgtaccgcggctgttgacggagcagatcctgctgacctggcgcttcatttttattctgttagacgaggcgatggcgattcaccgcgcgcaaactctgcgttttggctatggtagcgtgccgcagggctatcgctcgctggcgatgctggtgggactgctgttcacccgcgtcctcctgcgctatcagcagatgagcacggcgctggatatcaaattgtaccagggtgattttcacctctaaggataagtatgcttgccacaaccgatctctggtttcgctatcaggatgagccggtacttaaagggctgacgctggatttttcccgccatgcggtgaccggcctggtgggggccaacggctgcggaaagtcgacgctgtttatgaacctgagcggcctgctgcgcccgcagcaggggggggtgctgtggcagggagaggcgctgaattacagcaagcgcggtctgctggcgctgcgccagcaggtggcgacggtgtttcaggatccggatcagcaaatcttctataccgatatcgacagcgatatcgctttcagtctgcgtaacctcggggtggcggaagaggagatcgcccgccgggtggatgaggcgttgaccctcgtcgatgcccaggggtttcgccagcagccgatccagtgcctcagccatgggcagaaaaaacgggtggcaatcgccggggcgctggtgctgcaggctcgctacctgctgcttgacgagcccaccgcgggcctcgatccacgcgggcgggcgcagatgatcgccatcatccggcgcattgtcgggcaggggcggcgggtggtgatctccagccacgatatcgatctgatctatgaggtgagcgacgccgtttacgttctgcgtcacggcgaagtactggccgcgggggatcccggcgaggtatttgcctgcgcggagacgatggacagggcgggattgacgcagccgtggctggtgaaacttcatagcgaactggggctgccgctgtgtaaaaccgaggcggagttttttcagcggatgcacaacaacgcgataggcgcgataaaggaggcgtcatgacgctggcagtgatgttgcagggcacggcttccgacgttgggaaaagcgtgctggtggcgggattgtgccgcatttttcatcaggatgggctgcgtaccgcgccgtttaaatcacagaatatggcgctgaactccggcattacgccggatggcaaagagatgggccgggcgcagattttccaggccgaagcggccgggattgcgccggatgtccgcatgaatccgattttgctcaagcccaccagcgaccgtcaggcgcaggtggtgctgatggggcaggtggcgaccagcatggatgcggtgagctatcaccagtacaagccgcgcctgcgcgagcagatcctcgcggtctaccagagcctggccggagagtatgaggcgctggtgctggaaggcgccggcagtccggcggagattaacctgcgcgaccgcgatatcgtcaatatgggcatggccgagatggcgcaatgcccggtgatcctggtggccgatatcgaccgcggcggggtgtttgccgcgatttacggcacgctggcgctgctgcagcctcaggagcgggcgcgggtgaaaggggtgatcatcaataaattccgcggcgatgtggcgctcctgcgctccgggatagagcaaatcgaggcgttgaccggggtgccggtgctgggcgttatgccatggcttgacgtggatctcgaggatgaggacggcgtcgcgctgcaggccgggaaataccatcgcaccgaccggcgcgatatcgacatcgccgtggttcacctgccgcatatcgccaattttaccgactttaacgccctggcggcacagccagatgtccgggtgcgctatgtccgcgatccgcaggcgctggctgacgccgacctggtcattctcccgggcagtaaaaataccctcggcgatctgtgctggctgcgcgagagcggcatggcgcacgcggtcgagcaggcccggcagcgcaaggtgccgctgctggggatctgcggcggctatcagatgctgggcgaaaccattatcgatgaggtggagtctggccttggcgcccagcccgggctgggggtgctgaagaccgtgacccacttcgcccagcacaaaaccaccacccaggtgcaggcgaccctggggtctgcgctcccggattggttagccgacgcggcggggctgcgcgtcagtggctacgaaattcatatgggcgagacgcgccgcgaggcaggctgcccgccgctgctgcagctgcataaagcggggcaggcagtggacgacggggcgataagcgacgacggcctggcgttcggcacctatctccatggcctgttcgacagcgatgactttacccgggcgctgctcaacggcctgcgccagcgcaaagggctggcgccgctggacagcgccctggagtatgcccgctataaaacccggcagtttgatcggctggccgaggccatgcgcgaacatatcgccatcgataaaatttacgccatcatgcgccaacatcaggagcccctatgctgactctggttaccggcggcgcgcgcagcggcaaaagtcgccatgccgaggcgctgattgccgatgcgccgcaggtgttatatatcgccacctcgcaaatctttgacgacgagatggccgcaaggatccagcatcatcgcgacggcaggcccgcccactggcgcaccgccgagcgctggcagcagcttgatgaactgatcaccccggctatcgccccagcggaggcgattttgctggaatgcatcaccaccatggtcaccaacctgctgttcgcgctcggcggcgacagcgaccccgacggctgggattacgccgccatggaacaggctattgatgacgaaattggcgtgctgattgccgcctgtcagcgctgtccggcgcacgtcgtgctggtgaccaacgaggtggggatgggcattgtgccggagaaccgcctggcgcggcattttcgcgatattgccgggcgggtcaatcagcgcctggcggccgcggcggatgcggtctggctggtggtctccggcatcggcgtcaaaatcaaataactcaatcgctggctgaccgggccagccctggcagggattctgtatgcaaaatttaaacacggttctgcgggcgatccccgcgccggacgccgactccatggcgcgggcacagcaacacatcgacggcttactcaagccccccggcagcctcgggcgtctggaggcgctggcggtgcagctggcgggaatgcccggcctgggcggccagccgcaggtggcgaaaaaggccctgctggtgatgtgcgccgaccatggagtgtgggacgaaggggtggcgatttcgccgaaggcggtcaccgccatccaggcggcaaatatgacccgcggcaccaccggcgtctgcgtgctcgccgcccaggccggggcgaaagtgcatgtaattgatgtcggtatcgatagcgaaccgctccccggcgtggtgaatatgcgggtggcgcggggctgcggcaatattgcccgcggtccggcgatgagccgtgagcaggggcaggagctgttgctggaggtgatgcgctacacccgcgcgctggcccaggagggtgttaccctgtttggcgtcggcgaactggggatggccaataccacgccggcggcagcgatcgtcagcgtcctgaccggcagcgatgcgcaggaggtggtcgggattggcgccaatctgccgctggcgaaggttggcaacaaggtggaggtggtgcggcgggctatcgccgtcaatcagcccgacccgaatgatggcctcgacgtactgagcaaagtcggtggtttcgatctgctggggatgaccggtgtcatgctgggggcggcgtcctgtgggctgccggtggtgctggatggctttctctcctacgcggcggcgctggcggcgtgtcagatagcgccggaggtgaaaccgtatctgatcccgtcccattattcggcggagaagggggcgcgtatcgcgctggcgcacctgggtctcgaaccgtatctcaatatgggcatgcgtctgggagaaggcagcggcgcggcgctggcgatgccgatcgtcgaggcggcctgcgcgatgtaccatcgcatgggcatgctggcggcaagcaatattgtgttaccgaaggggtaagcaggagatgggggcggcaatggccgttcccgttttcggcagaggttttgccggcggcagaaacaaaaaacacccttgagggtgtttgtaatgttggttgcgggggccggatttgaaccgacgaccttcgggttatgagcccgacgagctaccaggctgctccaccccgcgtcaccgtactgcttcactttgtcaaatttgattggttgcgggggccggatttgaaccgacgaccttcgggttatgagcccgacgagctaccaggctgctccaccccgcgtcaccgtactgctttacttcatcaaattttaattggttgcgggggccggatttgaaccgacgaccttcgggttatgagcccgacgagctaccaggctgctccaccccgcgtccgtggaagcgcactatactccgctagcgagatgatgcaaccttttttcgaccaaatcgacatttttgtaagaattggcttataaaacgccatgttgtggtgtttttttacacaaatctgtgccatcgatgagatcgcgcatttcaatagctccggcgctttgttatcttcaacacgcactaaggcttcgcagcaaaagatgagacaccatgaaaggacgttgggcaaaatatgtagcgacgggggcaatgctggccatgctcgccgcctgttcctcaaaaccgaccgaccgcggtcagcaatatagcgatggcaagttcacccagccgttttcactggtaaaccagccggatgccgtcggggcaccgatcaacgccggcgacttctccgagcaggttaatcaaattcgtaacgcctcgccacgcctctataatagccagagcaacgtctacaacgcgctgcaggagtggctgcgcgccggcggcgacacccgtacgctgcgccagtttggcatcgacgcttggcagatgcagggcgtcgacaactatggcaacgtccagtttaccggctactacacgccggtggtgcaggcgcgccacacccgtcagggcgaattccagtaccccatttaccgtatgccgccgaagcgcggtaagctgccttcccgcgccagcatctatgccggcgcgctgagcgataactatgtgctggcgtacagcaactcgctgatggataacttcatcatggacgtgcagggcagcggctatatcgactttggcgatggttcgccgctcaacttctttagctatgccgggaaaaacggctggccctatcgcagcatcggcaaagtgctaatcgaccgcggggaagtgaagaaagaagatatgtcgatgcaggcgatccgcgagtggggtgagaagcacagcgaagcggaagtgcgtgagctgctggagcagaacccgtcgttcgtgttctttaaaccgcagtctttcgcgccggtgaaaggggccagcgctgtgccgctgatcggccgcgcctcggtggcctccgaccggtcgattattccgccaggaaccaccttgctggccgaggtgcctctgctggataataacggcaagtttaacggccagtacgaactgcgcctgatggtcgccctcgacgtcggcggggccatcaaaggtcagcatttcgacatctatcagggcattgggcctgacgcgggccaccgtgccggctggtataaccactacggccgcgtatgggtgctgaaaaacgccccgggcgcggggaatgtttttagcggctaactcccctggccatgcctgttgaccagggcgcccggatgacgccgtttacggcggcctccgggcgctgtcattttgttctgaggttctatgtctgttgtaatcagcgatgcctggcgccagcgttttggcggtacggcacgtttatatggtgaaaaagcgctgcaatgttttgccgacgcccacgtctgcgtggtcgggatcggcggggtcggctcctgggcggcggaagcgctggcgcggaccggcatcggggcgatcacccttatcgatatggacgatgtctgcgtcaccaacaccaatcgtcagatccacgccctcagcggcaacgtcgggctggcgaaagcggaggtgatggcggagcgtattcgtctcatcaacccggagtgtcgggtgacggtggtggatgatttcgtgaccccggaaaacgtggcggaatatcttggcgtcggctttagctatgttatcgacgctatcgatagcgtccggccgaaagcggcgcttatcgcctggtgtcgccgctacaaggtgccgctggtgactaccggcggggcgggcggtcagattgacccaacgcagatccaggtcgcggacctggcgaagaccatccaggatccgctggcggccaaactgcgcgagcggctgaaaagccagtttggggtggtgaaaaacagcaaaggtaagctcggtgtagactgcgtcttctctacggaagcgctggtctacccgcaggcggacggcagcgtctgcgcaatgaagagcacggcggaagggccgaagcggatggactgcgcttccggctttggcgcggcgacgatggtgaccgcgacctttggcttcgtcgcggtgtcgcatgccctgaagaagatgctggcgaaggcggagcggcagacgacgtaaatcccgggtcgcggcgcaggcgccttacccggtctacaggacaattccccggaggcggcgctgcgcacctgtccgggcgacaaaactgcacgagcccgtagcccgggcaaggcgcgtcaagcgccgcccccgggatgagcttaaacctcaacctcgcgggcggcggcgagcaccgcctcgctgagggcgctgaggccctggctgcgcgaggcgctgagctggccgcgcagccccagctcgtcgaacagcgccagcggatcctgcgccaggatcccggcgcgggtttttccttccacggcggttaaaagtaccgccagcagaccgcgcacaatccttccttcgctgtcgccaaagaagtgcagcctgccctcggcgtcctcctcatagcccagccagacgcggttctcacagccggcaatctcatgggcctgcgctttgcgctcgtcggtcagcgtcggcagctttttgcccaataaaatcagctgacggtatttatcctcccactggttcagcggggcgaagatctggcgcagcgtagcgtcggtaatggttgtgccgaaggggtgcagagttgtcattaatccaccagaatttccagggcgcgatccaccgcgtggaccagcgccgcaacatcgtcttgggtattgtagggggcgaaagaggcccgcagggtgccgctgacccctaaggcagccagcagcggctgggcgcagtgttgtccggcgcgcagggcaatgccggactccgccagcagcgtcaccagatcgctgtgatgaataccctcaaattcaaaggccagcaggcttgactgctggcagcggaaagagcggaagcccggccgtttcgccagttcctcttccgccaggctcgccagactgcggctccagttttccgcctggccgatatcgctctgcgccagccactccagcgcggcgctgaggccgataaccccggcgacattcggcgtaccggcctcgaggccatagggggccggctgcggcgtaaagccgtcaaagctgacctcggcgatcattttcccgccgccgagccagggcgacatcgctgccagcagctcgcttttgccgtacagggcgccgatcccggtcgggccatacagcttatggccggaaaaggcgtaaaaatcgatatccagcgcctgcacgtcagcggggaaatgcaccgccccctgggcgccatcgaccatcaccaccatcccggcggcgtgagcaaggcggatagcctgcgccaggtccgggcagccgccggtgacgttggacatctgaccgatggccagcacccggctgcgcggggtaatcagcgcgctgaggctggcgatatccggcagacggtcggtgccaagcggcagtttgaccactctggcgccggtctgcccggccaccatcagccagggcacgaggttggcatgatgctcggcttcgctaacgataatttcatcgccaggctgcaggcgcggccggacgtagctctgcgccaccatattgatggcctcggtggtccctcgcgtccagacgatatctttgccggacggggcgttaagccacgccgccacgcgatcacgggccgcctcgtagcgctcggtcagccgctgggcggcggcgaactggctgcgatggacattgccggcgctcaggcgataaaactggtcgctggcgtcgatcaccgccagcggtttgagcgctgtcgccgcgctgtcgagatagacgccggcatcggccagagccggaaactgcgcgcgaaagtgcgccgggttaaatgcgttcatggaattcctcgtatcaataccgcgatcgtcgcgcaatttgccgggcgtgacaaggtctctgcgtcctgtggaattgtccgaatgtgactccacgtcggtcaaagagggttatgctgaaaagtgttgggtttgtgttttaacctattacttaacgagttacgaatagtataaatagccgtaaggagagaagaatgaaaatgactaaggccgctgcgattatctctgcctgtatgctgactttaggcctgagcgcctgttcctctaactatgtgatgcataccaacgatgggcggaccatcgttaccgacgggaaaccgcaaaccgataatgacactggcatgatctcgtataaagacgcgtggggcaacaaacaacagatcaatcgctctgacgtgaaacaactgggtgaactggacgagtaaggcagtaaaaaggcaaaaaaaagcaccgcgcgttgcggtgctacattaaatcactatggacagacagggtaaatgtacaggaagtgaaaaggggtagctttgctaccagggtctgcaaaaacagaccaattgcaaacgcaacaacacaacatcacaaccgtaagccaaaagcttgatggaacacgcattccaaaaaaagcttctcgttccggctcaggaagtgccgccactataggtatttgctggtagaacctcaacggacaatttataatggctcagataaaaaaaactaataggttaatcattgtttcctatttgttaaattgagttaacatctaagccagaataaccatgtcgaagcgattaccacctctgaatgcattacgtgtttttgatgcagccgcacgtcatctcagcttcactcgggcagccgatgagctttttgtgacgcaggccgcagtcagccatcaaatcaagtctctcgaggattttctgggccttaagctgttccgtcggcgcaatcgttcgctgctgttaacggaagaagggcagagctattttcaggatattaaagagattttttcgcaactgacggaagcgacgcgtaaactgcaggcgcgcagcgccaaaggggcattaacggtcagtttattaccaagtttcgccattcagtggctggtgccaagactaacaagctttaactcagcttatccgggaatcgacgtcaggatccaggcggtggaccgtcaggaggataagctggcggacgatgtcgatgtggcgattttttacggccgcggcaactggccgggcctgcgtgtggaaaaattgtacgccgagtatctgctgccggtctgttccccgctcttgctcaccggcgacaaggcattgaaaacgcctgccgatctggcgcaacataccctgcttcacgatgcgtcccgccgcgactggcaaacttatacccgtcagcttggtctaagccatattaatgtgcagcaggggccgattttcagccatagcgcgatggtgctgcaggcggccattcacgggcagggcgtggcgctggccaacaacgtgatggcgcagtccgaaattgaagccggtcgtctggtgtgtccgtttaatgatgttctggtcagtaagaatgcgttttaccttgtttgccatgacagtcaggcagaactgggtaaaatagccgctttccggcagtggatcctggcgaaagcggcaagtgaacaagaaaaattccgctttcgttatgaacaataattacttgtagggtaacaacatgaccagccgttttatgctgatattcgccgcgattagcggctttatctttgtggctctgggcgcctttggcgcgcatgtcttaagtcaatcgctcggcgcggcggagatggcctggatccataccggcctggagtatcaggccttccataccctggcgatttttggtctggcggtggcgatgcagcgtcggatcagtatctggttctactggagcagcgtatttctggcgttagggaccgtgctgttcagcggcagcctctattgtctggcgctctctcatttacgtctgtgggcgttcgtgaccccggtgggcggcgtaagcttcctcgccggttgggttttaatgttaattggtgcaattcgtctgaaacgtaagggcgttgttcatgaataaggttgtcctctattgtcgccctgggtttgagaaagagtgcgcagcagaaattaccgataaggcagcccgccttgaggtgtttggttttgcccgggtcaaagaagactctggctatgtaatttttgaaggttatcagcaggacgacggcgagaagctggtgcgcgatctgccgttcagctcgctaattttcgcccgacagatgtttgtggtcggcgaactgctgcgcgacctgccgccggaggatcgcataaccccgatcgtcggcatgctgcagggcgtggtggagaagggtggcgagctgcgtgtggaagtggcggataccaacgaaagcaaagagctgatgaagttctgccgcaagtttacggtgccgttacgcgcggcgctgcgcgaggcgggcgtgctgaccaactatgaaacgccaaagcgaccggtggtgcatgtgttctttatcgcccccggctgctgctataccggctactcatacagcaacaacaactcaccgttctatatgggcattccgcggctgaagtttccgtccgacgccccgagccgttccaccctcaagctggaagaggcgttccacgtttttattccggcggacgagtgggacgagcgtctggcgaacggcatgtatgccgtcgatctcggcgcctgcccgggcggctggacctatcagctggtgaagcgcaacatgtgggtctcttcggtcgataacggcccgatggcccagagcctgatggataccggccaggtgacctggctgcgcgaagacggtttccgctatcgtccgaaccgcaacaacatctcgtggatggtctgcgatatggtggagaaaccggcgaaggtggcggcgctgatggcgcagtggctggtcaacggctggtgccgggagaccatcttcaacctcaagctgccgaggaaaaagcgctatgaagaggtgtcgcagaatctggcctatattcaggcccagctggacgagcacggcgttaacgcccagatccaggcgcgtcagctgtatcacgatcgtgaagaggtgaccgttcacgtgcgccgcctgtgggccgccgtcggcggacgtcgcgacgagcgttaatccttccccctcaggccggagacgcgtgcgcgtcctccggccttccccttaaggctgcggcgcatccgacacaatatgcgtcacgtcatccagatgaccaatcctcgcctcgccggagcggttgaacttgcttttgtcgatcagcagcagcgactgcgccgcccgcttaagcaggatcgatttgaagtcggcattgaacgcattggagtcccacagcgcgccctgcgggtcgatgccttcgcaggaaaaaataaacagatcgatctccagcgatttcagctgggaaatcagcgccgggttcacgtagcagccatatttccgctgcagagtgccgccggagcaggtgagcgtgatctggtcgcgtttggccagctcctggcagatgggctggctgttggtaaagacgtgcagcgggcggtccggcagctggcgggcgagataccagcaggtggagctggcatcgagggcgatcaccatcccttcgtcaatccaggccagcgcttcgcgggcgatgtcggctttatgcgcgtaatggcttttcaggcgcatgtggaaaggatcgccgctgtcctggctgcgctggtggatcactttggcccggccgtggttacgcagcactttgccctgcgcctgcagctcgctcagatcgcggcgaatagtttccctgctgacgttgagctgttttgacaacgtttcggtggtcaggctgctgtgggtgatcaggagatcgacgatcgcctgctggcgggctgctttcatttattctcatcccatcattgattgagcgtctgcatcaggcagacgctccggcatgagattacggcgtgactcctttttttaaaaggatatttccgtacttagcgcactctcctgtgataacgatcgcaaaggctttttgcgcccggtcgtagaaggcaaagcggtcaatccgcacgatatccgggcagggggcctgcgccgatagcgcctgccgatagcgctgttccaccgtcgggtcgagcgcatcgccttcgacggcggccatcatcaccaccggcggcgcatagctgtctaattcgaacagcgggataatcgcctgcagcagatcgctgactcgcaggccatcggcgcggatcacctgcggccccatgctgtgcgccgggaaatgggcatcggaaaaaatgatttcatccccatggcccatttcggccagcactttcagcagttccggcgatatcagcggggaaatggttttgagcatctcaggcttcctctatcagttcaggttcagtttgcggccagaaatagcggtagcggtacgcgacctgcgctctggcctgttctggcgaagagaactcgcccacgccataccagccaaacatcgccgcgccggccacggtggtttcggcatcgtcgaggactttgatcggtatcccgagtcggttggccttgatctggttccatagcgcgttgcggctgccgccgcccaccagcagcagctctttcgccctgaagccgccgattttttccagggtttgcagatgctgcgccagctgatcgcttaacccctccagcgcggcgcggtaaaaatggccgcgggtggtgttgagcgtgacgccctgccagccggcgtgctggctggcgagcaggtcgcactgcatcctgacgccctgggcgccgggcgggatcgcctgcgcttcgtcaatcagcgtctgccatggggtgtcagcgctccacagcagtttgcgcacccactcgagcacgccggaggccagccactgcatccccgggttatagcggcccggctggctgtccagctcgcaggtggagccgctgtagtcacagagcagcgaggtgtcgacctgcgcgctgcgtaccatcaggatctcccaggtcccggaggaaagcaccggctcatcctgcccggcgccggcgccaaacagagcgaactgggtgtcatgcccggccgagataaccgggatcccgacggggaggcccagcagcgcagcggcctccggcagcagggcgccgatcggctggcctgcttcaaccagccgcgggaacaggcggcgcggcaggccggtcgcctgcaggatcggcgcgctgaaatcgcgctgccggagatcgagcatctggctggtgcctgccatggtgaggtcggtggtgaactccccggtcagccgatggttgatcagtgatgaaataaacagccaggcatgggcctgcgccagcagctgcgggtggttctctttcagccacaccagcttatacagggtattgaacgcaaacgcgccgacgccggctatctgctgcagctgacgcgcgggcatatactggctgatattctccatcaccgccgcggtgcgcgggcatttccagctgatgatcggatacagcagggcgccctgctcatccaccagcgcgccatcgacgccaaaggtcgtgacggtgatgccgcgcaccgtgcaggaggccagctggtcatggatctgccgacagcagtcggcaaagcgctgcataatggcctccagcgaccactggtgccagtcgcttttttccgccgcgatgtcgctggcgttcgccgttgcggcgcgggcgataattttcccttgtcgatccacggccatcgcccgcacgttcgtggcgccgcagtcgaggaccaggataacgtcttgcttcatagtgactcccgaaacaacattgccggatggcgcagcgcttatccggcctacagaccgcgcgcgtctgtaggccaggtaagcctgctcctccgggcgaaaccaacctgttaacgcttatacagcggcccgtagttctggcaggcgcggtagtcctggccctcgatatccatgccgtgcgcggcccaggcggaagggcggtagattttcgcctcttccacgttgtgcatgcagaccggaatgcgcagcatggcggcgagggtaatgaaatctgcgccaacgtggccgatggtcagcacgccgtggttggcgccccagttggccatcaccgagtacacatcgctgaacgggcccttgccggtcaggcgtggggcaaaccaggtggtgggccaggtggagttggtgcgggcgtcgagctggtcgtgcatcgctttgggcagcgccacgctccagccttcggcaatttgcagcaccggccccagacctttgatgatgttcacccgggtcatggtgaacggcacgccgccttcggtcaggaagcgggaagagaagccgccgccgcggaagtattcgtggatcgccgggcaccattcggtcgccgcgaggcaggcatccgcctcgttctgctcaatctcccagtgaggtttcatcgtcgggttgccctgcgcgtcgcgctgctggcaggagccgtccagcgccgcagagccggagttaatcaggtgaatgatgccgtgctccgcccgcccggtgagcggctgcccggtgacccgttcaacggcatccggcgaccagtaggtgcgtacgtcggcaaacacctgggcggtgccggtgagctgatggcccatcagcatggccacgccgttgaggctgtcgttttcggtagcgacgacaaacggttcgcgcaccccgttccagtcaaaagagctgttgagcagcgcttcggcggtatcgccattggggtattgatcggtccagtggcgctgaccctggaaaccggcggcgatggcgttgtagcccagcgactcctccaccagtcctttttctgcgagcttcgggttaccctgcatcatgtcgcggatgcacatcgccatcagcaggctctctttcagcaccgcgcggctctgcgtttcattgcgcttatactgctcagcgttctgatcttcgccgtagcggaagtgtttatccgcccacgccagcgccatctccagctcggtttcatcatagattttttgatcgattcgccggcgcagctccgtcatgtcgacagcctgcaccttcatgccgagccaggattcaaaaaagttgtggtcgacgatagatccggcgatgcccattgagacgccgcccagcgacagatagcttttccctttcatactggcgacagccaggccggcgcgagcgaagcgcaacagcttttcttcgacatccgctgggatcgacgtgtcatcggcatcctgcacgtcatgtccgtagatggagaacgccgggatccctttctggctatgggccgccagcgccgcggccagatagaccgcccccggacgctcggtgccgttaaagccccagatggccttcgggcgcagcggatccatgtcgatggtttcgctgccgtagcaccagcagggggtgacggtgatggtgacgccgacgttctggctgctgaatttctcttcacaggcggccgactcggccatgccggcgatgcaggtatcggcaatcacgcactccacccgggcgccgcaggcgtggcgcagtttctcgctgataagcgcggcggtggctttcgccatgttcatggtttgcgcttccagcgactcgcggacccccatgcgacgaccatcgattaccggacgaataccgatcttcggtaagctgatttttttcattacagatccctcaggttatgcggataacaggcttagttcgtcgccgcttgtgaacggaaacgggcaaaaataaagatgatggcgaagcacagcgccgggaccagttcggcggtcgggatattgccggcggcgtcgctgacaaagcccatcaccggggtaactatcccgccgccgataatggtcatgacgataaatgacgagccatatttggtgtcctggcccagatgcttaatccccagcgagaagatggtcgggtactgaatggacataaaggcgctgcacagggtcagggccagcagaccgacgtggccgccgctgaaggcggagagcaagcagagcagcatggcgataaacgcatagatagcgagcacgttgtgcggcgcgaagcggcggataagccaggtgccggtaaaacggccgataaagaagcagaccatggtggcggtcaggtagttggcggcgaaaccggccgtcatgcccgggatctcttcgatagcgtagcgaatcaggtagctccagcaggcggtttgcgcgccgacgtagcagaactgggccagtaccgcccagcgccagtggcggatgcgcatcaggcgcgtcagcgaagcgaaaaaagtgctctgcgcgctgtcgctgtggtcatcgctttgcagggaggggaagcgggtgcagacgatcagcagggcgaccagcaggacaatggccacgataatcatatagggggtttgtaccgacaggaccagactgtgcttccaggcgctgagctgttccggcgtcattttatccagcacctcctgcggctgatgcgggacgttagacaaaataagactctggccaaataccacggcaataatggcgccgaatgagttaaaggtctgggccagattaaggcggaagtgaccgccgctttccggaccgaggacggtgacaaacgggttggccgcggtttccagacagccaagcccggcagcgataataaataatccaatgagaaataaggtgtaattcatcacttcggcggcaggccagaacagcgcggcgccgcaggcatataaaaacagacccgtaaggatgccggctttgtagctgaattttttcatcaacatcccggcggggatgggaataataaaatagccaaagtaaaaggccgattgaattaatccggcctggaagttagtcagggtaaaggcctgttgaaattgcggtaataaaatatcattcagattattagccacggcccacagaaaaaagagggagcacagcagagcgaaaggaataatgtagctcttactctgcccgctctccatggcgcggtaactttgcgttggtatcgttgtgtttcccatagcgtcctcatcagttcagaagcatttacaacagcattcagggcgcagtctggtgctgcagcagaccgcaaaattaagtgagctcaggtgacgcgccggtgagtgaaatgaaagtcacggcggaactcatggcttcattttcaaataaaaaccgtctgttaatatgatgatggtcacacttaacgtactgtgggccattttatgtgattattgtcactttaatttttcaaaaacgctgaccgtttgagaaaataaattcacaaaaccacaacgctaatgaccgaatgaatatatatcgtggaaaacgggcaaatgttacaaagaaataaaatgcccgcttgatgaaatattattaagaacgggcattttaatctctctcgtaatgggcgtggttgctttattcatggcggaataattgacgcggctcacaaaaaataatcatgaaaattcccctttgaatattcaggttgatgatgaagatcattattcaccctatcccacggtagccgacgatatttctgttgccctgccgttgatggatgatgagtcaccaaaagaggaacgcaatggaaagaaacagactggcccggcagattatcgatacctgcctggaaatgacccgcctggggttaaatcaggggaccgccggcaatgtcagcgtgcgctatcagggaggaatgctgatcacccctaccggtatcccatatgaaaagctgacggaagacaagatcgtctttattgatgccgacggccagcatgagcagggaaaactgccctccagcgaatggcgttttcatcaggcggcctaccagacgcgacccgatgcccaggcggtggtccacaatcacgctgtccattgtacggcggtgtcgatcctcaaccggcccatcccggccattcactatatgatcgccgcggccggcgggaattcgatcccctgcgcgccctatgccaccttcggcacccgcgaactgtctgagcatgtcgcggtggcgctgaagcaccgcaaagccacgctgctgcagcatcacggcctgatcgcctgcgaggccagcctggagaaagcgctctggctggcgcatgaagtggaggtcctggcccagctctacctcagtacgctggcgattaccgacccggtcccggtgctggatgacgaggcgatcgccatcgtgctggagaagttcaaaacctacggattacgcattgaagagtgatgccgcaacgctaacaggagagccacgatggcaaacagaatgatcctcaatgaaacggcatggtttggccggggggcgataaacgcattaaccgatgaagcggtgcggcgcggctatcgtaaagcattgatcgtcaccgacagcactctcgcccgctgcggcgtggcggcgaaagtcaccgacaaactggatgccgccgggctggcatgggatatattcagcgacgtgatccctaacccgaccatcgccgtggtccagcaggggctgcaggcctttcaacgcagcggggcggattacctgatcgccatcggcggcggttcgccgcaggatacctgtaaggcgatcggtattattcagcgtaacccggaattcgccgatgtccgtagcctcgaggggctgtcgcccacccgtcagcccagcgtgccgatcttcgcggtgccgaccaccgcgggtaccgcggcggaggtgacgattaactatgtcatcaccgaggaagaacagcggcgcaaattcgtctgtgtcgacccgcacgatattccgcaggtggcctttatcgatgccgatatgatggacgctatgccgccggcgctgaaggcggctaccggcgtggacgccctgacgcatgctatcgaagggtacctcactcgcgccgcctgggctttgaccgatgctctgcacctcaaggccatcgggatcatcgccggcgcgctgcgcggctcggttgccggcgacgccggcgcgggggaagctatggcgctcggccagtatgtggcggggatgggattttccaacgtcgggcttggcctggtgcacggcatggcgcatccgctcggcgctttttacaacacgccgcacggcgtggcgaatgccatcctgctgccgcacgtgatgcgctttaatgctgaggcgaccggggaaaaatatcgcgacatcgcccgggcgatgggcgttagggtggaagcgttaagcctgaccgccgcgcgcgaggcggcagtagaggcggtctgccagcttaaccgcgatgtcggtattcccggccatctgcgtgaggtgggcgtcaggaaagaggatattccggcgctggcccaggcggcgctggcggatgtgtgtaccggcggcaacccgcgcgaggcgagcctggcggatatcgtcgggttatatcaggcggcctggtgattgcctggcccgggtaaagcaggcagttaccctgcaccggcgcacctcttaacgatggtcagcgcgtcagccgcagctgctgcagattgccgtccagctggaggtcggtctgcaggcgggccacctcccggcaggtgaaggccatctcctgatgcgcggccagctttttgcgccacttctccgggacctcggccagacgggcgtacagcccctccaggtcctgaaactcgttcagcagctgggcggcgcttttgggtccaatgcccgccacgcccggcaccttcgagctgctgatccccgccagcccccagtaatccgctagctgctccggggtgacgccgaactcgctggcgatgaagggcgcatccagccagcgcttctgaaagtagtcgcggatgcggatggtgggcgacagcagctgacagtagcctttgtcggtggagacgatggtggcctgatggcccgcctgggccaccttcaccgccagggtggcggcgagatcgtctgcttcgctgcccggcgaggcccagcagcggatcccccgctgttcgaaggcggtccgcagcgccggcatctcggccaccagcgtctccggcatcggcgcgcgtccggctttgtactccggcaggcgctggtgacgccaaccgtgggcgcgatcctcatcgtcgaacaccgccaccgcatgggtgggctgactgtggacgatcagctgctccagggcatgcaggcaggtatcgacgcagggtgaaccctgcaccgcgtgaatgcggcggattagatttaacgcgtcgacgattaacagatgaacagccacagatacccccccttattctcagcgtctttagggtaacatcgccatcagatcgaggctatctgcgcctgaacaatcaggaagataacgcgcaaatttcgctaactgaccgccatcagcggtctgatgacgtccggcgcgggttcgccgtaccacaccgcttcgcgcaccgggaccggtttggcgataagcccgagggcgtaaaagcgatcggcgatggtctgctgggcgcggatcaccgacagatccatcggccgcgggcgatggctgcggcgggcgagggccatgctcagcgaccgggcgtcgatccccagctctgccgagagtaagcgggccgcttcgccgcgatgcgagtcgataaactgcccggtgtgggtcagctccgtcagcaggcggcgcatgatatcgccatgctgagcgaggtagtcccgtcgcgaaagataaaactgatggttgttgacccggccttcgccgctggcgaccacccgcagctcgccggtgtgttcggcgtcgctgagcagcggatcccacatcatccaggcgtcaaccgccagatagtcgctggcggtcagcggatatttcggcggggtatagaccacccgcacatcgttcagacccaggccggcgtcctcgaggatctgcagcagcagccagtggacattcgaccctttattgagggcgatgcgtttaccgcgcagatcgctgagctggcgaatgtcgctctcctgcgggacgaccatcgccacgctgcgcggcgccggcggctcccacgccacgtacatcagttcgctattgctggcctgggcaaacaccggcggcgcttctccggtggtgccgaagtcgatctcgttgcaggcgagggcgtggaggagctgcggtccggcaggaaactcactccacagcacgttgacgccgaggctggcgaaggcggtttccaggctctgacgggctttcaggatcccgaggctgccgaagcgctggtagccaatgcgcagttcgcgatcggccccggctgcgttggcgaacgcccgcggcggcgcaggcgggcggcggcggcttttgatcagcccgaggttagcgagctgggtgcgcaaggtatgccggctgatccccaacagcgcggccgcctggctctggttatcgtcgcaatgcgccatggcgtggcgaatcagggcgctggtcactcgctgccacagcggctcgccgggaagcgccagctggtggcgaataaagtcgtccagttcatgatcgctcgccgcccccggggcgtcgttgagcgtcgccaggcgcagctgggcaggactgatctcctcttctttactgagcagcaccgcgttgtgcagggtgttttccagctcgcgaatattgcccggccacgaatagtccatcagccgggccagtgattccggcgccagacgcagggttggccgcccgaggcgccgggcgtagagtgataaaaagtggtgcgccagcagcgggatatcctgccgacgctggcgcagcggcggcagcggcaccaccgcgatattcagtcgatagtagagatcctcgcgaaagcggcgctcgcggatcgcctgggccaggtcaacgtgggtggcggcaatcacccggacattcactttaatcgctttgcgtgagccgacgcgggtaatttcacgctcctgcagcactcgcagcagcttgacctgcagcggcaggcttaattcgccgatctcgtccagcagcagcgtccccccttccgcggcttcaaaccagccgggctgtccctgctgcgcgccggtgaaggcgcctttctcatggccgaacagttcggcttcggcgaggctctcggtcagcgcgccgcagttaacggccagaaacggctgctggcgacgggcgctgtgatgatggagatagcgggccaccacctccttgccggtgccggtttcgcccacgatcagcacggtcgcctccgttggcgcgagtttgtccagcaggctctggaaggccttcgacgccgggtcgatcagcgcgggagcggtggaaggggattctgggttcagcatagagggcctccgatcgttgatgctctgaacttatcctgcggcggccgcagaaaccagagggggaaggcccgcggctgttgcaaatgcgccagcggatgcgcggcggctgcgcgatttgcaacagcgcggcgcggcgaagccgttttcagggcattgattttaaaagattaattttttattcaccattggcatgattatcgctaacactcatataaccaaattaaaacatctcttcaataaatatcggatatggttatataggaaatagataatgacgcagcaagctcccgacaagatcaatgtcttctggttcttacctacccatggcgatggccgttatctgggtaccaccgagggtggacgcccggtcgatttaccttatctgcagcaggtggcgctggcagccgacagcctgggctactacggcgtgctgatccccaccggtaaaagctgtgaagattcgtggctggtggcctcggcgctggcgccgttgacccgccgtctgcgctatctggtggcggtcaggccgggcctgcagccgccaaccctggcggcgcggatggcggccaccctcgaccgtttatcggaaggtcggctgctgatcaacgtcgttaccggcggcgacccggtggaaaacaaaggcgacggtatcttcctcagccacagcgagcgctatcatgtgacccgcgaatttcttgatgtttacacccgcctgctgcgcggggaaaaagtggattatcacggcgagcatattcacgtggaaggcgctgaggtgttgttcccgccggtgcaggagaatggcccgccgctctatttcggcggctcttctgatgcggccattgatgtggcggccgagcagatcgacagctatctgacgtggggcgaacccccggaactggtggcggagaagctggcggtggtgcgcgagcgcgccgcggcccgcggacgcatcctgcagtacggcattcgtctgcacgtcattgtgcgcgaaacggaagaagaggcatgggccgccgccgaccggctgatcgcccatcttgacgacgataccattgcccaggcgcaaaagatcttcgcccgcatggactcggccggccaggcgcggatgagcgccctgcatcagggatcgcgcgataatctgcgcattgcgcccaatctgtgggccggcgtcggactggtgcgcggcggcgcgggtaccgcgctggtaggtaatccgcagcaggtagcggaacgcatccgcgaatatcaggcgctcggcatcagcaactttatcttctccggttacccacatctggaagaagcgcaccgctttgctgagctggtgatgcctctgttgccgctggaaaacggggcctcgtcgaaggcgcgtagcgtgaacaccggtccgtttggcgaaaccatcggcggcgataagcgcccggtgcgccaggtcagcgccagctgatggcccggagcgcgaccatgagacagcataccggaggagggcagcgatgagtgcagaaccgcatatcgtgattatcggcggcggctttagcggcgcggcggtggcgattgagctgctgcgcctggcgccgaacggggtgcgcgtgacgctgctggagccgcgccagtcccccggggccggggtggcctactccactgcggagccgacgcaccggattaacgttccggccgctcgcatgcagctggccggcgacgaagagggcgccttcgatcattggtaccgccatcagcctgcctttaccgtcgatgtgcaggcgctgcgcccggacggttccgtctaccctcagcgcggccagtttggtcgctatgtggcgcagcgttttgccgacgccgcggcgtccagcggcggacggcttcgccacctgcgcgatcgggcgctcgcttttcatcaggggacggtgaccaccgacggcggcctgcagcttaaggccgatctgctggtgctggcgatcagtcatccaccgccttcgctgccggcacaggccgaagcctggcgtcatcatccggcgctgattgccaacccgtggcagccaggcgcgctcgatgccatcgccccacacgcccgggtggcggtgatgggcaccggattaaccatggccgatacggtcgcgacgctggaccggctgggccaccgcggcagtatcgtcgccttttcgcgccatggcctgctgtcgcgcggcaaccttagcggcgcaggggcaacctggcctggcgactatcagcagggcagcctgcgccagcgcctgcgccagatccgcctcgacgtcgcgtatgcggcgcagcagggcctgagctggcaggtggtgctggatgcggttcgtcagcaggggcaacggatctggcaggcgctcagcgtcgccgatcgccagcgttttctgcgccatctgcgccattactgggatgtccaccgctaccgcgtggcgccgcaggtcgccgaggtgctggaggcgcgccagcgcacgggcagtctgcaggtgcaggcggccaggctactgtcgataagcggtgaaggcgaaacgctgcgtctgacgctggcgcggcgcggcggcggcgtgcagacgctgagcgtcgatcacctgatcctgaccaccggacccgcacaccgcgccctgaccgacagccagccatttttacaggacctcgcccgccgcggcctgattcgcgccgatgccctcggcatgggcctggaggtggacagccgttcccgggcagtggctgagccgcacgttgaggcgctgccggtgctggtggccggtccggccgcccgcgggcgttttggcgaactgatgggcctgccgcaggtagccgaccatgccgctgacgtggcggcgcaagcgttactcacgctcgggatcccgcaggactcccgatgtcctgcgtactgaatacctctctttcttttccctgattcattttgccgcgtgcgccccggcgacgggccgcgctatggagattgctatgtcatcacaacgtgaaattcgtcttaacgctttcgatatgaactgcgtcggccatcagtcgccgggcctgtgggcgcatccccgggatcgctcctggcagtataaagatctggagtactgggtggatctggcgcggctgctggagcgcggcaagttcgacgggctgtttatcgccgacgtgctggggatctatgacgtgctgaacggcagcggcgatgcggcgatccgccaggcgacgcaggttccggtcaacgatccgctggctctgatcaccccaatggcgctggtgacggagcatctgggcttcgggctgaccgcctcgctgtcgtttgagcatccttaccccttcgctcgtcgtctgtcgacgctcgatcatctgaccaaagggcgggtgggctggaatatcgtcacctcctatctggagagcggggcgcgcaatatcggccagcagacccagaccgaccatgacacccgctatgactatgccgatgagtatttgcaggtgatctataagttgctggagggaagctgggaggatggggcggtgctgcgcgacagagagcggaagatcttcagcgatccgcggaaaatccatcccattaaccatcagggacagttcttttccgtgccggggatccacctctgcgagccatccccgcagcgcacgccggtgctgtatcaggcgggggcgtccagccgcggcaaacagttcgccgccggccatgccgaatgcgtcttcgtcgcagcgccgtcgaaggtgctgctgaagaagacggtggcggatattcgccgccgggcagctgaggcggggcgcgatccgcacagcatcctgatcttcaacctgcagacggtaattgtcggcgacaccgaccgcgaggcacaggcgaagtggcaggaatataagcagtacgtcagctatgaaggcgcgctggcgctgctctccggctggacggggatcgatttcggccagtatcagccggatcaggtgctgaagtatctgcacaccaacgccattcagtcggcggtggaggccttttcgaccgctgatccgaaccgccagtggacggtgcaggccctggccgattgggcggggatcggcggcttcggtccgctggtggttggcagcgcgcaaaccgtggcggacgagctgcagtcctgggtcgaagagacggacgtcgatggctttaacctcgcctatgccgtcactcacgaaaccttccgcgatgtcgtcgagctgctggtgcctgagctgcaaaagcgcggcgtctttaagcaagagtaccgcgaggggaccctgcgcgaaaaactgttcggcggcggcccgcgtctggccgcgcctcacccgggcgccagctaccgccgcgatgcgcgcacggcggcatcggtagaggagaaggtgacatgatcgctattgatgacctgtataaaagttaccgcacggcggatggccggctcagcgcggtgctgaaagggctgtcgctgcaggtgcctgagcgctccatcaccgcggtggtggggccgagcggcgccggtaaatcaaccctggcgcgctgcatcagcctgctggagcaaccggacagcggcagcattcgtatcaatggccaggatctgtcagcgctgtccggcgaggcgctgcgccgggaacggcgggcgattggcaccgttttccagtcttcggcgctgttgagccgcaggaccgcctgggagaatgtcgccctgccgctggcgtggcttggtgtggtggagcgcgatatcaaggcgcgggttggcgagctgctggagagcgtcggcctgagccacaaagcggatgcctggccggcccagctctcaggcggccagcgccagcggatcggcattgcccgcgcgctggcgctgcgcccgtccgttctgctggcggatgaagccacctccggcctcgatcctcaggccacggcctcggtgctggctctgctcaagcggctgcgtgatgagtaccagctggcgatcgtcctgattacccatgaaatggacgcggtgcgcacggcggcggatgcggtggcggagatccgcgacgggacgatcgtccagtacgggcggatcgaagatctgctggcgcgtcccgattctctgctcggccagcagctgttgccgctgacgccggcggcagctacccacagcgatctgctgctgcgtctgagctaccgctgggatgtgccggtggccaccgactggatcagccgcctgagccagcagtgggcgctgcagatcgatctccttggcggtcacgtcgaggtgattaatggtcggctggccggtcgcctgcaggccggagtgcgctttcagggcgaacgcctgtcgcccgcgcgactgcagggcctgctggcgcagctcggcataacggcggagatcctcgacagcgcgccgttgctcagggaggcggtatgaaaccgacagtcatcagtcaggataccccctggggcgaaatcccttcgctgctgctccccgcctatggcgaaacctggctgatggtggccattgtgatgctgtttgtcgtcacgctgggagggctggtgggggtggtgttgtttaatgcctcgccgcggggcttatttccgcacgcactgctgtaccggctgctgaactgggtggtcaatatgggacgttcgctgccgtttctggtgctgatggccgccattatcccgttcacttactggctgaccggcaccacgattggcatacccgccgcggtagtgccgatgatcgccgccggcgtcccgttctttggccgtctggtggagaacgcgctgcgcgagttgccggcggaggtcaccgcggtgggggtcgtctgcggcgggtcgcgctggcaaatcattgccagcgcgcagctcagtgaagccatgcccgcgctggtagcggcggtgacgctaaacctggtctcgatgatcgagtattcggctatcgccgggaccatcggcgccggcggcatcggctacctggccgtggtgtacggctatcagcgcttcgacaaccacatcatgatcgcgacgatcgttgccctgatcgccacgatccagttgattcaatttttgggtgaccgtctggtcaaccgtttacgccacacgcaggggaaccttgtatgacaacagagcaatttgagttacgtaaagcgcggcgctggccctggctggcggcgctggcggtgattatcctgctcgccatcgccttctggtggtggcggggacatacccaaagccagcaggtggtcttcggcagcacgttaaaaattcactacgagccggcgatggccggcgagcagcggatcattgagtatattaatcagcatattgcgcccgattacggtctgaaactggaggcggtgggggtgcaggatccggtccaggctgaccgcgcggtagcggaaggtcagtatgccgggacgatctatcagcatcagtggtggcttaaacaggtggtggacgctaacggctttgcgctgtcgaccacggtgccggtgttccagtgggcgtttggcatctattccgaccgctactcgtcggtacaggcgttgcccaacggcgcgaccattgtcgtgcctgacgatggcgccaatcaggggcaggccctgtggctgctccagcgcattgggttgatctcgctcgacccggcggtggagccgcgcacggcgaagctgaaaaatattgtcggtaacccgcatcagtttgtctttaaagagctggatctgctgaccatgccgcgggcgttaaattcggtggatgccgccatcggctatgtctcgcaatttgacgccgggaaagtgccgcgtgagaaaggcatattattcccgccggcgccgcgcacctttgcttcgcaattagtgattggtacaccgtatttatcgcaggaaaatatcgtcaaattaaaacaggctttttctgatccgcggatccagacgtggttaaaaaccaccgatgacccgctggtaaaagacgtattagttccagtgtccgcggaataagcgtcctgcacgacgtctattttcgttgttatttatttcacttgaggatgcgtgaaagcgcgtcctttttgtgctggtgatatttattaacttattgattatattgatttttatagaatgatttgttgtttttattctcgtcgcgcgcggtctataaccgctgatgacctgcacaaaataataaggtgaaaaaatgagtacattaccagtggataatcccggtatcgcttcggtaccggtcagtagcgtcggggatgtggcgcggctaattaattccggcaaggaacaagcgaaatatgcgcggatgattgtcttcctcgcgctggggggcgtttttctcgacgcatatgacttaaccacgctctcctacggtattgatgacgttgtacgtgaatttcagctctcaccgctgctgaccggcctggtgacttcgtccattatggtcgggactatcgtcggcaatattatcggcggctggctgaccgataaatatggtcgctattcggtttttatggccgatatgttctttttcgtgatttcggctatcgccgccgggctggcgccgaacgtctgggtgttgattggcgcccgcttcctgatgggcatcggcgttggcatcgacctgccggtagcgatgtcctatctggccgagttttcccgctttgccggcaaaggcaacaaagcggctcgcctcgcggcgtggtgcccgatgtggtacgccgcctcaaccgtctgctttctcattatcttcggcctctatttcctgctgccgcaggagcatcttgactggctgtggcgcgcctccctgctgttcggcgccgtgccggcactgctgattattgccgtccgcagtcgatttatgaatgaatccccgctgtgggcggccaaccagggcgatctgacctctgcagtgcgtattttacgcgactcctgggggatccatgcccatgaggtcccggcggcgaagcccgcgccagcgccgaaagtgagcttccgcgtgctgttcgaaaaaccctaccgcgagcggactatcgtcgccggggtgatgaatatctgtatctccttcgagtacacggcgattgcctttttcctgccgtcaattcttgcccagttcctcggggctggcgtcttcgaaactatttcggcatcgctggggctgaacgccctgtttgcttttaccggtgggctgcgcggtatgcatctggcgtggaaatatccttcgcgtcatgtggcgatagccggcttcgccctgcagtttgtggcgctgattgtgctggcgctggtggggcaaccgcacgcgacggcaggtatcgtgctggctatcgcgatgctggggctgtggctgttcgccgaagggtttggcccgggggcgcagctgatgatctacccggcgctctcctatcctactgccattcgcgccaccggggtcggtttcagccgggcactctccgggatcggcagcgcgctggcgttgtttattctgccgctgctgcaggcctccctcggcacgcagatgttctgggtggtctcgcttgccgccattattcccattttcttcctgctggcggtccgtcatgaaccgacgcgagaagatatcgacgcacttcatgaataaggaactgacaatgaccctgctctccactggcaccgattatgacgcgctggcggccgccttccgcccgatattcacccgtatcgcccagggcgctgcggagcgcgaacagcagcgcattctgcccgatgagccgatccgctggctgaaagaagcgggcttcggcacgctgcgtatcccgcgcgagaagggcggctggggcgcttcgctgccgcagctcagcgcgctgctgatcgagctggcgcaagcggactctaacctgccgcaggccctgcgcgcgcactttgcctttgtggaagatcagctgaatcagccggattccgccgggcgcgaccgctggtttcgtcgcttcctcgacggtgagctggtgggcagcggctggacggagatcggcgcggttaagctgggagaggtgaacaccagagtgacgccggcagagggcggctggcgactcgacggcgagaagttttacagcaccggcgcgctgtacgccgactggatcgatgtgtttgcccggcgcagtgataccgccagcgatgtgatagccctggtcagcacccagcagaccggcgtggtgcgggaagatgactgggatggctttggccagcggttgaccggcagcgggaccacccgctttaccggcgctcgggtggaaaccgaacatgtctatgattttgcccagcgctttcgctatcagaccgccttctaccagcatgtgctgctggcgaccctcgcgggcattggcctggcggttgagcgggatgccgcgcagggcgtcaaacatcgctcccggatgtacagccacggcaacgccgccgtgccgcgcgatgacgcccaggttctgcaggtcgttgggcagatcagcagctgggcatgggcgacccgggccgcggtcctgcaggccgcggaatcgctgcagcaggcctatgtggcgcacgtcagcgacgacgaagcattgattgcccggcgtaaccagctggcggaagtggaagcggcgcaggcgcaggtgatcgccagcgactggatcccgcgggcggcgacggagctgtttaatgccctcggggcgtcggatacgcgaactcgccttgcgctggatcgccactggcgcaatgcgcggacggttgcctcgcataatccggtgatttataaggcacgtaatatcggtaactggctggtgaacggtgaagcgcccacctttatctggcagataggcaatggtgagaaaacggcggggtaagcctgtcggcgacgggaggcgcagagcttcccgtcgtcaggaaaatcaaggtttatccagcgaccaggtggcgctgcgcacgtcgactttcaccggcagcaggccgatgcgcgtaaaggtatccgccagcgcctgctgttcgttatacaccgccggggtcatgcgttcggcaccgtagggcaggcgggccagggtcttcagccagatggctttatccagtccggttgaggtcgacagcagcccggcggcctcgtcctgatggctgttcgcccacgcgctgagtttacccagctcatccaccacctgctttgctgtctccgggtaggtatctgcaaacttgcggctggcgagatagaaggtgtagtgcggcaccagcccctcggcattgcggatctgtcgggctttcgcgttggtttccacttctgcgaggaacggatcccagatcacccacgcatcaatcgccccgcgctggaaagcggcgcgggcgtccgccggcggcagatagaccggggtgatgtctttatagctgaggcccgctttttccagtgcggcaaccagcaggtagttgacgtcagaccccttgttcaaccccacgcgcttgcccttcaggtcggccacgctgtggattgccgactgttcaggcaccacaatcgcttccgttttcgggttagcgggggagtgggcaaggtagaccagatcggcttgcgccgcctgggcaaaggccggaggcgcatcgccggtcgcggccagatcgatactaccgacgttcagcccctccagcatttgcggcccggcggggaattcgacccagcgtacggcaatgccctgttttttcaggctctcatccagcgtgccgcggtacttcagcagcgcgaagatattcgccttttgatagccgatgttgacggtttccggcgctttggccagcgcggaggtagagagggcggcgaggaccagcagccaggcggggcggaatcggttggacattgtctgttctccttagcggttttgcgtaaggtaacaaacagcgcttataaccattaaataactaaaattttattgatataacaaaaagagttatgcaggacgatggcccgacacgccgatgcgtggcgggccagcaggttaatcgcaggcaacaatcttcatcgccagaccaccgcgggaggtttcccggtacttggcgttcatgtctttgccggtttcgtacatggtctcgatcactttatcgagacacacgcgcggctcgctggtccggcgcagcgccattcgcgcggcgttgaccgctttcacggcagcgatagcgttgcgttcgatgcacggcacctgcacctggccggcgaccgggtcgcaggtcaggccgaggttatgctccatagcgatctctgccgcgatgcacacctgacccgggctgccgcccagcagttccgccagaccggccgccgccattgagcaggcgacccccacttcaccctggcagccgacttcggcgccggagatggaggcgttcatcttatacagcgaaccaatcgcgctggcgaccagcatatagcgggccagggagttgctgttcaccttgcggataaacttgtcgtagtaggccagcaccgccggcacgataccgcaggcgccgttggttggcgcggtcaccacccggccgccggcggcgttctcttcgttcaccgccagggcgaacatattgatccagtcgaccaccgccatcggatcgctgttggtggtgtcctggctcaccagcatacggcgcagcgcggcggcgcggcgcgggacgcgcagtttgcccggcaggacgccttcggtggtgatgccgcgctcgataccggcgctcatcacttcccacaccgcggcgaagtgttgctcaagggcttctttgctgtgcagcgccagttcgttctgcatcatcaggccggagagcgacagcccggtttcacggcagtgacgctgcaggtcggcggcgtttttgtaagggtaaggaacggcaaccggcgcctcggtagtctggccgaagtgctcctcatcaacgataaagccgccgccgatagagtaatacgtctggctgtagagcaccttgtcgccggccagggcggtgatacgcatgccgttctcatgcagcgacaggttgtcggcatggaaattcatgcactgatccaccgggaagtccacttcgtgcttaccgttggccagcatcaggcggccatgggtattaacatcctgaataaagcccggaatggcgtcgatgtcaacggtgtccggcaggttgccggcgagtcccatgataatcgcgatatcggtatggtggcctttaccggtcagggagagggagccgtagacgtcgacgacgactttgctcacctcggccagcaggccgcgcgcgatcaggtcgtcagtgaattgtttgcccgctttcatcggtccaacggtatgggagctggaagggccaatgccgattttaaagatatcgaatacgctgatcatatgtattcccgtgctgtcggaaagcgcgccgccgtaaagcggcgcggggggaggcgttgaatgaattagctgaacagagagtagaagatcgcggagatggcaatcaggcccataatcaccacgaagacgttgctgatatggccgctgtatttacgcatcgccgggactttctgaatcgcgtacatcggcatcaggaacaggatcatcgcgataatcgggccgccaagggtctcgatcataccgaggatgctcgggttcagggttgccacaatccaggtggtgatcagcatgaacagcgcggtcagcttgttcagtttgttgatttcaatcgatttgcctttactgcgcagggatttaatcaccatgccgttaaagccttcgcgagcgcccagatagtggccaaggaaggatttggtgatggcgatcatcgcgatgatcggtgccatccaggcaatgattggcgcgttaaagtggttcgccaggtaagacagaatcgagatgttctgctctttcgccgccgccaggtctgccggagagaggctcagaacgcagctgaagacgaagaacatcacggtcagcaccatcatgatgtgggcgcgcgcgaggatactggagcatttcttctcagcgccttcgccgtactcttcacgtttggctaccgcgaaggaagagatgatcggcgagtggttgaaggagaagaccatcaccgggatcgccagccacagggtcatcagcaggccgttgccggtaacggaagcgccgctcagggagagcgtctctagcgccgcgccgttccactgcgggatcagatacagagccagcaccatcagcgcgataacgaatgggaacaccagcacactcattgccttaacgatcatctgctcgccgaaacgcacaatggtcatcatgccgacaatcaggatcagcgacagaatggcgcgcggcggcggcgtcatatgcagctgatgcgccatgaaggtttcgacggtgttagtgatcgccacgctgtaaaccagcaggatcgggtagatagcgaagaaataaagcagggtaatcagcttacctgcgcctacgccgaagtgttcttccactacttcggtgatgtcttcgcccgggtttttcccggagagcacgaagcgggtcatgccgcggtgggcgaagaaagtcatcgggaaggccagaatcgccatgatgatcagggggatcatgccgccaacgccggcgttgatcggcaggaacaagacgcccgcgccaatcgctgtaccgtacaggcccagcatccacatggtgtcggttttacgccatccgctgcgggtttcgcccgaaacgatggtgctggtttgagtggtttccatctgtatctcctggaggaatcaacaaaatctaatgaataaatacaattgcgtaacatgaaattcgtttaattacggtttttttagaaattttctccgtaataattgggccggaaagatacatttatatggtttatgcatcagtgatcgcgatctcaaatgcaataatccactttcaatgtgcgtatttttagtccaacagcctgtttctggtgatcagccagcgatttgtggcgcgaaggctaccatttgcagcatatgagataaaagcggagcggcgtaataacgagggatttactgtaaaaaagagaactagtcgacgtttttgcgcttaaaaccattttttgcagtgataattgtcgcagtttttaccaacgcaaacgtttggctatgtagaaataattcaggtgattgattagtaacagaaaggtttttagcgcgttctggaagtcagaggaagagagcccgccgggggcaggcgtcaggcgatgccccggcgggagagtgggaaatcaggcgatgatttcgtagcaaggaatataggcggtgccgcccggaagcttcatgcggtgctgggcgacgaagccctgcagcagatcgtccatacggcgcatcatctccggatcgccgtgcagtttgtaaggaccgtactgctcaatggcctggatgcccacctctttgacgttccccgcgacaatcccggagaaggcacgacgcaggtcggcggccagcacttccaccggctgatccggggagagtttgaggttggccatgttctcgtgggtcggatcaaacggcatctgcaggtccggcgagatgcgaatcgaccagttaaagctataggcgtcatcggtctcgcgacggctctctttcaccagcggcatcgcttttttcatctgccgcgccacttccgcggggtcgtcaatgatgatccggtagtggcgacgggccgattcgcccagggtatgggtgataaactcgtccagtacgcggaagtagtcggcgctctccttcggcccggtgaggatcagcggcagcacctgcgctttgttgtcggggtgcatcagaatacccagcaggtagagcagctcttcggcagtgccgacgccgcccgggaaaataatgatcccgtgggcgatacgtacgaaggcctccagacgcttttcgatatccggcatgatgatcagttcattgaccagcgggttcggtggttccgcagcgataatggatggttcggtcatgccgataaagcggctgtctttgtagcgctgctgcgcatggccgacggcggcgcctttcatcggcgcctccattgcgccaggcccgcagccggtgcagatattcagttcccgcaggcccagctgcgtaccgacgcggcgggcgtagagatattcgttttcgttgatggagtggccgccccagcagacgatcatgttcggcgcctcgccgacgtgcagcgcgcgggcgttgcgcaggatcgagaacaccaggttagtgatatgaaccgaactttcgagatcgaggttcgggaagcgaacggtattgtggatctggccgtaaacgaacaggatatcgcgcagcacggcgaacaggttggcctgcagggagcggataatccgcccgtcaacgaaggcgtcttccggcgggttgatcagttccagcttcacgccgcgttcgcgccgcagcacgttaatctcgaaattttcgaaacgggacaggagctccttgctgttatcggtcaggctccccgaattgagcacagcaagcgagcagttgcgaaagagttggtacaggtcgctgctggcggtgcgcttaagcatatccacttccagctgcgacagcatatccattgaaccaagcgggctaacatgtgtaatcaagtgaactccttacaggacgcttatggtcttcctgtgattacaatagccctgcgaacggcgtttccacaaccttgcgcgcgcctaaacgcacgcaaattgtgaaattgtttattattgacgggcgaggcggccggtggcgggggaaaagtcgccattgctgcgccaggggttgatatccagaccgccgcgtcgcgtatagcgggcgtaaacggaaagcgattccggctggcagaaacggagaatatcgttaaagatacgttcgacgcactgctcatggaattcgttatggtggcggaacgaaaccagatagcgcaggagctgctcgcggtcgattttcgccccccgatactggatctgcaccgagccccagtccggctgatgagtgataaggcaattagacttcagcaggtggctgaccagcgtctcctccacgattttgccgctggcggcgccctgcaggtaatcggcgctgaactgatagttatcgatctcgatatcctgatcgtcgatgcaggtgccgtgcaggcgggcaatcggctggccttccagttcatccaggcggtagagcgataccttcaccttcccctgcgcgcaggcgctgagatcgcgagtcagcgtctctgcaacgtcctgccagctagcgaaacgggtctggttaaagctgttgagatagagcttaaagcttttcgactccaccagattgaggctggtatcgggcagctcgacgtggccgacagctacctgcggcagacctttgccgttcagccaggagagttcgtacagcgtccagatatcggcgccgtgaaacggcagattatcggcatgcaggcccagcgggtcgcggtttaaactgcgcggcacgccctgcagcagcgaggcgtcataggtatcgcggtaatcggttgatttaccgagcgtcaggccggccagcgcctgatgattatcgtaagaagacatgtttcaccatagtaaagcgggtacactattgctccagtgtatcctgtctaacgtgaagagagaaaccggtggaccatcagacagcagaagcgctacgcgcttttacccaacgatattgcgccgtctggcagcagcagcgccacagcctgccgcgcagtgaagagctttacggcgtcccgtcgccttgcgttgtcgacacccagggcgaggccgttttctggcagccgcagccgttttcgctggcgcaaaatatcagcgcggttgaacgcgccctcgacattgtggtacaacagccgcttcattcttattataccactcagtttgccggcgatatgtccggccggtttgccggcgaaaccttgacgctgctgcagacctggagtgaagaggatttccagcgggtgcaggaaaatttaatcgggcacctggtggtgcagaagcggttgaagctgtcgccgacgctgttcatcgccaccctcgagagtgaactggatgtgatatccgtctgtaatctcagcggcgaggtagtcaaagagaccctcggcaccgccaaacgcattacgctttctccctcacttgcgggtttcctcaaccaccttgagccagttctgtaatccagtctgccagatcgtttgtgagagatctcttacaaaacctgtaagagatcgtcatcatttaaggtaaatttaatccatacttttttatataagttgttggtattaaatcagatcttaattttttcgtccttttgagtggggactaatcttaagagattgtctcaagaagggttgtaagaaggggcagaatcagtgatcctatgtctgtcgacaggacgtcgcgaaatgaagcgaacatcaggatgatggcgcttctgcaggacccgccaggacggcgttgcagggacaggcttcaggatgaagcaaggataacgcaggatcgcgtaatggacacctccaggatggagaacgagagccgctcaggatgaacggtggatcaggaagatcgggacaaacttatggataagtcatttcgcatcggggtggtgtgaaagcaggatgcacgtgtttatggatgaacatggtcaggagacctcaggaaaagttttcaaggacgagcagggagcaccaatgtagcgggactgctgcaaaacgaaccgggagcactgtttatacagtgctccctttttttatttctcctgcggatttgctatcctgcgcccggtttttaactcatcgaggtttccccatgactcttcacgatagcgtgcgcgatcgcctgcgcgccattgaagccctgctgcgcgaaacggagcactggcaggagacggcgccggacagcagcgccttcgccagcgataagccgttttgcctggataccctggagccgctggagtggctgcagtgggtcctgatcccgcgtatgcaccagctgctggagagcggccagccgctgccgcaaaattttgccgttgcgccttattacgagatggctctggatcaggcccacccggtccgcgaatccatgctggcggaacttctgctgttagacgcgctgtttgccggtgagcaggcctgatgctggagattatctaccaggacgactggctggtggcggtcaacaaaccctcgggctggctggtgcatcgcagctggctcgatcgcgacgagaaagttgtggtgatgcagaccgtgcgcgaccagatcggtcagcacgtttttaccgctcatcgtctcgaccggcccacctccggcgtgctgctgatgggattgtcgagcgaggcgggccggctgctggcgcaacagttcgagcagcaccagatccggaagcgctaccatgcgatcgtccgcggctggctgatggaagaggcgctgctggattacccgctggtggaggagctggatagaatcgccgataagttcgcccgcgaagataaagggccgcagccagcggtaacccactaccgcggtctggcgacagtggagatgccagtggcgactgggcgctatcccacctcgcgctatgggctggtggaactggagccgaaaaccggccgcaagcaccagctgcgccgtcatctggcccacctccgtcatccgatcctcggcgacagcaagcacggcgatctgcggcaaaaccgcagtgccgcggaacatttcggctgccaccgcttgatgctgcacgccagcgagctgtcgttaacccatccttttaccggcgagccgctgaccctgcgcgccggttttgacgacgtctggatgcgcgcgctgtcgcagtttggctggcgcgggcttctcccgctaaatgaaagggttgagtttgccgacgacagcggtcaggatgaagagaataaggtcaatccagggagataatagcatggcggaagtcggaatttttgtcggcaccatgtacggcaactcgctgctggtcgcggaagaagcggaagcgatcctcagcggactgggacacaaggctaccgtgtatgaggatccgcaggtcaacgactgggaatcctacacgggtaagtatgtgctggtggtcacctccaccaccgggcagggcgatctgccggacagcatcgtcccgctgtatgagggcatcaaagatatgtatcagcctcacctgcggtacggcattatcgcgctcggcgacagcacctatgccaacttttgcggcggcggcctgaagttcgatcagctgctgcaggagcagggcgcgaagcgcatcggcgagatgctgaagattgacgccagcgaagacccggagccggagagcgtctccaatccgtgggttgagcagtgggccaccctgctcgcataaaagcgctgccctctccctacgcagagggcgctctttcaatacgtcgcggccagatacgcggacgtcaaaatagtagcgctttccaggcgccacgcctttaggcaaacgccacaatatccttaacaatatcatggcttaagccagccagtttcaccgggtcaagtgaggtatttcacactccggccctttttgctgcgctatgcggcgccagcggcgctggcttttcatttccgtgaacttccccccattctttcaggcattcgccacaaaccacctgcaatagcggcgtaaaagctgtgtggatgcacggtgagccgcggtgtgcctcttcatatactgctccagccagtgataaatgcagtgccagatataacgacaactatcaaaacacgaccacgtcattctgattaccctacaggttgtgctgttcagaatgaacgtagctaaacgctatgattcaggagtacaacaatgagttcattaagtcaggcggcgacggcggctgaaaagcgcaccaacgcccgctactggatagtggtgatgctgtttatcgtcacctcttttaactatggcgaccgggcgacgctgtcgatcgccggttcggaaatggccagggacatcggccttgatccggtggggatggggtatgtgttctccgccttctcatgggcttatgtcatcggccagatcccgggcggctggctgctcgaccgcttcggctcgaagcgcgtctatttctggtcgatcttcatctggtcgatgtttaccctgctgcagggcttcgtcgatatcttcagcggctttggcattatcgttgcgctgtttaccctgcgcttcctcgtcggccttgccgagtcgccgtcattccccggcaacagccggatcgtcgccgcctggttcccggcgcaggagagggggacagcggtatcgatttttaactccgcccagtactttgccaccgttattttcgcgccgatcatgggctggctgacgcatgaggtgggttggtcgcatgtgttcttctttatgggcgggctggggattgtgatcagctttgtgtggctgaaagtgatccacgatccgaacaaccacccgggcgtgaaccagaaagagctggactatatcgccgaaggcggggcgctgatcaacatggatcagaagagcagcgcgcagaaagtgccgtttagcgtcaaaatggggcagatcaagcaactgatcggctcgcggatgatgatcggcatctatatcggtcagtactgcatcaacgccttaacctacttctttatcacctggttcccggtttatctggtgcaggcgcgcggcatgtcgatcctcaaagccggctttgtcgcctcgattccggcggtgtgcggctttgtcggcggggtgctgggcggggtgatctccgactggttaatgcgccgcaccggctcgctgaacattgcgcgcaaaacgccgattgtgctggggatgctgctctccatgaccatgctgatgtgtaactatgtcaacgtggagtggatggtgatcggctttatggcaatggccttcttcggcaaagggatcggcgccctcggctgggcggtgatggcggataccgcgccgaaagagattagtggtctctccggcggtctgttcaatatgttcggcaatatctccggcatcgtcaccccgatcgccatcggctatatcgtcggcaccaccggctcgttcaacggcgcgctgatctacgtcggtatccatgccctggtggcggtgctgagctatctggtgctggtgggcgatatcaaacgtatcgaactgaaacctgtagcgggacgttaatcatgactactcaatccagcccgattatcacagagatgaaggtcattccggtggccgggcacgacagcatgctgctgaacatcggcggagcgcataacgcctggtttacccgcaatatcgtggtgttaaccgataacgccggccataccggcgtcggcgaagcgcccggcggagaggtcatctaccagacgctgctggcggcgatcccgcaggtggtgggccaggaggtcgcccgactcaatcgcgtggtgcagcaggtgcacaaaggcaatcaggcggcggatttcgacaccttcggcaaaggggcgtggaccttcgaactgaaggttaacgcggtggcggcgctggaagcggcgctgctggacctgctcggccaggtgcttaatgtgccggtctgcgagctgctgggcccgggtaagcagcgtgatgccgtcaccgtgctgggctacctgttctatatcggcgatcggcagaaaaccgaccttggttatctggaccatacgccgggcgatcacgaatggtaccgcctgcgccaccagcaggcgttgagcagcgaggcggtaatgcgtctggcggaagccgcccaggatcgctacggtttcaaagactttaagctcaaaggcggcgtgctgcccggcgagcaggagattgacaccgcgcgggcgctgaaaaagcgtttcccggatgcgcgcatcaccgtcgaccctaacggcgcctggctgctggatgaggccatcgcgctgtgtaaagggctgcaggatgttctgacctacgccgaagatccgtgcggcgccgagcagggtttctccggccgggaggtgatggccgagttccgccgcgccaccgggctgccggtcgccaccaatatgatagccactaactggcgcgaaatgggccatgcggtgatgctcaacgccgtcgatatcccgctggcggacccgcacttctggacgctctccggcgcggtgcgggtggcgcagctgtgcgacgactgggggctcacctggggctgccattccaacaaccactttgatatttccctggcgatgtttacccacgtcggcgccgccgcgccgggcaaccccaccgccatcgatacccactggatctggcaggagggcgacgcgcgcctgaccaaaaatccgctgcagattattaacggcagcattgccgtgccagacgcgccgggactcggcgtggaacttgactgggagcaggtgcgcagagcccatgaggcctataaagcgctgccgggcggcgcgcgcaacgacgcaggcccgatgcagtacctgatccccggctggacattcgaccgcaaacgtcccgttttcggccgccactaattaaaaaggatgatgctatgacgactttctcttcaacgcccgttgtcaccaccatgcaggtgatcccggttgccggccatgacagcatgctgatgaacctgagcggcgcccacgccccgtacttcacccgcaatatcgtaattatcaaagataacgccggccataccggcgtcggtgaaatcccgggcggtgaaaagattcgccagaccctggaggatgccattccgctggtggtgggcaaaacgctgggcgagtataaaaacgtgctgggcgcggtgcgcaatcagtttgccgaccgcgacgccgggggccgcggcctgcagacctttgacctgcgcaccaccattcacgtggtgaccggcatcgaagcggcactgctggatctgctgggccagcaccttggggtcaacgtcgcctcgctgctaggcgatggccagcagcgcagcgaagtcgaaatgctgggctatctgttctttgtcggtaatcgccatgcgacgccgctggcctatcagagccagccggatgagcagtgcgagtggtatcgcctgcgccatgaagaggcgatgacgccggatgcggtggtccgcctggcggaagcggcgtatgaaaaatatggtttcaacgactttaagctgaagggcggcgtgctggccggttttgaagaagccgaagcgatcagcgccctggcgaagcgcttcccgaatgctcgcgtcactctcgacccgaatggcgcctggctgcttgaggaggccattcagattggtaaacagctgaagggcgtgctggcctatgcggaagatccgtgcggcgccgaacagggcttctccggccgcgaagtgatggccgagttccgccgcgcgacgggcctgccgaccgccaccaatatgatcgccaccgactggcggcagatgggccatacgctgtcgctacaatcggtggatatcccgctggcggacccgcacttctggaccatgcaggggtcggtgcgcgtagcgcagatgtgccatgagttcggtctgacctggggttcgcactctaataatcacttcgacgtgtcgctggcgatgttcacccacgtcgcggcagcggcgccgggcaagatcaccgctatcgatacccactggatctggcaggagggcaaccagcgtctgaccaaacaaccttttgaaatcaaaggcggcatggtgcaggtaccgagtaccccgggcctgggggttgagctggatatggaccgcgtgatgcaggcaaatgagctatataagaaacatggtcttggcgcccgcgacgatgcgatggcgatgcagtatctgatcccgggctggacctttgacaacaagcgtccatgcatggtgcgctaaaagtccgccggcctctgcgggggccggcattgcgcgacagcgccaggggttggctcagagtaaggacagcagatgaaaatagtgatcgcaccggattcctggaaggagagcctgagcgcgctggaagtggccagtgcgatagagcaaggctttcgcgagatttatcctgacgccgagtatgtcaagctgccggttgccgatggtggggaagggacggtggaggccatggtggcggcgaccggcgggcttctggttccgctgacggtcaccgggccgctgggcgagccggttgaggcattttacgggctgtccggcgatcgccagtgcgcctttatcgaaatggcggcggccagcggcctggagagcgtcccgccggcgcagcgtaacccgctgctgaccacttcctggggtaccggggagcttatccgccatgcgctggacgccggggtaagacagatcattattggtattggcggcagtgcgaccaatgacggcggcgccgggatggcgcaggcgctgggggcgaaactgctgaccgccgagggccagcaaattgcctccgggggcggcgcgctggagacgctggcgcgaatcgatctcagcgaactcgattcgcggctggcagattgccggattgacgttgcctgcgacgtcaccaacccgttgaccggcccgcagggcgccagcgcggtgttcggcccgcaaaaaggggcgacggcgcagatgatcgaccggctcgatagcggcctacggcactatgcccggattatcgcccgcgatttagatatcgacgtgctgagccttgagggcggcggcgcggcgggcggcatgggtgcggcgctgtatgcgttctgtggtgctcagttgcgtccgggcattgagattgtcaccgatgcgctacagctggctgagcgggtggcggatgccgatttagtgatcaccggcgaagggcgtatcgatagccagacgatccacggcaaagtgccggtgggggtggcgagggtggcgaagcgttttaacgtcccggtgatcgggattgccggcagtcttaccgccgatgttggcgtcgtgcatcagcacgggctggatgcggtattcagcgtgttgtataccatctgtacccttgatgaagcgttggccaatgccgccgccaacctgcgaatgacggcgcgtaacgtagccgcggttttgcagatgggcgacaggcggtaacccggctggcgcagtggtatttgtagcccggataaggtgcgtagcaccgcgatccgggaaccatccccggtggcgcttacgcttaccggggctaccaaccgaataccggaccgtaggacgtagcccggatgaggcgcgtagcgccgctatccggggttcacacccccatccggcacgcttcgcgggccacattatccatctcatctaacagctcaagcagctccggctccagatcctcggcggcggtgcctgcccgtagctgactttccagggtatggcacagctttttcagccgcggcacgccgctatagctgcagctgccgtgcagtttatggatcagatccaccagcccttccggctgctcgcccaccagctgctcctcaactttgttacgcacctccggcataaaggcgatcagcatttgcagcatctcccgcgccaggtccggcttcatggccgcctggcgcagcgccagctgccagtcgagcgtttgattatgatcgacgatcggctctgcgggcggtagcgacgccggaacgacgctgtgcaggccgggctgatagcgcagcagcagtgcgtgcagtttctcttcttcgattggcttcgccagatagtcgttcatgccggcgctcagtaatttctcacgctggccctccagggcgtgcgcggtgaccgcaataaccggggtttgctgatgatgggacaggtgatggataagctcgcaggcgcggatgccgtccatatccggcatctgaatatccatcaggatcagatccatctgcagctgcttggccttgtccaccgcctgctggccgctgtcgcagaggatcacctgctgcacaagatcatccagcagggcgccaatcagcttcaggttagccgggttgtcgtcgacggccattaccgtcattggcaacttatgactgtcgatctgcatcagcggcgcggaggcaagcgcgtggctggtagccaccagcgccggtagcagacgggtggtggtgagcggctttaacaggcaggcggcaacgccgtcgcgcttcagggcttcggcgctgacctgggcatggcacggcagggccagcagtacgttatcggacatcgcgcaggctttggctaatttttcccgatgcggcgacaaatcgcgcattgaaaccgggataccgaccagcagaatgtcatactgcgcttccgccagcgaggagaaggtagggctatagataacctccagcggcgtagcggccagcatctccagggtacactgcgccgccgtcgcgttggcttccacataggccagacgtttgccgacaagcccgtcggtgttcagcgtatccggaatggcgttcgggttgagatcgaggctgatatggaaccagaaggtggagccgcggttcggctggctgtggaacgaaatatccccgcccatctctttgaccagacgctgagtgatcaccagcccgagcccggtgccgccgtggcggcgtgaaatactggcatcggcctgacggaaggcctggaatagccgggactggtcgcgctcggggatgccgatgccggtatcgtggatctgaatttcgatctgtacccgggaattactgatggcccgctgctccaccagtacgtcgatattgccgtgctcggtaaatttgatggcgttgcccacgaggttggtcacaatctgctgcagacgcagcggatcgccaatgacgttatccggtacattgttcttaatattcagcgtcagctccagccctttatcgtgcgcggaatgcgccagcagggtgaccacttcatcaagcgaagtgcgcagcaggaacggaatactctccaggatgagcttcccggcttccagcttggaaaagtcgagcacgtcattgatgatcgccagcagattgttggccgaacgttcgatggtggtcaggtggtcgcgctgcgtagcgttgagatcggttttcagcgtcaggcgggtaaagccgatcaccccattgagcggggtgcgcagctcgtgagacatattggccaggaactcagacttaatgcgcgccgcctcctgggcgcgctttttcgccaggtccagctcgacgttctggatctccatctgttcaagcgtttcccgtagatcggaggtcgcctggtcgacgttgtgttgcatctcttcgtggtatgccgccagcgacatggccatcgagttaatgccgtttttcagcatatccagttcgccgagcataaagccttcgacccggctgtccagctgtccgcggcggatgcggtcgacagtgttaaccatattgcggattggcccggtgacgtcgcgcatcagcctccagccgaagattaacgcgatgccgatacagaacagcatcattacgctggagataaaaatctctttgtactgctggaggcgaaccgattttagatccagctccagggcgacgtagcccagcatattgcccggcattttagcgtcagattcgggtgattcatccggagaatagctttccgagacaataggcgtgcgcaggatcatcatgtcgccatcgcggatgacgctgaggtgacgggggaatgcctcgcctttcgggatctgcagttcgctgggattgagctggtaattggaggtgacaaataagcggttatgcgaatcgtacaccgagatggcccgcacgatctccgagtggcgacgatgcagaacgctgatcagctggccgatggattcgcggttttgcaagttcatgccatattcgctggagaccgccagcggttcgataatactggcgccagcgtcctccagctggcgttgcaggtcgttataacgatgagcgacaaagaaaatactgagcaacagtcctatcaggacggttggcgccagaatcagaatcatcatgcgagcacgcaggctgtagttggtcatgcggttccattatgggagaatatagacatcatcgttctgtgcagcgtcgctgcgcctcgcggcgctgccgctctgaacgagctcgttttatttgattgagacaactctctacgatggcgcaattctactctgcaaaacggcgtgtgacgacgcgccagatcataaccgttacagtcaacgacctcgatccctttggtcagggtgttgcccgccaccaggggaaggcgctgttcgtgagcggcgtgctgccccacgagcaggccgaggtggtgctggtggaagataaaaaacagtacgcccgcgccgaggtgaaacgccgactgaccgacagcccgcagcgccaggcgccgcgctgcccccattttggcgtctgcggcggatgccaacaacaacatgccagcgttccgcttcagcagcaaagtaaacgcgccgcgctggggcgactgatgaagcgcgaggtagatgacgtcatcgccggcgcgccgtggggctaccgccgtcgcgcacgcttgagcttgaattatcagccgaagacccaacaattgcagatgggttttcgccaggtcaacgccaaagcgatcgtcgatgtggtgcagtgccctgttttggtgccccaacttgaggcattgctgcccgctgtgcgcgagtgcttaagcgcgctgagcgcattacgccatctcggccacgtcgagctggtgcaggcggacaatggcccgctgatggtgctgcgccataccgcagccctgccggcgacagacagggaaaaactggaacgcttttcgcaaactcacggtctttccctgtacctcgcgccacaaagcgagatactggagcaaattcatggcgaagcgccatggtatacctcagacggactacgcttagtgttcagcccgcgggattttatccaggtcaacgacggcgtaaatcagcagatggtgcgtaccgcactggagtggctggatctgcggccagaggaccgggtgctggatctgttctgcgggatgggcaactttaccctgccgctggcgacacgcgccgcccatgtggtgggcgtggaaggggtgccggcgctggtggagaaggggcgggaaaacgccgcccgcaatggtttatcaaatgtcactttcttccatgaaaatctggaagaagacgtcacccgtcaggcctgggcgaagcacggctttgataaagtgctgctggacccggcccgcgccggcgcgccgggcgtgatgccgcatataataaaactggcaccgcggcgggtggtgtatgtttcctgcaacccggcgacgctggcgcgagacagcgaaaccctgttgcaggctggatatcagattcaacgcctggcgatgctggatatgttcccgcataccggccatctggaatcaatggtgttgtttgagcgcaggcttacataaggtcattcacaacgtcgcagaagagccaccctggccatgaatgctgacgcgacctgcaggatgacatgtagaaagttgaggcttgccgacttcggcaggccggtcccttaaggagaggacaatggttgcggtaagaagtgcacatcttaataaagctggtgaatttgacccgaagaaatggatcgcgagtctgggaatttccagccagcagtcgtgtgagcgcttagccgaaacctgggattattgtcgcgaaaaaacgcaaggacacccgcaggcggacctgctgctgtggcggggcgtcgaaatggtggagatcctctccaccctaagtatggacatcgatacgctgcgcgcggcgctgctgttcccgctggccgacggcgaagttgtcagcgaagaggtgatgcaggagagcgtaggtaaatcggtcgtgaccctgattcacggggtgcgggacatggccgctatccgccagctgaaggctacccataccgactcagtctcttccgagcaggtggataacattcgccgtatgctgctggcgatggttgacgatttccgctgcgtggtcatcaaacttgctgagcgtatcgcgcatctgcgcgaggtcaaagacgcgccggaagatgagcgcgttcttgcggcgaaagagtgcaccaatatctatgctcccctggcgaaccgcttaggtatcggccagctgaagtgggagctggaagattactgcttccgctatctgcacccggcggaatacaagcgcattgccaaactgctccacgagcgccgtatcgaccgcgagcattacatcgaagagtttgtcggccacctgcgctcagagatgaaagccgaaggcgtcaaggcggaagtctatggccggccgaagcatatctacagtatctggcgcaaaatgcagaaaaaacacctcgctttcgacgagctgtttgacgttcgcgcggtgcgtattgtggctgagcgtttgcaggattgctatgccgcgctggggatcgtccatactcactaccgccatctgccggatgaattcgacgactacgtggccaacccgaaacccaacggttaccagtctatccataccgtggtgctggggccgagcggcaagacggtggagattcagatccgcacccggcagatgcatgaagatgccgagctgggcgtggccgcgcactggaagtacaaagagggcgcgggagccggcaccagcggcggccgcggctatgaagaccgtatcgcctggctgcgtaagctgattgcctggcaggaagagatggccgactccggcgagatgctcgacgaagtgcgcagccaggtcttcgacgaccgggtgtatgtctttacgccgaaaggcgacgtggtggacctgcctgcggggtcgacgccgctcgactttgcctatcatattcacagcgatgtcggccatcgctgcatcggcgccaaaattggcggccgcatcgtgccattcacctaccagctgcagatgggcgatcagatcgaaattattacccagaagcagccgaacccgagccgtgactggctgaaccctaacctcggctatgtgaccaccagccgcggacgttcgaagatccacgcctggttccgtaagcaggatcgcgacaagaacattctcgccggtcggcagatcctcgacgacgagctggagcatttgggcatcagcctgaaggatgcggaaaagcacctgctgccgcgctataacttcaacgagctcgatgaactgctggccgccatcggcggtggcgatatccgtctcaaccagatggtcaacttcctgcaggcgcagttcaataaacctagcgccgccgagcaggatgcggccgcgctgaagcaactgcagcagaaaacctacacgccgcaaaatcgcaccaaggacaatggccgggtagtggtggaaggggtaggcaacctgatgcaccatattgcccgctgctgccagccaatcccgggcgacgagatcgtcggctttatcacccaggggcgcgggatctccgtgcatcgcgcggactgcgatcagctggcagaactgcagtcgcatgccccggagcgcatcgtcgatgcggtatggggcgaaagctactcggcgggctactcgctggtggtcagggtggaggcgaacgatcgcagcggtttactgcgcgatatcactaccatcctcgccaatgagaaggtgaacgtgctgggcgtcgccagccgcagcgatacccgtcagcagctggcaaccatcgatatgaccatcgagatttacaacctgcaggtgctgggccgggtgctcggtaagctcaaccaggtgccggatgtgatcgacgcgcgccgtctgcacggcggttaattcgtctgtaggccggataaggcgaagccgccatccggcaatttcgcaacgtcggataaggtctaaacgccttatccggccgactattttttaaatttccaggattgtcacatgactcaaattgaccgcttgctcggcatcatgcgccgcctgcgcgacccggaaaacggctgcccatgggataaagagcagacctttgccactatcgccccttacacccttgaggagacctacgaggtcctcgatgctatccagcgggaagattttgacgatctgcgcggtgaactgggcgatctgctgttccaggtggtgttctatgcgcaaatggcgcaggaagagggacgctttaactttgacgatatctgcgccgccatcagcgacaagctggagcgtcgccacccgcatatcttcggcgaggcatcggcgggcaatagcacggaagtcctggcccgctgggagcaaatcaaaagcgcggagcgggcggaaaaagcccagcattcggcactggacgatattccccatagcctgccggcgctgatgcgcgcgcataaaatccagcgccgctgctcggcagtgggtttcgactggacctcgctgggcccggtgctcgacaaagtgcatgaagaaattgatgaagtgatgcatgaagcgcagcaggcggtggtggatgaagcaaaactggaagaggaagtgggcgatctgctgtttgccacggtgaacttatcccgtcatttgggcgtcaaagccgaggtggcgctgcagaaagcaaacctcaaatttgagcgtcgcttccgcgaggtcgagcgtattgtcgccgcccgaggcctggaaatgaccggcgtcgacctcgataccatggaagaagtgtggcaggaagtaaaacgccaggaaactgatctctaacggattttcgtgatcaggcgcgatttgtgtgattttataaataacaagcgcttgatttacgtcaaaaacatttcgccaaaagcgtctattttctctttccgttatgtcgttgaaacaccatgtagcctgcctcttcgagttgttcgagtcgcaacacaggtgcaacttgaagaacgaaggggaggggaagaatgaaagtttgtggcgtcacgcatgttcgggtatactactttcccgtcctggttattccatcgttttaccctaacttctcaggttcagcatgacaacgaactatatttttgtgaccggcggggtcgtatcctctctgggtaaaggcattgccgcagcctccctggcagccattcttgaagcccgtggtctcaacgtgaccatcatgaaactggatccgtatatcaacgtcgatccgggcaccatgagcccaatccagcatggggaagtgttcgttactgaagacggcgcagaaaccgatctggacctgggccactatgagcgttttatccgcaccaagatgacgcgccgcaataacttcaccaccggccgtatctactccgacgtgctgcgcaaagagcgccgtggcgactacctgggcgcgaccgttcaggttatcccgcacatcaccaacgctatcaaagagcgcgtactggcgggcggcgaaggccatgacgtcgtgctggtggaaatcggcggtaccgtaggcgatatcgaatccctgccgttcctcgaagcgattcgtcagatggcggtagagatcggtcgcgagcataccctgttcatgcacctgactctggtgccgtacatggccgccgcgggcgaagtcaaaaccaagccgacccagcactccgtaaaagagctgctctccatcggtattcagcctgatattctgatctgccgctccgatcgcgcggttccggccaacgaacgagccaaaattgctttgttctgtaacgttccggaaaaggctgtgatttctctgaaagacgtcgattccatttataaaattccgggcctgttgaaatctcaggggctggacgattatatttgtaaacgattcagcttaacttgtccggaagcaaacctggccgaatgggaacaggtaatctatgaagaagctaatccggcaggcgaagtcaccatcggtatggtcggtaagtacattgaactgccggatgcctacaagtcggtgattgaagcgctgaaacacggcggtctgaaaaatcgcgttaccgtcaacatcaagctgatcgattcgcaggatgtggaaacgcgcggcgtcgaaatcctcaaggatttagacgctatcctgatcccgggcggcttcggctaccgcggcgttgaaggcaagatcgccaccgcgcgctatgcgcgtgaaaacaatattccttatctgggcatctgcctgggtatgcaggttgcgctgattgagttcgcgcgtaacgtagcgggtatggaaaacgccaactcgacggaatttgtgccagactgtaaatacccggtcgtggccctgattaccgaatggcgtgacgaagatggcaacgttgaagtccgctctgagaagagcgatctgggcggcaccatgcgcctgggcgcgcagcagtgccagctgagtgatgattctctggtacgccagctttacggcgagccgaccatcaccgagcgtcatcgtcaccgctacgaagtcaacaacatgttgttgaaaccgattgaagctgccggtctgcgcgttgcgggccgttccggggatgatcagttggtcgagatcatcgaagtgccgaaccatccgtggtttgtggcctgccagttccacccggagtttacttcgacgccgcgtgatggacacccgctgtttgccggctttgtgaaagccgcgagcgagtaccagaaacgccaggcgaagtaaaaagagtttgaacggcaatgcacccatccgggtgcattgtttgtctggagttttagtttaacttgtactgaggaaaacctaatgtccaaaatcgttaaagtcatcggtcgtgaaatcatcgactcccgtggtaacccgactgttgaagccgaagtacacctggaaggtggtttcgtcggtatggcagctgctccgtcaggtgcttctactggttcccgcgaagcgctggaactgcgcgatggcgacaaatcccgtttcctgggtaaaggcgtaaccaaagctgttgctgcggtaaacggcccgatcgctcaggcaatcctgggcaaagatgctaaagatcaggctggcatcgacaagatcatgatcgacctggacggtactgaaaacaaatctaacttcggtgcgaacgctatcctggccgtttctctggcgaacgccaaagcagctgctgcgtccaaaggcctgccgctgtacgcgcacatcgctgaactgaacggcactccgggcaaatactccatgccggttccgatgatgaacatcatcaacggcggtgagcacgctgacaacaacgtcgacatccaggaattcatgattcagccggttggcgcgccgaccctgaaagaagcagtacgcatgggttctgaagtgttccatcacctggcgaaagtgctgaagtccaaaggcatgaacactgccgttggtgacgaaggcggctacgcgccgaacctgggttccaacgccgaagcgctggctgttatcgctgaagcggttaaagctgcaggctacgagctgggcaaagacatcaccctggcgatggactgcgcggcgtctgaattctacaaagacggtaaatacgttctggctggcgaaggcaacaaagcgttcacctctgaagagttcactcacttcctggaagagctgaccaaacagtacccgatcgtctccatcgaagatggtctggacgaatctgactgggaaggtttcgcttaccagaccaaagtactgggcgacaaaatccagctggttggtgacgacctgttcgtaaccaacaccaagatcctgaaagaaggcatcgaaaaaggcatcgctaactccatcctgatcaagttcaaccagatcggttctctgaccgaaactctggctgctatcaagatggcgaaagacgctggctacaccgctgttatctctcaccgttctggcgaaactgaagacgctaccattgccgacctggctgttggtaccgctgcaggccagatcaaaactggttctatgagccgttctgaccgcgttgctaaatacaaccagctgattcgtatcgaagaagcgctgggtgagcaagcgccgttcaacggtcgtaaagagatcaaaggtcaggcttaatcctgtccttgtgaaataatcatgccagccttcgggctggcattttttttacgcctgcggccattatttaaagtcgacggccatttgctgagggatcgacaacccgcgggtggtttccacgcagcggtcgatgtaatcggtaaagcgcggcggttttggcatccccatgctcagcagcttgtcgttactaaagcgcacgttcagggtggcgaatgcgccgtataagcgcatggctttcagcatcagccgctcattgcatggcccaaatatccctttcagttcgcgtctcattttgaccagcgtttcatagctcacctgggcgtacttatcccccaccggcgcctgctccagggcctgagccatcgccaggtcgatttcggcaaacttcacgctgttctcttcgccagcagagatatgcaccacctcgccgtgagccagaggctggttaagcagcattagcagggcgtcggcgcagtagtccaccgggataacgtcaattcggtcctccatggagcacatgaatttctgcagcatcagccccatgctgaacacccagaaaatactgctggaaggccggcagccgtgatgggtatgacccaccacgatagaggggcgggcaattaccagcggtagcgtagggcactgctgctgcatcagctgctcgatggtcgacttcgagtgggtatattccaccaggtgctcagcgcgttcccgaaactccgcgctttcggcgaccagtgaatccggttcaggcgaacatgacatcgccgtaccgacgtgcagaaagcgctgcagacccgtcacctgcgccatacgttgcgccaggcgcagcgtgccctcaacgttaaccttccagataagcgggttgctgccaaatgaagcgacagcggcgcagttgaggatgtgcgtgacctgatcgaggcgcggatcgttaagaaaatgctccggagaggcgagatcgcccagcaggatatgctgctggcgcaacatcgccagcttctcctcggcgatgttgaacttacgcatgttctctttaacccgttcgaggccagcctcggggctatcagcacgtaccagcagcagcagatctaaccgggtttcctgatggagtattttctctaacgcggcaccgcccagaaaccccgtaacgccggtaattaataatgtggtcataaacgctatctcattatggttggtctgcgggattctaggcgggcaaaagtaaacgacaattaaataaaaaaggggcccgatcagggctttattaagaccagtttaaggttattattaccgggggatagaattggactcgcagatcggccagataattcactctttcatgtatcagtttgtacattactgtattttaaggttttttattttggttcttggaccttttattttatcctgaatgacaggaataacattttctgttacatatttccccccgcgcgtcagaatgctatttattttaattcttaccatgctaataaactaagccaaaagaaaagattgcttttttaatcaataatattattcccgacacggatattgacggaggggtaaaaaagcgatcgcagcgcaggacaagacctgggcagcgaaatctgcgataatgaacgtttatcaccctaaacagagatgactatgcagtacccgattaacgagatgttccagaccctgcaaggcgagggttacttcaccggcgtgcctgccatctttattcgtctgcagggatgcccggtaggatgcgcgtggtgtgacaccaagcatacctgggacaagctggccgatcgggaagtgtcgttgttcagcatcctggcgaaaaccaaagagagcgacaagtggggcccggcaagcagcgaggatctgctggcgattattgggcggcaggggtggacagcccgccacgtggttattaccggcggtgagccctgcattcatgatttaacgccgttaacctcgcttctggaacaaaacggctttagctgtcagattgaaaccagcggcacccatgaagtacgctgcagccccaatacctgggtgacggtttccccgaaggtcaacatgcgcggtggctatgacgtgctgtctcaggccctgcagcgggcggatgagatcaagcatccggtagggcgcgtccgcgacatagaagcgctggacgaactgctggaaacgctgagcgatgacaaaccgcggatcatcgccctgcagccgatcagtcagaaagaagatgcgacgcgcctgtgtatcgatacctgcatcgcccgcaactggcgcctgtctatgcagacgcacaagtatctgaatattgcctgataaaaaagcccggcagcgtactgaccgggctttttttcgcttactcgccgcgatagacgcagccggcggtgcaggtctctttgaccatcacggcgctgagcagcggcacccgcggtttcatctcatcccagatccatttggccagcacttcgctggtggggttttccagaccagaaatatcgttcagataatagtggtcgaggcgatcgtatgtcggcttaaaggcggccttcagctcggcaaaatccatgatccacccggtatggggatcgacttcaccggtgatctccagacgcaccataaaggagtggccatgcaggcgaccgcatttgtgtccttccgggacgtgcggcaggtggtgggcggcttcgaaggtgaaatctttaaacagcgtggtggacatcattgactctcaacaggacgaaaaaaaccgccgtagggtaccggaaagtacattttttcgcattaactaaaacggccgtgaacagaaaatagacatgttcatctgctttatttgagttaatctcttatatttcaattgcttatttaatcgattttgttgttaataactacaactaaaacaggttagtccatttggttatttattatttccatcccttctttaattgttactatgcccgccgttaaccttctattctcttctgtttttgtcgcgctgacagggtgcgaataacagctttgcttactggaacaaacgacgcatgacgacacaggccccaccttccaacttgctaccgctcaacccggagcaactggcgcgccttcaggcggccaccactgacttcacgcccactcagctcgcctgggtatctggctatttctggggcgtgctgaatcagcagtccggcgcggcggtagccgaacccgccccggccgccgaggtaccgacgatcacgctgatttccgcctcgcaaaccggcaacgcccgccgcgtcgccgaagcgctgcgtgacgatctgctggcggcgaagctgaacgtgaagctggtgaatgcaggcgattataaattcaaacaaattgctgcggaaaaactgctggtggtagtgacgtccacccagggggaaggagagccgccggaagaagcggtcgcattgcataagttcctgttctctaagaaagcgccgaagctggacgggaccgcgttcgccgtctttggtctcggcgatacctcttatgaatttttctgtcagtccggcaaagatttcgacaacaagctggccgagctcggcgcggaacgtctgctcgatcgcgttgatgccgacgttgaatatcaggccgcggccgctgaatggcgcgcgcgcgtggttgaggcgctgaaggcccgtgcgccggtcgctgcgcccgctcagctggccaccagcggcgcggtgaacgatattcacaccagcccatataccaaagaagcgcccctgacggcgaccctgtcggtcaatcagaaaatcaccggccgcaattcagaaaaagatgtgcgccatatcgaaatagacctcggtgattccggtctgcgctatcagccgggcgacgccctgggcgtctggtaccagaacgatcctcagctggtgaaagagctggtggagctgctgtggctgaaaggcgacgagccggtgaccgttgagggcaaaactctgccgctgtcggaagccctgcagtggcattttgagctgacggttaacaccgcgactatcgttgaaaactacgccaccctgacgcgcagcgaatcgctgctgccgctggtgggcgataaagctcagttgcagcagtatgccgccgcgacgccgatcgtcgatatggtccgtttctctccggcgcagctggacgctgaggcgttaatcggtctgctgcgtccgctgacgccgcgcctgtactccattgcttcctcacaggcggaagtggagagcgaggtgcatgtcaccgtgggcgtggtgcgctatgaaattgaaggccgcgcccgggctggcggcgcctccagtttcctcgccgaccgcgtggaagaggatggcgaagtccgtgtctttatcgaacacaacgacaacttccgtctgccagccaacccggagaccccggtgatcatgattggcccgggcaccggtattgcgccgttccgcgcctttatgcagcagcgcgctgcggacggagcgcaaggcaagaactggttgttcttcggcaacccgcacttcaccgaagatttcctctatcaggtggagtggcagagctatgtgaaggaaggtctgctgacccgtatcgatctggcctggtcccgcgatcaacaacaaaaaatctatgttcaggacaaactgcgcgagcagggggccgagctgtggcgctggatcaatgacggcgcccacatttatgtctgcggcgacgccaatcgcatggcgaaggacgtggaaaacaccttactggaagtgattgccgaatacggcgcgatggacgccgaagcggcggacgaatttttaagtgagctgcgcgttgagcgccgttatcagcgagatgtctactaatgagcgaaaaacatccggggcctttagtggtcgaaggtaaactgagcgatgccgagcgcatgaagcttgagagcaactacctgcgcggcaccattgcggaagatttaaacgacggtctgaccggcggttttaaaggcgataacttcctgctgatccgtttccacggcatgtaccagcaggacgatcgcgatatccgcgcggagcgcgccgcccagaagctggagccgcgtcatgcgatgcggctccgctgccgtctgccgggcggggtgatcaccaccacccagtggaaggcgatcgataagtttgccgctgagaacaccatttacggcagtattcgcctgaccaaccggcagacctttcagttccacggcattctgaaaaagaacgtcaggccggtgcatcagatgctgcactcggtggggctggacgcgctggccaccgccaacgatatgaaccgtaacgtgctgtgcacctccaacccctacgagtcgcagctgcacgctgaggcctacgagtgggcgaaaaagatctccgagcatctgctgccgcgtacccgcgcttatgccgagatctggctggatcagaaaaaggtcgccactaccgacgaagagccgatcctcggccagacctatctgccgcgtaagtttaaaaccacggtggtgatcccgccgcagaacgatatcgatctgcacgccaacgacatgaacttcgtggcgatcgccgaaaacggcaagctggtgggctttaacctgctggtgggcggcggtctctctatcgaacatggtaacaaaaaaacctacgcccgcacggcgagcgaattcggttatctgccgctggagcatacgctggcggtggcggaagcggttgtgaccacccagcgcgactggggcaaccgtaccgaccgtaagaatgcgaaaaccaagtacacccttgagcgcgtcggtgtcgaaaccttcaaagcggaagtggagcgccgggcaggcattaagtttgagccgatccgcccgtacgaatttaccggccgcggcgatcgcatcggctgggtgaaggggattgatgataagtggcacctgacgctgtttattgaaaacggccgcattctcgattatccgggtcgtccgctgaagactggcctgctggagattgctaaggtccatcaaggcgaattccgcatcaccgctaaccaaaacctgattgtcgccagcgtaccggaagatcagaaggcgcggatcgagaagctcgcgcgggatcatggcctgatgaatgccgtcaccccgcagcgcgaaaactcgatggcctgcgtctccttcccgacctgcccgctggcgatggcggaagccgagcgtttcctgccgtcgtttatcgacaaggtggaagggctgatgagcaagcacggcgtgagcgatgagcatatcgtcacccgcgtcaccggctgcccgaacggctgcggccgcgcgatgctggcggaagtgggactggtgggcaaagcgccgggccgctataacctgcacatcggcggtaaccgcaacggcacccgcatcccgcggatgtaccgtgagaatattaccgagtcggaaattctcgactcgctagacgaactggtagggcgctgggcgaaagagcgcgaagcgggtgaaggcttcggcgattttacggtgcgtgcgggcatcattcgcccggtgctcgacccagcccgcgatttctgggaataacatcctggtgcccggtggcgcgtagcgatccgggccagcgaaacccgtaggccggacgaacgcagtgtcgtccggcaaaacaggcaaacgaggttcatatgtccgtactcgatctaaacgcgcttaatgcattgccgaaagtggaacgcattctggcactcgcggaaaccaacgcccaactggaaaagcttgacgccgaagggcgtgtggcgtgggcgctggaaaatctgccgggaaactatgtgctgtcgtcgagctttggcattcaggcggcggtcagtttgcatctggtgaatcagatccgcccggacattccggtgatcctcaccgataccggctacctgttcccggaaacctatcagtttattgacgagctgaaggacaagctcaagctgaacctgaaggtctaccgcgcggctgaaagcgcggcctggcaggaggcgcgctacggcaagctgtgggagcagggcgttgagggcattgagaaatacaatgagatcaacaaggttgagccgatgaaccgggcgctgaaagagctcaacgcgcagacgtggtttgccggtctgcgccgcgagcagtcgggcagccgggctacgcttccggtgctggcggtccagcgcggggtgttcaaggtgctaccgattatcgactgggataaccgcacggtgtatcagtacctgcaaaagcacgggctgaagtaccacccgctgtgggatcagggctatctctcggtaggcgatacccacaccacccgcaagtgggagccgggcatggcagaagaagagacccggttcttcgggcttaaacgcgagtgcggattgcacgagggttaagctgttagctcttcctctgagtgataattcaaaaagaacacgcgggcgataccgcgcgttcttttgtgcgtattagcttttcttctccactttcgccagctctttcaccagcggcagcatgactttcactacctcgcgtccgcggtgttcgatgcgccccggcagcgcgtggtcgatatactgctgattatccagctggacgtcatgccaactggttccctgcgggaaactggccgatttgctccgctgctgatagccatcttttttgccgagtgaccagttagtcgcctcgaccgacagcaccgggatcccggcgttgtcgaagacgctggcgtcattgcagcagctggtgcctttcggataagccgggttgagtcccgggttggtgtaggcggcgatgcccttgctgcgagcgatagccagcgcgcgatcgcgggtcagcttgcgcaccgaggccggcgtgctgcggccgctgttgaagtaaagcttatcgcccaccaccagattatcgagattgatcaccagcagggtatttttcttttccgcttcgctcatccgctgcagcaggttttgcgcgccgagacggccttcctcttcaccgctggtggcgataaagcggatgccatagcgggtagggacgttctttaaatgctccgccagctccagcaacacgccaagtcccatcgcgttgtcgtcgatgccctgcagcgtcaggccgccgaggttgttctccacgtctttatcgctctgcggcgcataggtgtcgaggtgtgccatgataataatctgctggcgcactttaccttcatgggcggcgatcaccgtactgccggtggcgttatgccagttcttgcgctgattgctgtcggtatagatatagcgggtattgaagcttcgcacgtcgctctgataccccatcagggcgaactgctggcgcagatagtcagctgagagcatttccggcggcgttccggtcattcgtcccgggaagacggtggcgatatggcgggcctggctactggcggtgtcgcccagcgcgctgaatgcgggggcggcggcaaaaacaaaaccggtgccgagcgccagcggaagcagacggcggcacaacgcggaaaacataaggggtccttacacgaacaagacaatttgacgcgtacagtatgaaactgtgaccgcggttaaacaatttcaattgctcttaaatagcggaaaaatagcgcgttaagcactttttgatatttgtatttccgccgcgttattcctttgtgtcacaactcattccatttcgtaatttcatttgctctaaggcgcaccctatagtcgcagtatcgctgaatgtaagagagttgttgcaccgtggattacttgcccctttttgccgaactgaaacaaaggcccgtgctggtgatcggcggcggcgagattgctgaacgtaagatcaagttcttgctgcgcgcccaggcgcaggtgcaggtggtcgctgaaacgctgtcaccggcgctggccgatctggctgcgcgccaggcactcagctggcgggcgacggaattcagcgactcgctggtggatgatgtctttctggtgattgcggccaccgaggatgaggcgcttaaccagcgggtatttgcggcagctaacgcgcgctaccggttggtcaacgtggtggataaccaggcgctgtgctcgtttgttttcccttctatcgtcgaccgttcgccgctgctggtggcgatctcctccagcggtaaagcgccggtgttgtcgcgcattctgcgtgaaaaaatcgaagcgctgctgccgacgaatctcggtcggctggcggaatcagcaagctactggcgcaaccatctgaaaacccgcctgacgactaccgaagcgcgtcgccgcttctgggagcgcgtctttaccggccgcttcgccagcctgatggtggcgggcaactctgcggaggcggaaaaggcgctgcaggatgagctggataagcccgaacgcgagacgggagaaattattctggtcggcgccgggccgggcgatgccgggctgatgacccttcgcggtctgcaggcgatccagcaggcggacgtggttttccacgaccatctggtgactcagccggttctcgagctggtgcgccgcgatgccgagctgatctgcgttggcaaacgcgccggcgagcactcggtgccgcagcatgaaaccaatcagctgctggtggaggcggcgaaggcggggaaaaccgtcgtgcgcctgaagggcggcgatccgtttatttttggccgcggcgcagaagagctgcaggctgccgccgaggcggggatcccgttccaggtggtgccgggcgtcaccgctgccgccggggcgacggcctacgccggtattccgctgacccatcgcgattatgcgcaaagcgccgtctttgtcaccggccactataagccggacagcgcccccttcgactggtcgctgctggcgaagagccaacagacgctggcgatctacatgggcaccatgaaggcggcggaaatcagcgcccagctgatcgcccacggtcgcgacagcgacacgccggtggcggtgatttcccgtggcacccgtgacgatcagcagacgataaccggcacattgcaacaactcgaacacctggcgaaagacgccccgatgcccgccctgctggtggtaggcgaagtggtgcagctgcatcagcagctcgcctggtttcaacatacatcatccgccgaggggtttaacgcttcggtggtcaatctggcttaaggaacggttatggaccaaaaacgactcactcacctgcggcaactggaggcggaaagcatccatattattcgtgaggtggccgccgaattttctaacccggtaatgatgtactccatcgggaaagattccagcgtaatgctgcatctggcgcgcaaagcgttttatccgggaaccctgccgttcccgctgctgcacgtcgataccggctggaaattccgtgagatgtatgagttccgcgaccggaccgctaaagcctacggctgtgaactgctggtgcataaaaacccggaaggggtggcgatgggcatcaacccgtttgtccacggcagcgccaagcataccgatatcatgaaaaccgaaggcctgaagcaggcgctgaacaaatacggctttgacgccgcgttcggcggcgcgcgtcgcgacgaagagaaatcccgcgcgaaagagcgcatctactccttccgcgaccgtttccaccgctgggacccgaaaaatcagcgtccggagctgtggcacaactacaacggccagattaacaaaggcgaaagcatccgcgtcttcccgctctccaactggaccgagctggatatctggcagtacatctatctggaaaatattgaaatcgtgccgctgtatctggccgctgagcgtccggtgctggagcgcgacggtatgctgatgatgatcgatgacgaccgtatcgatctgcagccgggcgaggtgattgaaaaacggatggtgcgtttccgtaccctcggctgctggccgctgaccggcgcggtggagtctgaagcgcagacgctccccgaaattattgaagagatgctggtatcgaccaccagcgaacgtcaggggcgcgtcattgaccgcgaccaggccggctcgatggagctgaagaaacgtcaggggtatttctaaggagccgccatgaacacgaccattgcccaacaaattgccaacgaaggcggcgtagaagcttacctgcacgcgcaacagcacaagagcctgctgcgttttttgacctgcggcagcgtcgatgacggcaaaagcaccttaattggccgcctgctgcacgatacgcgccagatctatgaagaccagctctcttcgctgcacaacgacagcaagcgtcacggcacccagggcgaaaagctggacctggcgctgctggtggacggcctgcaggccgagcgcgagcagggcatcaccatcgacgtggcctatcgctacttctcaaccgaaaaacgcaaatttatcatcgccgacaccccggggcacgagcagtacacgcgcaatatggccaccggggcgtccacctgcgacctggcgatcctgctgatcgatgcgcgcaagggcgtgctcgaccagacccgccgtcacagcttcatctcgacgctgctgggcattaaacacctggtagtggcggtcaacaaaatggatctcgtcgagtttagcgaagcgcgcttcaacgagatccgggaagattatctgacctttgccgagcagctgccgggcaaccttgatatccgctttgtgccgttgtcggcgctggaaggcgataatgtcgccagccagagcgcgaatatgccgtggtacagtggcccgacgctgctggaagtcctcgaaaccgtggagatccagcgggtggtcgagagccagccgctgcgctttccggtgcagtatgttaaccgtccgaaccttgatttccgcggcttctccggcacggtcgcctccggtaccgtgcaggttggccagcgtctgaaggtgctgccgtcgggcgtcgaatcgagcgtggcgcgtatcgtcaccttcgacggcgacctgcaggaagccgccgccggcgaagccattacccttgtgctgaaagatgaaatcgacatcagtcgcggcgacctgctggttgacgcgcaagcctcgctgccggcggtacaaagcgccagcatcgacgtggtgtggatggccgaacagccgctgaccccgggccagagctacgacatcaaaatcgccggcaagaagacccgcgctcgcgtcgacgctatccgctaccaggtcgatattaacaacctgacccagcgtgaagtcgagtctctgccgctgaacggcatcggcctggtggagctgacctttgacgaacctttagtgctggatccgtatcagcaaaacccggtgaccggcgggcttatctttatcgatcgcctgaccaacgtcaccgtcggcgccgggatggtcaacgagccgcacctgcaggcatcgacttcggcatcacagtacagcgccttcgagctggagctgaaccagctgatccgtaaacatttcccgcactgggacgcccgcgacctgctgggaggcaaataatggcccagcatgacgaaaacgtcgtctggcatgcccaccctgtgacccaacagcagcgggaacagcatcacggccatcgcggcgtggtgctgtggtttaccggcctttcggggtcgggtaaatccaccgtcgctggggcgctggaggaggccctgcatgagcgcggcgtcagcacctatctgctggacggcgataacgtgcgccatggcctgtgcagcgacctgggattcagcgatgaggatcgcaaagagaacattcgccgcgtcggggaagtggccaggctgatggtcgatgccgggctggtggtattgacggcatttatatctccgcaccgtgcggaacggcagatggtgcgcgagcgcctcggggaaggacgctttatcgaagtgttcgtcgataccccgctggccatctgcgaggcgcgggatccgaaaggattgtataagaaagcgcgggcaggggaattacgcaatttcaccggtatagactcggtctatgaggcaccggaaaaggcggaaattcatctggatggtgaacaattggtaacaaatttggtgcaccaactattagacctgctgcaacagagcgatattatcagatcctgaaacggcagcggcatcgaggggtgccggttgcccggtctacaggattcgatatgcgcaatacccagaacctcagtattattcgttcagaaccgcctccggcgatcggcgacgagaccacctggtctttgtcgggcgctgccgtgggctttatttcgtggctgctggcgctgggtattcccttccttctctatggcagtaatacactcttctttctcctctacacctggccattcttccttgcgttgatgccggtggcggtggtggtcggtattgcgctgcactctctgctcaatggcaaactgctctatagcgtcagcgcgaccatcctgaccgttgggctgatgtttgcgctactcttcctctggctgttgggataacccgttgctggtatgaatcaagcatgggtatcgacagcaaaaatatggtacagtccccgcgttacgcggcatcgtccgcgcgccccggtagcgtacccgggcgagttttgggatgatgatgccgtttttcagggggcaggatgggtaaactaacgctgctattattagctttgctggtctggctacagtattcgctgtggttcggtaaaaacggcctgcacgactacacgcgggttaacgacgacgtcaccgcccagcaggcgactaacgccaaattaaaagcacgcaacgatcagctgtttgccgaaattgacgacctcaacggcgggcaggaagcgattgaggagcgtgcgcgcaatgaactcagcatgacccgcccgggcgaaaccttctatcgtctggtaccggatgcgtctaaacgcaatcaggcatcggggcaacagcagaacaatcgataaccaggcccaggattacaacatggcagccacttttccgggcgtttgcgccgtggtgccggcagccggtttcggccgccgcatgcaaacggaatgcccgaaacaatatctctcaatcggtaacaaaacgattctcgaacacgcggtcgccgcgctgctggcggatgcgcgcgtccagcgggtggtgattgccgtcagccccggcgatcgccgcttcagccagctgccgctggcgcagcatccgcagattaccgtggtggatggcggcgctgagcgcgccgattcggtactcgccggcctgcgggcgttgccggaggcgcagtgggtgctggtgcatgacgccgcgcgcccctgcctgcatcaggacgacctcagccgcctgctgtcgctctgcgaaaccagccgcgtcggcgggatccttgcggcgccagtgcgcgacaccatgaagcgcgccgagccgggcaaaaccgctatcgcccataccgtcgaccgcaatgacctgtggcatgcgctcaccccgcaacttttccctcgcgagctgctggtggattgcctcactcgcgcgctaaacgagggagccactatcaccgatgaagcctcggcgctggagtactgcggcttccatccgcagctggtcgccggacgcgcggataatattaaagtgacgcgcccggaagacctggcgctggctgaattttacctcacccgttcccgacaccaggagaaagcttaatgcgaattggacatggttttgacgtacacgcttttggcggtgaaggcccaatcatcattggcggggtacgcattccttatgaaaaagggctgctggcccactccgacggcgacgtcgcgctgcatgcgctgaccgacgcgctgcttggcgccgcggcgctgggcgatatcggcaagctgttccccgataccgatccggcgtttaaaggtgccgatagccgcgaactgctgcgcgaagcatggcgccgcattcaggccaggggctatacgctcggcaacgtcgacgtcacgattattgcccaggcgccgaaaatgctgccgcatattccgcagatgcgcgtctttatcgctgaggatctcggctgccatatggacgacgtcaacgtgaaagcgaccaccaccgagaagctcggcttcaccggccgcggggaagggatcgcctgcgaagcggttgcgctgctgcgtaaggccgacaaatgatcgcctttgaccaactgacctggctgcacggcaagccgcagagcagtgggctgctgaaagccaatccggaagattttctggtggtggaagatctgggatttgccccggacggcgaaggcgaacacgtgctggtgcggatcctgaaaaacggctgcaatacgcgctttgtcgccgacgcgctggcgaaattccttaagatccacgcccgtgaagtgagcttcgccgggcaaaaagataagcacgcggtcaccgagcagtggctgtgcgcccgggtgcccggcaaagagatgccggacctgagcaaatttcagctcgagggctgccaggtactggaatatgctcgccataagcgtaagctgcgtttaggcgcgctgaaaggcaaccagtttaccgtgatcctgcgcgagattagcgatcgccaggacgtggagacgcgtctgcaggccatcgctgaacggggagtgccgaactatttcggcgcgcagcgcttcggcattggcggcagtaacctgcagggtgccctgcgctgggcggagagcggcgcgccagtgcgcgatcgcaataagcgcagtttttggttgtcggcagcccgcagcgcgttgtttaatcagcaagtgagtattagattaaaaaaaacggaatttaatcaggtcgttgatggcgatgcgctacaattagcggggcgcgggagctggtttgtcgtcacaccggaagaactcgaggtttcgcaggcgcgggtgcataaccgcgaactgatgattacggccacgctgccgggcagcggcgactggggaagccagcgcgacgccctggctttcgagcaggccgcgatcgccgaggaaaccgcgttgcaggcgctgctggtacgggagaaagtcgaggcggcgcgccgggcgatgcttctctatccacagcagctcagctggaactggtgggatgacgtaaccgttgaactgcgtttctggctgccggcgggcagcttcgccaccagcgtggtcagggagcttatcaatacaacgggtgactatgcgaatattgctgagtaacgatgacgggatccatgcgccggggatacagaccctggcgaaggccttaagggagtttgccgaggtccaggtggttgcacccgatcgtaaccgcagcggggcctcaaattcgctgacgctggaatcgtccctgcgtacgtttacctttgaaaatggcgacatcgccgtccagatgggcaccccgaccgactgtgtctatctcggcgtgaacgcgctgatgcgcccgcgtccggacatcgtggtttccggtattaatgccggccccaacctgggcgacgacgtcatctattccggcactgtggccgcggcgatggaaggccgtcatctggggttccccgcgctggccgtgtcgctgaacggctatcagcattacgataccgccgcggcggtaacctgcaccattctgcgcgccttaagccgcgagccgctgcgtaccgggcggatccttaacatcaacgtgccggatctcccgcttgatcaaatcaagggcattcgcgtgacccgctgcggcaaccgccatccggccgaccaggtgatcccgcaacaagatcctcgcggcaacaccctgtactggattggcccgccgggcgataagcgcgatgccgggccgggcaccgattttgcggcagtggatgaaggctatgtttccgtgacgccattgcacgtcgatttaaccgcccatcaggcgcatgaggtggtcaccgattggctggaacgtgtcggggttgacaggcaatggtaagtaaacgtgttgaaagtttgttgaatcaactgcgcacgcagggcatcgtcgatgaacgtgtcctcgaggcgatcgcgctggtcccgcgcgaaaagtttgttgatgaagcctttgaacataaagcgtgggaaaacaccgcgctgccgattggccaggggcagaccatctcccagccgtatatggtggcgcggatgaccgagctgctgacgctgacgccggagtcgcgggtgctggagatcggcaccggttccggctaccagacggccatcctggcgcatctggtgcatcacgtatgctcggtagagcgaattaagagtttacagtggcaggcgcgtcgtcgcctgaaacaacttgatttacataatgtttcaacccgtcatggcgatgggtggcaaggttggcaggcgcgggcgccgtttgatgccattattgtgacggcggcgccgccggaaataccgaccgcgctgctggcgcagctggatgatgacggcgtgctggtgctgccggtcggcgaagagcatcagtttctcaaacggatccgtcgtcggggcaacgaatttatcattgataccgtcgaggccgttcgctttgttcccctggtgaagggggagctggcctgagacccggattattccaggttttttttgcctgactttaggcgtagggtggacacatttttcagtgtcctggccgggcgccgcccggtaagcaagatattggcagttaacatattcctgggggataaatgagcgcgggaagcaccaaatttaccgtcagccgtattgcggctctttcactggtttcactctggctggccgggtgtaccaacaccaataatccgcctgcgccggttagctctgccggcggcgccgcctcttccagcaccaactccggcatgctgattacgccgccaccctccggcgtcaagtccgctcctcaggcgcagccgattcagccgatgcagacccagaccattcagccgcagccggcgccggtggcgcaggagccggtacagacggtaaatggccggatcgtttacaaccgcaaatatggcgatattccgaaaggtagctataccggcggcagtacctatacggtaaaacgcggcgacacgctattctatatcgcctgggtcaccggcaacgatttccgcgacctggcgcaacgcaacaacatcccggccccgtacgcgctgaacgtggggcaggtactgcaggtcggtaacgcctcaggccagccgatcaccggcgaaaacgccgtttctcaggccagcgcaagagcgagcggcggtgcgacgaccagcacaacttctgcacaaaaatcgaccgcggtggttgcttcacaaccgactattacgtattctgaatcttcaggtgaacagagtgctaccaagatgttgcctaataataaaccagcgaccacaaccacaacggttgtcgcgccggtgacggcaccaacaacggtgagcacaacccagccgactgcaagcagtacgtcaaccagttcgccgatctcagcatggcgctggccgactgatggcaaggttatcgagaactttagcggcgcggaaggcggcaataaaggtatcgatattgcaggcagtaagggacaggctattgtcgcgaccgccgatgggcgcgtcgtctatgccggtaacgcactgcgcggctacggtaatcttattatcatcaaacacaacgatgattacctgagtgcctacgctcataacgataccatgctggttcgggagcaacaggaagtcaaagcggggcagaaaatcgctaccatgggtagcaccggaaccagctcaacaagattacattttgaaattcgttacaaggggaaatccgtcaacccgctgcagtacttaccgcagcgataatttggcaaagtacggataagcgaagcatcagctaacaggcgccagggcggtgtctacgttcctctcgcagagagggcaggggaaatcgtccaggcgtcgtttgttgatgtgccgtggaaggtgctttgctcagggatcacgggtaggagccacctttatgagtcagaatacgctgaaagttcatgatttaaatgaagacgcggaatttgatgagaacggaattgaggttttcgacgagaaagccttagtagaagaggaacccagtgatagcgatctggctgaggaagagctgctgtcgcaaggcgcaacccagcgcgtacttgacgccactcagctttatcttggagagattggttattccccactgctgaccgcggaagaggaagtctatttcgcgcgtcgcgcactgcgtggtgatgtcgcttcacgccgtcgcatgattgaaagtaacttgcgtctggtggtgaagattgcccgtcgttacagcaatcgtggtctggcgctgctggatctgattgaagaaggtaacctcggcctgatccgcgccgttgagaagtttgacccggaacgtgggttccgtttttcgacctacgcgacctggtggatccgccagactattgaacgggcgatcatgaaccaaacccgtacgatccgtttgccgatccatattgttaaagagctgaacgtttatctgcgtaccgcgcgcgagttgtcccataagctggaccacgagcctagcgcggaagagatcgccgaacagctggacaaaccggtcgatgacgtcagccgtatgctgcgtctgaacgagcgcatcacctccgtggatactccgctgggtggcgattcagaaaaagcgctgctggatattctggccgatgagaaagagaacggcccggaagacaccacgcaggacgatgatatgaagcaaagtatcgtcaaatggctgtttgaactgaacgccaagcagcgtgaagttctggcacgtcgttttggtctgctgggttatgaagctgccacgctggaggatgtgggccgtgaaattggcctgacccgcgaacgcgtgcggcagatccaggtggaaggtctgcgtcgcctgcgggaaattctgcagggacaggggctgaatatcgaagcgctcttccgcgaataagacgttttctgtcaaaaaggccccctcgaaagtcggggcctttttctttgggctagccgaggcgggtttcctgcagatggcgccagacgattttcccttccgcttgctgaaaaatcgccgtcgaccagcgaacgttctggctgctatccgccagcgtttggctttcacgatatagcactgcggcgccgtcgtgccactcgctgatgatttccatctgatccactacgatatctaaccccggacggctgccgccggcgtggtggaaaaaatggctcaccgttgggtagtccatcttctcaccgctcaaggggatcatggtaaaatcggcggcaaaacgcttcatcagcgcctcagcgcttccttcgccatggcttaaccagcgttcgataaggacatgggcatcgaggacttcctgcagataaggattcatgacttctccagagtggtgtgcaggcgatggataatcgcccgattattcagccgcaggcaaaacagcagcggcaacagggtaatgacggcggcgctgataaataccccctgccaggcgtaggccggcgggaataccctcagcagcagggcgagcagggcgctgccggcaaagaagctgagctggcggttaagattccatagcgcgctggcgtcaggcatctcttcggcaggcgtatgcaggaaagcgctgctttgcgcggtgctgctgcataagctgcctccgccgcccatcagcgtaaaggccagaatcaacagcgccagcgggctgtccgcatcgatcttcagcagcagcatgatccccatcgcctgaagcaggcagccgatgacgaccagcggccggggcccgaagcggttgaaatatctgccggtaaaggtgatggcggcaaacgaggccagcgaccagggcaccatcagggcaccgattgcccccggcgccatcccggtgacgcgttgcaggtagtacatccccaccacgttgacgccaataaacatccccggcacgcagaggtagatcagcatcgcgaagcgcagcaggggatcggccagcagcgacagtggaagaaagcgagtcgggcgaaccggaccgggggtgtcgttcagccatcgcaccgccagcacaaaggttagcagagcgacaggcaggctggcgaaaaagacccagcgccaactgaacgcctcgactaacaggccgccgatcgccggcgagcaggcgggggccagcaggccgaccagcatcaccgccgccgacagcttcgcccgctcatgcggctgaaacagcggccacgtcagcgcctggccgagggggattaacagcccgccgcccatcccctgcagcgtccgccataaaatcagttcgctcaggctgttggcaagccctgccgccagcgcgccgaggctgaacagccccagcgagagtaaaaacagccgtttcgccccccagcgctcgctgagccaggcgctgaacggcacaacgaccgtcagaccgagaatataggcattactgacccacgccagctgcgagacggaaaccgccagcgcgcggctgattgccggaaaggcgatgctggcgataaacatattgatcaaatcgagaaaaaagccgaacagaaaaacggtggcaacgcggtggcggtaggtcatggttcactccctcagacaggcggctactgtaaacctgccgcagcgagggataaacgggactaatcgggatatactgtctgaatatttttgacaatcatccggacgacgatgcttaatcttcagcgcgtgaccatgtttatcgccgtggtagatgccggcagtttcaccctggccgcagcggcgctggggcagaccaaggcggtggtcagctttaacgtacggcagctggaaaatgagctgggggtgacgctgctgctgcgttcgacgcggcgtttgcggctcactgacgccggggtgctgttctatcagcgcggggtggcgctcctgaacgcggcggaaaatctccaggatgaggtgcgggccagccatagcggcttaagcggggagctacggatcaccaccacgccggagtatggcgagcaggttatcattccagcgctggccgcgttcgcccgtcgtcatccggcgctgcgggtgcgccacgtctcctcctcccgtcatgccgacctcatttcagaacgatttgatgtggcgatacgcctcggtacgctggccgattcccgctatcgggcgacgcggatagccagtttcgcgatcctgcccgtcgcctctccggtctggctggcaagccatccggtgcagacgctgtccgatctggcgcaagctgagtggattattcacgagcgcctgccgacgccgctgcgctggcagctgcgcacggatcaccagacagaggtggatttcgcgatagccagcgcgccgcggttttctgctgatagcgctacggcgctgatgagctttgctctggcgggatgcggcgtcgccttgctgcccgcatggctggtagccaaaaaggtggcgcagcgggagctggtgccgctcctgccggaataccatttcccacagcagggtgtgtatgccctttatcccgactctcagcatttgccgacccgggtgcgggcatttattgacttcctgcgcgagaaggtcggttaagcgcccgttcagggcgccatcattttgtgcaccagccgggagaactgctcgcgctcgtcatcgctcaggcggccgagaaactcgtcatcgacctcattgccctgcggaatggaacggttaagcaacgcctcgccttcgtcggtcagatagacaaaacggcggcgtttatcggccggatcgtgctcccggcgcaccaggccgcgcgcttccattcggctgagcatctccgccagcgtagccttggtgctgaccgccgcttcaatcagcgccacctgttcgatcccggggtgctccgctaccgagcgcatcaccgcatactgaggtttagtcagctccggcaacgcctgctgccagcgggcggtatgctgttgaaaaagctggcgcagcaggtggaatgcttcgtttcgtaactccatgaatactccgtaacaaaactgtcacctctatgatagccgttcgtacgcctttttataccctttctgcgttttgattaaaaatgcgcacgtatacgaacgatcttgccaataagggctggagggggtagtttaaatataaagttcgtacacgaacaaaagtaatgaggtctggaatgaaactgattattgggatgacgggggccaccggggcaccgcttggggtggcattgctgcaggcgctgcgcgatatgccggaggtggaaacccatctggtgatgtcgaaatgggccaaaaccaccatcgagctggaaacgccctggacggcgcgcgaagtggccgcgctggcggacttttcccacagcccggcagaccaggccgccaccatctcatccggttcatttcgtaccgacggcatgatcgttattccctgcagtatgaaaacgcttgcaggcattcgcgcgggttatgccgaagggctggtgggccgcgcggcggacgtggtgctcaaagaggggcgcaagctggtgttggtcccgcgggaaatgccgctcagcacgatccatctggagaacatgctggcgctgtcccgcatgggcgtggcgatggtcccgccgatgccagcttactacaaccacccggagacggttgacgatatcaccaatcatatcgtcacccgggtgctggatcagtttggcctcgactatcacaaagcgcgccgctggaacggcttgcgcacggcagaacaatttgcacaggagatcgaataatggcttttgatgatttgcgcagctttttgcaggcgctggatgaccagggacaactgctgaaaatcagtgaagaggtgaacgctgagcccgatctggcggcggccgccaatgcgaccggacgcatcggcgacggtgccccggcgctgtggttcgataatattcgcggctttaacgacgctcgcgtgacgatgaacaccatcggctcgtggcagaaccatgccatctcgctgggcctgccgcctaacacgccggtgaaaaagcagattgatgagttcattcgccgctgggataacttcccggtgacgccagagcgccgcgccaacccggcgtgggcagaaaatactgttgatggcgatgatatcaacctgttcgatattctgccgctgttccgcctcaacgatggtgacggcggtttctacctcgataaagcctgtgtcgtttcacgcgatccgctggataaagataacttcggtaagcaaaacgtcggtatctaccgcatggaagtgaaaggcaagcgcaagctcggcctgcagccggtaccgatgcacgatatcgcgctgcatctgcacaaagcggaagagcgtggggaagatctgccgatcgccattaccctcggtaacgacccgattattaccctgatgggtgccacgccgctgaaatacgatcagtctgaatatgagatggctggcgcgctgcgcgagagcccgtatcccatcgctaccgcgccgctgaccggctttgacgtgccctggggttcggaagtgatcctcgaaggggtcattgaagggcgtaagcgtgagatcgaggggccgttcggtgaatttaccggtcactactccggcggtcgtaacatgacggtagtgcgtatcgacaaagtctcttatcgcagcaaaccgatttttgaatcgctctacctcggtatgccgtggaccgagattgactatctgatgggcccggcgacctgcgtaccgctgtatcagcagctgaaggccgaatttccggaagtgcaggcggtcaacgccatgtacacccatggtctgctggcgatcatctccaccaaaaaacgctacggcggttttgcccgcgcggtgggcctgcgggcgatgaccactccccacggcctcggctatgtgaagatggtgatcatggttgatgaagacgtcgacccgttcaacctgccgcaggtgatgtgggcgctctcctcgaaggttaacccggcgggagacctggtgcagttgccgaacatgtcggtccttgaacttgacccaggctccagcccggcaggcattaccgacaaactgattatcgacgccaccaccccggttgcgccggaccttcgcggccactacagccagccggtgcaggatctgccggaaaccaaagcctgggctgaaaaactgaccgctatgctggccaaccgtaaataaggagaagaagatgatttgtccacgttgcgccgatgaaaagattgaagtcatggcgacctcgccggtgaaaggggtctggaccgtgtatcagtgccagcactgtctttacacctggcgagataccgagccgctgcgccgcaccagccgcgaacactatccggaagcgttccgcatgacgcagaaagatatcgatgaggcgccgcaggtgccgcacgtaccgccgctattgccggaagataagcgttaatgaaaggggcccgctaagtcgggccttttttatatttagtacaattatggaaattattttttcattaaattaaaaaattacgtgaagggttaatataccgggatgactttgcgagcctgcatccagattattataaaattcgtctgattaattccttgcagataaatttcacgccctgacgagtgtagaattgcggcgggtgcttgaggctgtctggccttgagcattaccaggaccccagacagacgaaagccccaggagatatttctatcaactgaggctagcgaatgaacatagacaattcagatgttagtctcttctttgcagggaggcaaaatatgcccttgtggcaatcgtcgtactctttattacggtactgggatttacgctgttggtgcacagctcactatgcgagctgagtattaaagagcgtaatattgagtttaaagctgttctcgcttacgaatcgaagaagtagcatccgcgcgagggcaaccccgcgtatgggttgtcaggacgcatcctctagcacccattttttgtttactaaaacggcagcgcttcacagcgctgccgtttttcaccttaatgggtggctagaccaggcttttcagacggtagatccactccagcgcctgacgcggggtcagggagtccggatcaagattctccagcgcctcaaccgcaggcgagggctcttccggggcggcgagtagcgacatctgcgtgccgtcgacctgggtcgccgccgcgttgggcgagatactctccagctcgcgcagtttctgccgcgcgcgcttgatcacctctttcggcacccccgccagcgcggcgaccgccaggccatagctcttgctggccgcgccgtcctgcacgctgtgcataaaggcgatggtatcgccgtgctccagcgcgtcgaggtggacgttggcgacgccttccattttctccggcagctgggtgagctcgaagtagtgggtggcgaacagcgtcagcgccttgattttgttggccagattttccgcacaggcccacgccagcgatagcccgtcgtaggtggacgtgccgcggccaatctcatccatcagcaccaggctatgctcggtggcattgtgcaggatattggcggtttcagtcatctccaccataaaggtcgagcggccgctggccaggtcatccgccgcgccgacgcgggtgaagatgcgatcgatcgggccaatttctactttctgcgccgggacgtagctgccgatataggccagtagcgcaatcagcgcggtctggcgcatataggtacttttaccgcccatgttcggcccggtaatgatcagcatccgccgctgcggcgccagctgcagcgggttagcgataaacggctctttcagcacctgctcgaccaccggatggcggccttcgctaatgcgaatgcctggcttatcgctaaaggtcgggcagcagtagttcagggtttccgcacgttctgccaggttgaccagcacgtccagctcggccagcgcgctggcgctggtttgcagatcggcgagatgcggcagcagcaggtcgaacagttcgtcataaagctgtttttccagcgccagcgctttgcccttggaggtcagcaccttatcttcgtattccttcagctcaggaataatgtagcgttcggcgtttttcagcgtctggcggcgcacatagtggatcggcgcgaggtggctctggccgcggctgatctggatgtagtagccgtggacggcgttgtagccgactttcagggtatcgaggcccagccgctcgcgctcgcggatctccagcttatcgagataatcggtggcgccatcggccagcgcccgccactcgtccagctcttcgctatagcccggggcgatgaccccgccgtcgcggaccaacaccggcggggcgtcgatcaccgcgcgctccagcagttcgcgcagttcggtgaactcgcccattttctcgcgcaatttttgcaccggctgactgtcaacgtcggccaggagctcacgcagcagaggcagttgctgcagggcatgacgcatgcgggcaagatcgcgcggccgggcggtacgcagcgccagacgcgccagaatacgctccagatcgccgacctggcgcagcaccggctgcagctcggtatagcgctcctgcagcgcgccgatggtctgctggcgctccaccagcacggcggtatcgcggaccggcatatgcagccagcgcttgagcatccggctacccatcggcgtcaccgtacagtcgagtaccgaggccagggtgttgtcggtgccgccggccagattctgggtgatctcgaggttacggcgggtggcggcatccataatgatgctgtcctgctggcgttccatggtgatggagcggatgtgcggcagcgaggtacgctgggtgtctttgacatactgcagcaggcagccggcggcgcacaggccgcgcggggcgttttcgacgccgaagccgaccagatcgcgggtgccgaactgcaggtttagctgctggcgcgcggtgtcgatttcaaattcccacagcgggcgacggcgcagaccgcggcggccctcgatcagcgacgattcggcaaaatcttccgcatacagcagttccgccgggttggtgcgctgcagctctgccgccatggtttcgcggtcggccggttcgctcaggcgaaagcgcccggagctgatatccagcgtcgcgtagccgaagcccttgctgtcctgccagatggcggccagcaggttgtcctggcgctcctgcagcagcgcttcatcgctaatggtgcccggggtgacgatacgtaccactttacgctcgaccggccccttggtggtggccgggtcgccaatctgctcgcaaatggccaccgactcgccctgattgaccagtttggcgaggtagttctctacggcgtggtgggggatgccggccatcggaatgggttcgcccgcggaggcgccgcgcttggtcagcgagatatcgagcagctgcgaggcgcgtttcgcatcgtcataaaatagctcgtaaaaatcccccatccggtaaaacagcagaatgtcaggatgttgcgcctttagcttgagatactgctgcatcatcggcgtgtgggcgtcgagattgtcaattgtgctcatggggtgttatccagatccctgattttaaatggctgcgattttgtagttttcgtcgttatcacatggatgagacataataacggagatgggcaggtgagggaaaccgacgaaagcgcgcggcgcgatccggattccagttgcgccgcgcgggggttacggcgccagataaacctgggggaccgcgttgtccgggtgctggacgaggcggacatccgccccgtaccagcgatggataaccggctgctggatcacctcctgcggcgtgccctgggcgaccagatgtccctggtggagcagcaggatgcggtcggcccacagggcggcgaggttaaggtcatgcagcaccacgcagacgtgcagttgcccgccggcggtgagccgtttgagcaaacgcagcaggtgctgctgatagtaaaggtccagcgccgaggtgggctcatcgagaaacagccagccctgcggcgcgccgtcgcgccatagctgcgccagacagcgggccagctgtacccgctgctgctcgccgccggagaggccgggatagcggcgaccggcaaggccatcgcagccggtgacggccatcaccgccgccagcaccgccggatccgccgtcgcgccccacggtgagcgtcccatggcaatgaccgtttccaccgtccagtcggcctgcagggccgttcgctgcagcatgaccgcccgccggcgcgacagcgcctcgggggaccaggcctccagcggcttgcctgcaagatggcgggtgccgctgtccggagtcagatagccagtcaacaggcgcagcagagtggatttcccggcgccgttcggcccgataagcgccgtcatctcgccgccgcgcagcgcgacggagacgttgtcgataatctgtcgtttaccaaggtgaagtgacagcccctgggcgcagtattcattaaccatgtctggagttctcccgacgaaagaccagccacagaaaccagggggcgcccagcaggctggtgagcagaccgaccggtatctccgccggcgccgccacggtgcgggccagggtgtcggccagcagaagcaggatcgcgcctgccagcagcgagccggggatcagtccgcgatggtcaggtcccagccacaggcgcatcaggtgcggcaccaccaggccgataaagccgatgactccgctgatggccaccgcgacggccaccagcaccgcgctgcacagcagcagccagcgctgcagcgcctgcacgttgaccccaagatagtgcgcctcttcatcgccaagctgcagcagattgaggcgggacgccatccaccacaccgccagcgccgccgggataatcaaggtcgcggccaccagcagcgtcggccattcggcctggcccagactgcccattccccacagcgacagctggcgcagctgggcgtcattgctcagccaggacaggacgccgaccagcgcgccgcacagcgcgttgatggcgatccccaccagcagcaggcgcgacagcgaaccctcctccgcccgactgaggatgaaaatcaccaccatcaccgccaggctgccaataaacgccgccagcatcggcatatacagagcgatcagccccgcaggggagaacgggagcactagccagctggccaccgccagcgcggcgccgctgctgatgcccagcaggcccgggtcggcaagcgggttgcgaaacagcccctgcatcacgcagccggagagggccagcgccgcgcccaccagcagggccagcagcacccgcggcagacggatggtcagccagatatggcgcagcatgtcatccccggaaggcagcaggttgaccagcggcaagcgcatggcgccgagggtggtggcaaacaacgtcagggagaccagcagcagcgtcatcagcagcaaacggcgagcgagggcagggcgcatcagggcaactgctccgctttgtttcgcagcgcgattatcgcctgcggtgtgcgcggcccgaagcccagcagggccatatcgtcgatcgtcagcagctgtttatgacgccccgccggggtctgcgccaggccgggcagtttccacagcccggcttcgccgcccatccctttgagaccatcggcggagatcaccaccagatccgcctggctggcggcgaccccttcctgcgacatggcgcgatagtggtcgaagccctgcatcgcgttctgcaatccggcggcgcgaatggcgccatcggccgcggtatgctgtccggccaccagggtattcattccgccgtggctgagaataaacagcacccgcttagcaaccggctgcgttggaatggcggcgatctgctgctgaagctgctggcgcagcgcgtcgcctgccgccgttttgcctaacgcttcggcaatgacggccactttgttatcgatcgcggacagactttcgccgcccggcacgttcaccaccttcaccccgctcgcctgcactttgtgtaagaccagcgagggctgcgcctgggcgctcgctaacaccagctgcgggcgtaacgcgaggatcccctcggcgttcagctgtcgcaggtagccgacgtccggcaacttttgcgccgccgggggccagctgctggtgctgtcccgcgccaccaggctctcctccgcgtgaagggcataaacgatctcagtgacatctccgccgagtgtgacgagccgctcaacggcggcgtgactcagcagcgggaaagcgatcaagagcagtaaccagcgcatcatgcgggctgcccttcacgggtcaggcggtctacctgctggcgccattgcgtctgctcggggtgcccctcgctgcgctggccgtagagctgggcaatctgggtgccgtctttagcgaacagttcgacgctggtgacgtgtccgtccgaagtcggcttgcgggtcacccacacttcatcgaggctctcttcgcgcagatgcagggtaaaagtagtattgaagatattcagccagccgcgcatgggggccagcttttccagggcgccggtaaagatctgcacgcagccgcgattgccgacgaaaatcatgatttcattgccctcctggcgcaccgtctccagcagcgacggcagcgcatggcgatccacgcggcaggcgaggtcgtcgctcaccagacggaaggcctgctggcgggaaagctgatatttacgcagcagaccgaagaactggtgaacgtcggtcatcgcgcgccagtcgttctccagggcggcgccgtcggcggtatcggcatatttcaccggctccagcgggcgcagggtcagcggtgccggcgccgccacccgatattccgcgatcagggtctcccaggccgccatgtcggtctgcgtggtcgcatagactttcagcagggcgtcgccgtggtggtcgaaaaactggatgctctgacggccattatcgttcagatggaaggcgctggcccactggctgaggaacagacgcaggtcgagcgcgcgcggggtcagcaccagcccggcgtggccgctgaggtgctggtgcgtgaactggcccacctgctcatgcacggcatactcgttgcggcagatgcatttggtttcgccgacgcgctccagggcggcaatcagcgcccgggcgtcatcgctcaggcgcacggcatcatgaccgaggcgggcggcggtcagctcggcttcgctgatccccatttccgcggcgatatcgcgggcatatttcgcggtactggccgctttggtggcctggtagcgctgccacaggtcagggtgtgcatttggcataatcatatccttctcgacgatgaatatccccggccggcgggccgggggcaggtgcgttattattcgggcaatcagaagtcgacgttgacgcccagctgccaagtgcggcccggcatcaccgccagcgctttatcgttggcgtcctggttggtgccggtctcgatattgcggctgctcaggtaatcccagtatttacgatcggtgaggttgtagaccccgccattgaggcgcacgtttttcgccacctgccagtacgtggtccagtccagcatgccgtagcccggcacgcgcatatagtcgctgctggcatcggtgatggcggatccgctgttgctgtagctttcgcggttggtggcggtcgcctgtttccctttgacaaaggtcgccgtcagggcggtgccgtagcgtttcgccggatcgtcccacgccacgccgacgatggctttcattggcgccacgctgtcgaggtcgacgtatttatcgccgctgtagctggatttcgatttcccttcgctatagccgagggcgagggtggcgctcaggccgtccacctgctcaaaccaggtgccaaagttaaatttggtgctaatctcaccgccgtagatataggctttatcgcggttttccgcctgataaatggtgtagatgttcgacggcacattcgtgaactggcccggattgttggcgcgggtatagcgggtataggcgataaagttcttatagctgttgtagaacagcgccgtgcgcagggtgatgccttcggtaacttcccctttcagcccccactcgagattatcgctggtttccgtcttcagatcggtattgccgatcagggcatactgctggctgccggcgtagctggagccgaggttccaggagccatacagctggctggcgttggggaactgcgccccgcgctggtactgcaggtaggtcatcaggcgcggggtgaggtcgtactggaaggtcaacgacggcagaacctgggtatcgctgtttttgccgtacagattcgccaccgacgattcgctcagcacgctgctgttggcggcgagatcggacagattttccggcttagtcgattgatgcaccacgcgcacgccgggaataacggcgaagttgtggctgtcgagatcgaagttgatcttatcctggacaaagccgccgagggtgtagctgcggctgtctgcctccggctgcatgatctcgctgtaaacgctggggatcggcgactggctgaacggccgctgggttttgctggtgctggcgttgaaaccggcgctcagatcgtggcggcccagggttttcgccagcgcggtctgcaggccccaggtgtcggtatcgtagttagagttcaccgtctgcattttgcgggtgacgctgtccggcatataagtccagtcatgggcttcggtatgctggtagtagatttttgtggagacgctgtcgaggtagtcgttcatcggcgtccagtcatccttcaggctcaggccccagcgccgggtctggctggtctggttggcggtgccgatggtgctgttgccgctggagtcccaggtatcgtagtgggtgtggttggttttatggtaatagtcgaaggtgctggtcagcttgtgctcatcgttaggctgccagatcccggaggccagaaaagcatcggagtgccagttcgccgggtaggcgtcgacggtgccgctgttgttttcggtttcctggccgtcacggcggctatagaccaaaatcccgcgcaggaactcatcgccgccggcgacggtcaccccgttgtgccagctgcgatccgcagagtcgtaaccgctgcggtagccgaaggcgctggtcttgcccgggcgcaggtaatcatccgctgatttcgggcggaaggagacattccccccgatagcgctgttggccgtttccgtcgaggtggcgccggactggatatccacgctgccgtacatatacgggtcgatataatcgcggccgatgccgaaggtgttgagcccggcgcggccgacgtagccgcggccggtggcgttgggttgcgcgataccgtccacgtcgatgcctacgcggttgctctccataccgcgaatgttgtagccggtgtaacctccgcggtcgaagccgcttttgccgttgccggagccgccgctggccccggtggcgctgatgagcggctcatagcgcatgattgagccgaaatcgttagcgcctttattctccagctcccgggcgctgatgctgtgttcgctaccggctttctgcaccggcgcgggggcggtgacggtcatttgttccgaggtgtcatccaccgcctcgccgctaacggcggaagtatctgctgcgatggcagaagtctgataaattgctgcaaacaaagaggtcaccagcaggcgttttttacaccatgctgctgacggagtcgatttgtacatagtcgccacgccttgatcgttattagtatcggctcacgcgttacttccagagatgcaggttgctccgtcttttccgttgcggatggggtcttactccatttgttgattgcgaatggtaatgataggtattatcgtttgcaacaaaataatcatgtgttcttcatttaaactgcactttgtttacaatttgccctttcagacttagcgagacgacgatgaactcaaaagcggccatcaccatcacctactgttcccagtgcaactggatgctgcgcgccagctggatggcgcaggagctgttatataccttcagcaccgacatcgcctcggtgacgctggtgccggggaccggcgggatcttcacgatcgatgtcgacggtcagcagatctgggagcgcaagcaggatggcggttttccggatgcggccgagctgaaacgccgggtgcgcgatgtctgcttcccggagaagccgctgggccatgtggataaaggtgaccagaaggggtgacaaccccctccggacgacaagcgcccggaggagaagccgttagtgggctaactgcacgtcaaccagcacgctttgtcggcgagtgtgtatgagggataccgcttcttccagcacgccggggagatcttcggcccgggaaaccgacagggccgccgcgcggctggaggcggcgatcgcggcgaaatccggcgaggtggtaaaggcggtggccggaatggtttccgcgcgggccgcgtagccgtccgggtagagcgctttggtgccgcccgcgacggcgccccatccgccgttatttccgaccacgacgaggacaggaagcttcattacctccgcaatatggtggcagaccgcagggttggcgaacaggtacgacccgtcgccgacggcggcaataatcagctcttcccggcgcgcaagctgcagccccagcgcgatgggcagggcttcgcccaggccgccggccagcgcttcctggtaatagctctcggcatgggtcagtccggcaaactgcggcagcgtggtcagttcagaaacgatccggccgcggtgttgattagccagatggccgaggcagtagctgagccagggtttggtaatggccccggtctggctggcatggagaagcgcgtcgcgctggtttttctgttgctggatgcggctctgcgtatatgccgcccgctccgccacatgctgctggcgggcggcctgcagcgggcgcagcgcctcttccagcaggctgaagacttcatcggtctcgcccgccaggttgatgtccgcgcgatagccgcgcaccgggtagcgggagaagagcggatcgggccccatctggatcacggtgcagtcctggcgacagtcgccctcggcgatcatccatggtgcctgcgagtcgaccaccagaatcacatcggcgtcagcgagccagacgctgggatcagccccggcgagcaggggattatcggcgctcagggtaacctcggtgccccagtattccaccagagggatcgcccattcgcgcaccagactatcgaggcgcgcaaagccttccgccgttcgggcgccgcgctgggcgaagatgaccgggtgtctggcgcaggcgattgcctcggctgcgcgggcgatatcttccctgactggcgcatagcggaccggctgctgcgaagggccagcctgcagcgcggcctcatcgacggcaaaggtttcgcacagtggctcacgcggtaagctcaggtagaccggccctttcggcagggagctggcgatcgcccaggcccggtcaacatgctcgccgatctgatcggccagccgcagttcaaaatcccacttcacggattcgcggatcagcgccgcctggtcgcgcatctcctggccgtagccaatcggcgtattacggcagccgaagtgggaatgttcgcttatcggcgtgcggccgccaaaaatcagcaccggaatattgctgttcgccagattgatgacgccgcaggcggcgttggctagcccgacgttggtgtgaaccatcaccgcctgcaccttgccggtgccgaggtaatagccatgggccatgccgatggcggcgttttcatgcgggcagatcactaactccggtaccttttgcccggtcgcccgggcctttgcccaggcttcaatgactggaggataatcggtgcccgagttgataaaaatatacgccacgtccagcgcctgtagccgatgcagtaaaagttcagcagccgataatgtgatagaggccatattctctccgtattcacgcggtgtaatcgcggtaattaaaaggttaagaaaataaatccgcccatcgtaatgatggaggcaataatactcagcgccatcgtcgaggccatttcctgctcgccggttttatactgcatagcaataattatcgcgatggagcctaccgggatagccatcgtcaatacgacttcctttatttgctccatgctgaagcccatttttaataaaatgagatagcaggcgccggggaccagaatattgcgggcgataacggtgataatggtagcggtggtgataacaatgctgcgcgtatagagcacgatcccggcggcaaacagcgccagcccgccagaggctttgcccagcagacccagcgacatcgagatagtctgcggaatatggatatccgccagcacgatgatcagggcgattaccggcgaccagaccacgggttgtttaatggcgttcaccacccgtgcgccaaaggaaatatgctggctcttatcgccggtggcgaccgacatcagtatcatcaccagcggcagctggaagacgttttgcgtgatgctggacacggtgatcagcgacgcgctgacggtgccaaataaaaaggccagcactgaggtgccgataaacgggactgccggcgagccgatggccagcgcctgcagcgtactgagggcgaggtcgcgtcgaaacagatagcgggcgaccagtaagggaatgacgaagctgagaatcagcgccaggatgatagccacggcgaccgggcccatggtcatgacgatgtgtcgcggcgtcatcaccatattgctgaaaatacttagcggcaatgcgtagagcatcacaattttattgatgtctcctgcctgctgccagttaaagtcttttcgtttaccgctaatatagccgatgatgacggtaatgatgaccggtaatatagcgcctgaaattaatagaatattgttctgtgtcatggtgatatattctcattataaattatcttcggttcaaaaatgtgttttgccgtgggtggtgagataaataaatccttttgaagtatgcgttccggtgatttttgagcgtattgatagcgatatttattcgctaaaaaagggcgcaggggaaatgcaaaaaccgtttattcaatgagtaaatatcatgccaatgaaatttaagcagattcaggcatttattaccgtcgcccgcgaaggcaatatgaccctggccgcagagaaaatggggatcacccagtcgggactgagccgactgctattgagcctggaagcggacctgagcgcatccttattcgaacgacataagcacggcatggcgttgagcgaatatggcagcgcctttttaccctacgcgctgacgatgctgaataccgaacaaaaggcgcgcgaggaaattgagctcatccgtggcgccgggaaaggcattctgcggattggctgcgtttccagtctgctgaccagccatttcatcgataagctggcggctttccatcagcaccatccccagatccatctgcggatcgtcgaccgcattgactccgagctgtataagctgttgctgatgcacgacatcgatatcgccctctgcggtcccttaccgcatgatgagaaaatcgtggtgcggggcaaaattaactggcaggaccggatctgcatcgtcgccaggcagcaccacccgctgcatcaggcggcggacgtcaccctggaggcgatgctggactatccgtggattatgccgccgccgtctagtacgccaatgaacatcctggcggatatctttcgcgcccggcagctaccctgtccgcagccggttattgagtgcgcctcatcctcggccattaaggcctttctgtgcgagagcgatctgttaacgtcgatgccggccccggtttaccgacacgaagaagcgcttggcctgctgcgcccgtttgagctcgagggcagcgtttttatccgggatttctatgcctacagccatttcggggttctgtccggggcagccctgcagttgattcagcatctgaagcagtgagtctggtcgggtatggatattaaggtgtatgataaatacaccttaagagcagacgaaaggcggggagatggggaagcgtatcgaacgggaaaaaatgacgattcagcggatgattgccctctaccagcggcgcagtcccgacgcgcaggccgataatgcgcactatcaggcgctgaacgcctacgctgacaagcgccttgataagtgcgtgtttggcgagaacaaaccggcctgcaagcagtgtccggtgcattgctaccagccggcgaagcgcgaggagatgaagcagattatgcgctgggccgggccgcggatgctctggcgccacccgatcctcactgttcgccatctgctggacgacaggcgcccggtgccgccgctgccggaaaaatatcgaccgaaaaagtagcggctttccctggtcagcgctgcgcagccgggcgacaagtcgtgctcttgtagccccggcaaggcgttagccgccaccggggataattgctgaagttttctgtttctgactatcgcggatcgtgcttgcgacaaaggcgaccacaaacagcgcggtaaacagcactacgatagtcggcgctggcgcgctgtcgagatagaacgccagccacacccctcccgccgagcagccgatggccaccgctaccgccagcagcagggcgtggataaagcgtctcaccagcagaagcgcgatcgccccgggggcaatcagcagcgaaatcgacagaataatccccaccgactgcagcgtcgcgacgatggtcagggcgatcatgcacagcaggccgtagtgcagcagtccgccgcgcaggccgctggctttagcctgcgttggatcgaaggcgtgcagcaaaaaatcccgccatttgagaccgataataaacgcaatcaccagtgcgatcgccgtcgtttgcccaatatcgctgagggagatccccagcatatcgccgaacaggatatggtcgagatgaacatcggactggatcgctacgtacagcaccagtccggcgccaaacatgccggagaagacaatccccatgatggtatcgcgcttgagtcggctgttatcgtcgagaaaaccggtcgtcacggcgcacagcagaccagcgataaacgcgccgatggcgaaggggatgccgataatgtaggccagcaccacgcccggaaagaccgcgtggctcatggcgtcgcccatcagcgcccagcctttgagcaccagaaacaccgacagcagcgcgcagggaatggcgacgacgatcgatatcgctatcgcattgaccataaaaggaaactggaacggggcctggaacaggttcagcatgcggcctccctggcgcggcggcggctggccagcaggccgtgcttcggcgcgaagataaaggtgatgaggaacagcagcgtttgcgcgaccacgataatgccgccggtggcgccgtcgagatagtagctgagccaggcgccgaagaaactggtcaggctgccgatagccacggcgatggccagcaggcgcgggaagcgatcggttaacagccacgcggtggccccgggagtgaccaccaggcagatgaccagaaaggcgccgacggtctgcagcgccgccacggtgcaggcggccagcagggtaaagaacagcagcttcaggccgcgggtgttcaggccaatcgagcgggcgtggtgttcatcaaagaaggtcaccatcaggtctttccacttcagcagcagaatcgccattgagataaagccgatcgctgccagctggataatatcctccggggcgatggccagaatattgccgaggatgatggtctggatattcaccgacgtcggattcagcgacaccataaacagcccgatcccgaagaaggaggagaagatcagcccgataatggcatcctcttttagccgcgagcgctgttgcaaaaacagcatgctgcccgccgccaggccgccggagagaaacgcgccgagcgcgaaaggcaggccgagcatataggccccggcgacgccgggcacaatcgagtgggagagggcgtcgccaatcagcgaccagcctttgagcatcaggtagcaggagagaaacgcacagacgccgcccaccagcgccgacacccacatcgcattgagcatatagtaatagccaaacggctccagcagccagctcatcgtgggcctcccgccgcgcgccggctgataaacggccgctcgtcatcggtgataacctgcgcttccccgcctgtgagcgcgacgtggcgcagcacgccgctgaaagcccgctccagattctcggcagtgaaggtggtttctgtcgggccgctggccagcacggtgcctttcaccatcaccgtataatcacaaaattcactcactgacccgaggttgtgggtggagaccagcatggtacagccctcatcgcggagctcgcgcagcaggctgatgatccgcgcttcggtctgcacatcgacgccggtgaaaggttcatccagcaggatcacctgaccctgctgagcgatggcgcgggcaagaaagacgcgctttttctgcccgccggagagctcgccaatctgccgatggcggaactcgctcatgcccacgcgggccagcgcggcatcgacaatctcgcgatcgcgcggctttgcccgccgcagccagcccatatggccgtagcggcccatcatcaccacatcctccaccagcaccgggaaggaccagtccacctcttccgactgcgggacataggcgaccaggttctggcgcagcgcgcggttgaccggctggccgagtatggcgatctcgccgtgaccaacgcggacaaagcccatcagcgctttaaacagcgtggatttacccgagccgttaacccccaccaacgcggcaatggagccgcgcggcacgctgaacgaggcgtcgcgcagggcagtgtggccgttgcgccaggtgacggtgagctggttgacatacagtcccgcttgcgctgcattcatggctgcttcctcatcccgtcctggataccgttgacgatggtttcggtggtgacgcgcagcaggtcgagccaggtcggcaccgggccgtcggcggcgctcagcgaatcgacatacagcacgccgccgtagtgggccccggcttcccgcgccacctgacgcgccggtttatcggagatggtgctttcgctgaagatggtcgggatgcgttctttcttcatggtgtcgataaccttgcgcacctgttgcggggtgccctgctggtcggcattgatcggccacagatacagttcgcgcaggccatagtcgcgggccagataggagaaggctccctcgctggtgaccagccagcgcttatccgccggcagctgcgccagtctggcctgcagcggcgccatcgtctgacggatcttctctttgtaggcctcggcgttacggcgataggtgtcggcgtgaggcggatcgtacttcaccagcgcatcgcgaatgttatcgacatagatcagggcgttatctgccgacatccaggcatggggattgggcttcccgctataggggcccgcgctgatgcccatcggctggatcccctcgctgaccaccacctccggaacgccctgtaagtgctgataaaaacgggcaaaccaccgttcgagattaagcccattgctgaggatcagctgcgccccctgcgcgcgtttgatatcgccgggcgtgggctggtaatcatggatctccgcgcccggtttagtaatggagctcacgtcggcggcgtcgccggccacgttctgcgccatatcggcgataaccgtgaaggtggtgataaccctgaatttctcctgcgccgaggccggcgtcgcggccagcagagccagcgcgctggccagcagcaatgatttcagcggtgtcaggtgtagcataggatccctcgcaatggtgtggttaatttcccagcgtttatagccattgctatgttatatagcacaagctatttataaatgaaaataattcttatttgcatgcgtgggtaataatgagccgggaaacgaaagcgcgaaaaggggaggtaagtctggcccggcgccaaccgggcgaagatcaagagatatcggcgaccgactggcgcgggatcaggcggccagccagcgagcggccctcggtggcgaaggttggccggtcgtcaatcaggctgcgaatacgctgaatacagttatccagcagcgcctccagtggccaggagatgcaggtcagcggcgggtagagcagcgaggcgagcggggaatcctcaaggctcagcagggagacctcctgcgggacggcgatggtgaattcgcgcagcagacgcatcgcctcagccgcgtagcggtcgcgtttaacgataatgactgagtatttactgaagctgttaattaaggtcagcagcgcctgctcgacgtcatcgttggccgtcagcaccagctgacggttaaaaggaatggagtagttctgcaggacgttgcggtagccttccagcatctgacggctggcatcgtcgctatcgctgtccaccagcagggcgatgttgcggtgtcccttgccaatcacatagcggcaggcgctttcggtggcaaaggcgaagtcatagccctggctgttgctcccggcgacgccgaagcggtcaaaggcgataacgttgcgcggcgcgtcggcggcaacggcgcccagcaccaccaccgccacgcactggcgctgcagatcgtcgattaccgccgcctgctctaccgggtcgctgacgtactggaccagcaggcttttattcagccctttcagcgcctgagagagcagcggcagcagacgtgcgccgtggctttcgtcctgcgcggaaatcaccagaccaacgtggctggatgtctgactggcgaggttttgcgcggcaaagctcgggcgatagttgagttcttcaacggcccgcagcacagcttcccggctctcttcgcgcacgccccgggtgccggtcagcacgcgggataccgtcgctcttgagacattcgctaatcttgaaacatcatcaatcgttggcatggctttttctgtctgaacattttcgcctagcttaacatacctgctgaaaaaagtgtctaccgctgcccttgcgcggcgccgggaagccggggcagccaggccgcgccgcgcacgccgctggcgtcgccgaaacgggccggtttgatctgcgtgcggcaggtgtcggagaagatccacggcacgatggcggcaggcagatcgcgatagatctggctgacgttggacagaccgccgcccagcacaagcacctgcgggtcgagaatattgatcaccgacgccaggctgcgggcaaaggcatcgataaagtgtcgccagtgggccagcgcgcgcggatcgccgttttgcgccgcggcgacaatggcttccgcacgggcttgttccccatagcggcgggcgaagccggtactggagagaaagctttcgatgcagttcgttttgccgcagtagcagggctgcggcgggccatcgcgctcaggagtatagcccggcagcggattatgcccccactccccggcgatagcgttggggccgctgagcagctgttgatgaacggcgatcccgccgccgcagccggtaccgataatcaccccgaagacggtggtagctccggcgccggcgccatccaccgcctccgaaagagtgaagcagtcggcatcgtttgccatccacaccggctggccaagctgctgcatgatatcccggcgcagatcgtgaccgttgagcaccaggcagttgcagtttttaatgcgtccgctttgcggatcgatagccccgggcaggccgatccccagggtgaacggctgcgggctgaccgcgcgaatatcggcaatcagggtcagcagctgacgcataaaggcgtcatagctctctttgtgggtcggccggcgcaggcgctggacgcattcgcccgccgggtccagcagtacggcttccattttggtgccgccaatatctattccaagatgtaacatagtgacctcggggaatcaggcccggccagcgcgtctggccgggcaaggcgctaggcgtgaagcggctgcgcgcggtaaatcgcaatcagttcggcaatcagctctttcgccagaatggatgtcatcaggtgatcctgagcatggaccattaccagcgtcattttggtttttccctcgccttcgtcagcttcgataagctgggtctgtacaaggtgagcttcgcgggaatagtgcgccgcttcctgcattttggcgtcggcggtggcgaaatcacccgctttagcggcgtgcagcgcttcgtagcacaggctacgtgactggccggcgttgatgatgatccccatcacctgttcttctaattccatgattatcctctgaatcgttagcgttaagcggtttgcgccgcgttgtcagcctggccgacggcgttttcacgctcctgggccagcagctgtttttcgtaagctttgagaaatggcaggtacatcaccatggcggtagccatacaaatgaggcacaggatcaccgggctaaagctccagttcgccgcccacgaggcgccgataggcgccggcgttgtccacggcgtcatcgacactacgcggctgaccaggtccagcttcagcgcgaagtacgccagggtcgcgttcaccatcggcaccagcacgaacggcaggaaaaacagcgggttcatgatgatcggcgcgccgaacagaatcggttcgttgatgttaaatacgcccggcacgacccccatccggccgatcgtccgcagatgcacggccttgctgcgcagcagcatcagcgccagcggcagggtggagccgacgccgccgatcagcagatagtgatcccagaagccctggacatagatgtgcgggatagcggtgccagcggccatggccgcctgattgaccgacaggttggccatccagaacgggttcatgatcccggtgacgatcagcgcgccgtggatcccggcgaaccacagcacctgacagaccagcaccgacagcaggatcgccggcagcgtatcggaagccgcgaccagcggcttcaccagcgacatgatcgcttccggaatgatcatccccagctgggcttcgataaacaggttcagcggatgcagcgtcagaatgatcgccagcaccgggatcaggatttcaaacgagcgcgccaccccggcaggcacttccggcggcaggcgaatggtgatgttatgccgtttgaggaaggcgtacagctcggtggaatagatggccaccagaatggcggtaaagatcccctgaccggagaagtaggcagtagagatctggccatctttcagcggcgcggctaccagcagaaacgacatcagcgacagcatcccggcggtcagcgagtccagatgatggtgtttggcgaggctggcggcgatcccgacggcgataaacagggtcatcacccccatgctgaagttgaacggcagcatcagcgcatcgcgatgatcgagcgaaaattgcagccaggcgcgggcaaacccccacgtcgtatccggagaaaacggcgggaagataaacaccaacaggaacgagccgacgatcataaagggcagggcagtgataaagccatcgcggatcgaggtgacatatttttgctggccgatcgcgccggccataggcgtgatctgccgttcgatcacgtcgatcagtttagcgtacagagagctcatgatctttccttagttcttgttttcgataagggaaagggcgaaatcaaggaccgcggcgcctttttgcatgccgtagtccatcatattgatgggttcgacgcggataccgtatttatccgcctgtttttgcaggtcctgctgcatgtatttcacctgcggccccagcagcaccacctgataatggccgacctgttcggcaaactccgctacgccataggcgttgatctctaccggcaggccccgctgttcggcttccgcaatcatttttttcatcagcaggctggtggacatgcctgccgaacaacacaacataatttttttcataattaccgctcctgatgaggttggatgagcggactatagtcaaaatggatgcattacggaaagcgctttccgtttgtggatttattaattgtgaccatgatcacctatggcaggctttcactttccggtgttgtgggcgatcatcccggcgagacaaccattcgcaaaggtaggagtatgaacattcagttaatgaatgtggccgtggacatcatcgagcagcggctggcgccgctggcgaacgttctgacgcgcaacaaccacattacggcgatgcgcgatagctttgcgctggctatgccctttgtgattgttggcagcctgttagttcccattttgtttccgcccgtttccatcgacggcgcctcgcgtttcggccaggtctatttgctgctgcggcctatcctgctgccgacctttcagctaactattggcctggtggcgctgattgtcgccttcggcgccagcgccagtctcgccaagcagtaccgtctgccggaacggctctgcggtttaaccgggtgtctggcttttctgctgtttatcggctttcgcgagactgcggtgagcaatgtttatctcggcggtatggggatatttaccgccctgatatccagcacctattccattgagataattcgctttttctacaaaaaaggctggtgcattcgcttgcctgatgaagtgccgctgatgacccgcaatggctttcaactgctgatcccgctgctggtggtgatgctgtcgataagcgtgatgaatgccatactgctgcagaccaccggacgcatcgtaccggagttgatcagcgaagcggtgcggccgctggtgctggcgtccgacacgctgatggcggtacttatctctttatttatctgtaacttactctggtttatcggtatccacggcgcgctgatcatcaccgggatcatgaaccccttctggatgacctatctgtttgaaaatcagcaggcgctggcggcgggttcgccaacgctgccgcatatttatctgcaggggttctgggatttttacctgctgatcggcggtattggctccactttgccgctggtgctgatggcgatgcgcagccgctcgcggcagctgaaaagcgtggccaagattggcctgctgccgtcgctgtttaatatcaacgagccaatactgtttggttttccggtgatcatgaacccggtttttttactgccgtttctctttgttccgctgataaatgcctgtatcgcatggtatttaactcagctgggtatcctcgaccgcgcggtggcgatgctgccatggtcgatgccttccccgctgggggcggcatggtcggcgaacggcagctggaaaaatttgtgcatgagcctgttcgcgatgtttaacgcctggatgctctatcgccccttcttcaaagtgtacgaacgccagctcgcggaaaccgaacgctgaccccctcgccgtcggcggcttatcccccggcggcacctgctcatctcctcctccttccgctccactgccggctcccggcggcattcttgtaattttatgtgatcagtctcacgaatatattcgccgcagagctaattttgtgaaccagataggcaattatggaaagcgctttccgtaagtggatgtacatttccgtttttgatccgtaaatttcccctccgttatcggttcgtgttaacaaacataacgtgggaaaaaaataatgataaagctgaaacactcaatacctctggctctcctctcgctggcaggggccagcagcccggcctgcgccgatccgaagtatgattttgcgctgcatggctatatccgctccgggatcctggcgaactccgatggcaaccgcgcggactccgtcggcctgatgccggacggtaagtggcgactgggcaacgaagaagacaccaagatcgaactgatccccaccgtgacgctgacggcggacagcggcgtggtggcgaaagtgcaggccaacctcactcaccagtcgaaatgcacctccgactggaactgtcaggatgacgatggccatgacgtacagtttcgtgaagggttcgccgagctgagcaatctggattttgcgccggagatgaccttctgggccggtaagcgctacagcagctccaacacctccagccatcagttcgactgggagtacattcagtacaacggcaccggcggcggcttcgataacatggatctcggcttcgcccgcttcgacgccggggtgtacgccttttcacccaccgatgaaaccaaagcctacccggtggataagggagatcagggctacccggatgactattccctcaacctgtggctgaaaaagatcgcggggacaggcttcgatctggagctgatcggccaccacatgaaccgtaacgaaaaccatccgacttccgccgagaagggctatggcgtgaccggtatttataactttgacggcttctatggtctgaccggaggctactcccgcctcgcattgcagtacgggaaagggctggcggcgggtgactcgctgggtaaaaacggctggggctgggccaacctggaaaacacccagtcctggcgagtggtgctggatagcgtggcctcgatgggcgacctggagatctcgaccttcgctttctggcaaaaagataaaaactaccgctggtggacggaagatgaaaatggctggggacgctcgatgtgggtcgctggtatccgcccttatcatcagatcacccgcaactttgccatgcagtacgagctgggctacgaatacctggatgacaaaaactacaaaggagtaaacggcaaaggcaaaggcggcctgaccaaagtcaccgttgcgccaacgctgacctttgactccggtttctgggcgcgtccgcagctgcgcttcttcgtcacctacgcgaagtgggataaaggtgtctccgatgcattagacggtaactacaactgggataccaataccatcaccgccggcgggtattcccgcagtggctctaccgacaccgttaacttcggcgtacaggccgaggtctggttctaaggagagacaacgatgaagccgatgaaaaacctgctgctgatggggctgctgtccgcgctgggggccggcggggcgctggccgccgagcgctcgcactttacgcactttatcactcgcgacggcgccaccctcaaggacggcgacaaggtgtttcgtttcgccgggatccacgcgccggagctacaccgcattgaagacgacgcccgcggcccctgcagggcagatccgcgcggctgggggcaatactttaaatggccaacggcccaggagcagcaaaactggatccaggcgatggtgcaaaccggggcgaaagcccagcgcgtctacgtgctgtcggtgcagcaggaatttgataaggcctgcgggcgtgagacccatattctggcgccggaaacggcggacggcatgccgcggctgaatgagaaagccatgcgggtgtatgacaacatgattgccgaagcggataaacagggattgcgtctgatcctgccgtttatcgaccactggtggtggtggggcgggcgcgagcagctggcggcgttctatcatgaaaaagcggaagacttttatcggaccgatagcaagaccttcaaagcctatctggatgtgatccgccaggttatcacccggacaaataccgtcaccggccgcgcctattatgatgaaaaggcgatcatggcctgggaaaccggtaacgagctggaggataccaacgccgatttcctgcatcagaccgcggcgtggattaaaaaatgggcccctcatcagctggtggtggatggcacctataagaaaattaatccgtttgcgttgaccgaccccaatgtggatatcgtcagcaatcactattacaccaatgccgataataaccatcccgggcaggtgacgcaggatctgcgcgccgtcggcggacaaaaagtctatctcgtcggcgagtttggcctgctgccggcggatcaactgaacgccattatgcagtcgattgttcacagcgacgtcaacggggcgcaagctgccggcgggcttatctggggcttccgcggccatcgtcacgacggcggcttctactggcataaggagtcgaccgggcactatagctaccacctgccggggtttgccaaagaaggcgaagcgaaccaggagcaggcggtggtcgatctggtgcgcaccgccgcggcgcagatggccgggcagcagacgatggcaccgctgccgaagccggacgcgcctttgctgcgcgaaaccacctcgcccttcgcgatcaactggatgggcgctgcggtaggacgcagctacgatgtcgaacgcgccgcctcaccgaccgggccgtggacggtggtgggccgggatatctccgatggcgttaacgaatggaatccggaaaccatggttctgttccgcgacgattatcgtcagcttcagctcgggcacacgtattactaccgggtgacggcgaaaaacgagagtggtcgttcggccccttccaatgtgattagcgtgcagcatagcgaggagaatcagccaccggttgtcacgctggaaccggccctaaccaccacgcaggaccagggcgtcgagcttacggccagctggcaggacgatggcctgccgtcgcgagaggttaaggtgggctggcagcacgccggcgatggccaggtgcatttctgccatgccgatcgggctcaaaaccgggcctggtttacggcgccaggcacctatgcgctgacgttcacggcggacgatgggctgttgaaaagcagcaaaaccgtgaccgtgacggtgggcgaggcgacggggaaagcgccagcggatttttgtcgttatcacggcgaagtttatggcgtggctgaggggcggctgacggtgatgaagagtgataaagacgcgctgacagttggtgaggacggcttcctcggcccatttgccaacgagggggataaggtcagctggcaggtgcaggcgccgtggagcggtcagttcctgctcaatgtaaccttcaacggcaaatggggcggtaagcagaactcgtttgtcgtcaacgggggcgctcggcaggcggtggccttcccgcagacggatgagcagggccagcagctgcggataccggtgacgcttaaagccgggagcaatcagattgacttcggccgcttcgccggcgactggggctatatgttcattaaatcgatcgaagtggtcgctgagtagtacgttcaggctgcgccagacgggcgcagccttttttcgaaggagaggttatgcagcagtatcagtttccgcaagggttcctgtggggggcggcggcgtccggcccgcaaacggaaggggtcaccaataagcgccatcgttccatctgggacagctggtttgccgaacagccggagcgattttatcagcaggtagggccgcagaccgtgtgtgatacttatcatcagtatccgcaggacgtggcgctgatgaaacagaccggcttcaactcatttcgtacctcgatacagtggtcacgactgatcgctgatttggaaaccggcgcgccggacccggacgcggtgcgtttttatcacgcctatctggatgagatgatcgccaacggcattgagccgatgatcaatctctaccactttgatatgccggaagcgctgcagaaacagtacggcggctttgaatcggcgcacgtagccgagctgtttgcccgctttgcccgcaccgcctttagcctgtttggccataaggttaaatactggataaccttcaacgagccgattgtgccggttgagggaggctacctgtacgactttcactatccatgtaagaaagatggccggctggcggcgcaggtggcgtttaacattatgctggcgcacgccaaagcggtaacggcttatcgtgaactggcgctggcgggcgagatcggcgtggtgctcaacctgaccccgagctataccctcaccgacagcgacgcggataaaaaagccgccgggtatgccgacctgttttttaaccgcagcttccttgacccgctggtaaaacatgaattccccaaagcgctgtgcgagatccttgccgcccacgactgcctgccgacgaccagcaaagacgacgcggcgttgatcctcagcgcggatatcgattttcttggggtaaactattatgtgccgcggcgggtaaaagcgcgtgagagcgaatatgacctcgattatttcaccccggaatactatttcgaaaacgcggtgaacccgcagggccgctttaatccttatcgtgataacaacgagatcctgccgcaggcgatctatgacattgccgccaatattcgcgataactacggcaatattaagtggtatctcgcggaaatcggcatcgcgatggatcgacaatcagagggcgagcccggggcggacggggtgatagacgatactttccgcatccagctgatggaggagcatctggtgcagctgcatcgggcgatagccgacggcgcgaactgctttggcgtgcaccagtggacgtttatcgacaactggtcgtggatcaatgccttcaaacggcgctacggcttctggcgactggatctggagaccggcgagcgacagataaaacgcaatgcgctgtggtttgccgaactggcgaccagcaacggttttaccagcgataaatagcgcgctgcgccagcgctccctctcaccggcgcggaaagggggagcgcgcgaggttacaccagttcgtctttattaatacccagccgcttcatgcgtgacaggagcgtggtgcgcttgagccccagccgctgggcggcgcctttcggcccggccaccacgccgttgctctccttcagcacccggacgatcagctgatattcatcctcaccttcctcaggcaggaccgccggcgtccgcggggcttccacgatatcccgctccggcagggagagctgcagtacgttgccgcgggtgagcaataccgcccgttcgataacgttttccagctcgcgcacgttgcccggccactccatacgcgtcagagtgcgcagggtttccgccggaatgctgtcgatattgcgccccatgcggcgggcgattttaaaggtaaacgccttcaccagcagcgggatatcgtcgggacgttcgcgcagcggcggcaggtggatcgggaacacgttgagccggtagtagagatcgctgcggaattccctgtcgataaccatctgcttgagatcgcggttggtggcggcgatcaatcgaacgtcggtctgaatcagcttgttgctccccagacgttcgaactcctgctcctggaggacgcgcagcagtttgggctgcagttccagcggcatatcgcccacttcatcgaggaacagggagcttttgtccgccagttcgaagcggccgatacgctgggcgctagccccggtgaacgcgccgcgttcgtggccgaacagatcgctctccagcagcccggcgggcatcgccgcgcagttcatcttcaccatccgccgaccgttgcgtccgctgaggttgtggatagcgcgggcgataagctctttgccggtgccggtttcgccgaggatcagcacggtgctgtcgctctgcgccaccatctctacctgcttgagcacattgttcatcgcctcgctgcggccgataatctccccgaattcgctctcgacattattgagctgctcggtgagggcgaggttctcatccaccagccgctctttcaggcgctgaatttcgcggtaggcgagggcgttatcgatagcgatcgacacccgctcggcgatctgccgcagcagcttgagattggtggtggtgaagacctgttcgtcgcactgcgccagcttaagcaccccgagcagggtattgccggacatcagcggcagcaggcatagggtctggatcttattgccccacatctcgaagagcattttctcatacggcgcgagagtgtcatgttcgtgcagattaagcagcagcatctctttgcttttgaacacgcgctcggtgagggtgccggcttcatccacctcgctctggtcgtgaaccgggtggctggcgtcaagataatgcgtggaatagatgttgagcttccccttgcggtcgctgcgcagcaccacgctgatggcgtcgatccggaagtagcgatggatctctttcgccacctcgctgaccagctcgtcgatatccagtcgcgagagcaccgcgttggtgatcgccaccaggatgcgaaagttgtcgcgctcgtggcacagcagatcgtaatcgacgttattgctgacccggttctgaatctgttcggtgacgacggcgacgatctgcgcgaaggtatgcagccgctggaactctttctcgctccacggccggttgtcacggcggaggaattcgcaaccgccgaagatccgcccgtccgccgccagcggcagcagcgaatagtatccgaacgggcgatagagcccgctgcggataagctgcggccaggtgtcggcaaaggtttcatgatcgcaatgcagggcatccggccgggagagtaagcgacgcaccggaccgtgggccaggacggtttcatcctcgtagcttaccggatggccggcctcatcgcaggcgtacctggccgcgcggtgattacccgcgttccacaggatgatggccgcctcatcggccagcgcggactgttgcaccagacgggtcagggtttcgcttagcgcggccagatcgggctgctgtaataaaagccgggtgatatcgaacagcccctgctggccgagatcgctcatcggtgtatacgacattgcttacgtccaaaacgcgccgacaacgcggcgcataagaaaatgatggtacaaataatagtatgttaataaagcggttattgccgctttaacccatccatgggcgcccgctggtttgggcaaaataattacgctggctttttcccggctcgcgctgcgcttagccgggctacatgtgcgcgcagttctgtagcccggaaaaggcgccagccgctatccgggacccgacgccgtcgttaacaaattctcggcagcggttcggcgtggggaagatcgagcgtccgcttcacgccgtacagcccaacggaacgtacgcccgggcggacgaccacttcgccgattatcgccgcatcgcgtcctaacgcgtgagaccgcaaatgcgccagcacgttttccgcctcgtcgcgggcgacggcgagcaccagcttgccttcattggcgaagttcagggcgtccagaccaagcagctcgcagacgccgcgcaccgtgtcgttgaccggcagcgttgcctcctgcagttcgatgccgcagccgctggcggcggcgaactcatgggcgaccgcgttaaccccgccgcgggtggcgtcgcgcagggctttcactccgctcagcgggcgcagggtctggataagcggcgtcagcaccgcgcagtcgctggacagcgcgccgtccagccccatctgctcgcgcaggttaaggatggtggcgccatgatcccccagcgtgccgctgaccagcagcacatcaccggcgctaatctgctgcgtcccccagtgaacgtccgccgggatggcgccgatgccggcggtgttaataaacagcttatccgccgcgccgcgcggcaccactttagtgtcgccggtgacgatggcgatccctgccgcccgggcggtgtcggccatgctggcgaccaccgcttccagggtggccatctccagcccctcttcgagaataaagccgcaggaaagatagcgcgggatggcgccgctgaccgccacatcgttggcggtaccgcagacggcaagcttgccgatattgccgccgggaaagaacagcgggtcaatcacgtagctgtcggtggagaaggcgaggcggtccccctgggcggcgagcgccgccagatcgaggcgcgcctgatcctcctgctccgccagccaggggttggcgaaggcctgcataaacaggtcgccgatcagctgctgcattgcctgtcccccgctaccgtgggctaactggacgcttttcatacttcattttcctgactgcgatattgataccaggcggcgcaggccccttcagaggagaccattagcgcgccaaaggcgctttgcggattgcaggtgctggcgaagagcgggcactggtgcggtttacagcggccggtcagcacctcgccgcagcgggcgcgcgggtcgtcgcacacgcgctgcggcgccgggcgaaaatgcgcctcggcatcgaagcgctgataggctggcgtaagttgcacgccggagtcgctgatgacccccaggccgcgccattcgctgtcgccatccaggcggaagacgtcggccatcgccgcctgcgccagcgggttgccctcatccggcaccacgcgacggtactgattttccacatcgctgcgctgcgctattgtctgctcaaccagcatcaccgcgccttgcagtagatcaagcggttcgaaaccggcgaccactaaaggacggtgatagtcgctggcgataaagccgtaggcctcggtgccgatcaccatactgacgtggcccggggcgagaaaggcgtcgattccgttctccggctggtccagcaggctgcgcagggtcggcagcagggtgatgtgctggcagaaaaagtagaagttatcgacgttgcgctctcgcgcctgacgcagggtcagggcggtagcgggcatggtggtttcgaaaccaagaccaaaaaagaccacctcgcgctgcggattttgctgcgccagccgcagagcgtccatcggcgagtaaacgatgcggacatcggcgccgcgggctttcgcctgcagaagcgagccgtttttacccggcacgcgcatggcgtcgccgaaggtgcagaagatcactcccgggcggctggcaatctcaatgcaggcgtcgatgcgccccatcggcaggacgcacaccgggcagccgggcccatgaataaattcgatgttctccggcaacagctggtcgagcccgaatttaaaaatggcatgggtatggccgccgcagacctccatgatgcgcagcggtcgcgcggcggtgtgcggcagcagacgagcacgctgctgaagatgggccaccagctgcatcacctgttcgggggcgcggtattcatctacgtaacgcattatcgctcctcgccgtacagcagcgcgccgacgtccggctccacgtcaaacatattttgcagcgcctcgagggtgtcgcgggcttcggcttcattaatgacgctcatggcgaagccgacgtgcaccagcacccactggccgagccgcggctggccctgctcatctacggcgccgaccagcgtcaggtcgacgtcgcgctgaataccgcaaacttccaccttcgccagcacgccgtcgatggcgcaaatttgtcccggaatgcctatgcacatcgctgcgtctccagccaggtgagccactgctccatgccttcgccgctggtggcggagacaagaataatgtcaatatgcggattgacctcgcgggcgcaggccaggcaccgctcaacgtcgaaattgagatacggcagcaggtcgactttgttgagcagcatcaggctggcggcggcgaacatatgcggatacttcagcggtttgtcttcgccttcggtgaccgacagcaccgccaccttatggcgctcgccgagatcaaagctggccgggcagaccaggttgccgacgttttcgataaacagaatgccgcggtcagccagcggcaggcgcggggcggcgtcggcgatcatctgggcgtcgagatggcagcctttcccggtattgacctgaatcgccggggtgccggtggcgcgaatgcgggcggcgtcattgaccgtttgctgatcgccttcaatcaccgcgcagtcggcgcgtcctttcagccgggtgagggtttcggtgagcagggtggttttgccggagccggggctggaaaccagattcagcaccagctgctgttttgctgcgaagcgtgcgcggttgcgtgccgccaggcggttgtttttatccagcacgtcgatctccacttccagcatccgccgctggctctgccccggggcgtgggtacccgcttcgccgtggccgtaatgcaggtcgccctctggcgtgcgggtgggggcgaagtggtcgattttgacaccggtgatggtcatcgtctggcgtggggcgggcgcgaagggggcgctgcggaacgcggaatgcgggtttcgttcgtctccttcaatatagaggttgccttcgccacagccgcatgttgtacacataatttactccaattctaaacgctgaatctgtaagccgtcatccgccacgatctgcagctggtcgttattgcagtgcgggcagcggcgaacgtgctgcgagacaagatggacgtactgctgacagcgatcgcaccagcattcagcctgttgttcggtgatatgcagttcgcacccctccgccagcgtgccgcggcagaccagctcaaagcagaaggtcagggcgctggcttccacgcaggaaaatgcgccgaccttaagccacacgccggtaacccgccgcgcgccggcctgctgcgcctgttgttcaataatttccagcgcccgctggctgagggtgatttcgtgcatagtcgcctccgtatcgcgatgcgccttctatgcaataacgatgccagaatgaaatcgtcgtggcagtcaatgtcgatgtcgacgccccggggctgtcatcgacatgtcgcatcggcagaggtcgataaaaaaaacatagttaaatcaattaaataaaacctagcatgaaaaatgcttagagggtgcatctcatgctacggagaaaccgatatgactatttgggaaataagtgaaaaggcggattacatcgccgaccgtcaccggcagcagcaggagcagtggcacatctactgtaactcgctggttcaggggatcaccttgtcgaaggcccgcctgcatcacgcgatgagctgcgcgccggacaaagagctgtgcttcgtgctgttcggccattttcaggtgttcgtcgccctcgcggaaggcttcaacagccacaccatcgagtactacgtcgaaaacaaaaacgggggtgataagtatctgattgctcaggccaccctcgcaatggatggcacggtggacggccgcatcagcaaccgctcccgcgaccaggtgctggagcactatctggcgattatcgccaccgtctatgaccgtctgtatgacgccatggaacaagaccaaccggtggatttaagccatctggcgctgacccactgatcgtaaggtgtcgacacgtgtcgaaaatgacacctgcgcaaccttatttcgtcaaaaatgactttcacccgaggatgacccggtgaaccgttttgtaattgctgactccactgtctgtatcggctgccgcacctgcgaagccgcctgctctgagacgcatcgccagcacggcctgcaggctatgccgcggctgcaggtgatgcgtaatgaaaaagaatcggcaccgcagatgtgccaccactgtgaagatgctccctgcgccaccgtctgcccggttaacgccatccaacgcgtcgatggcgcggtccagctcaacgagagcctgtgcgtaagctgcaaactgtgcggcattgcctgcccgttcggcgccattgaattttccggcagccgcccgctggatatcccggcgaatgccaatacccggctggcgccccccgcgccgccggcgccggcgcgcgtcagctcgctgctcgactgggtaccgggcgtgcgcgctattgccgtgaaatgcgacctctgccacttcgatgaccagggcccggcctgcgtgcggacctgtccgaccaacgcgctgatgctggtggatagccgtgatatcgcccaggccagcaagcgtaaacgccagctgacctttaataccgaccttggcgacttgtcgctgttccaggcgcaacagggggagagggaatgagtgtaattggattagtgaatcaggcggtggcgtggtatgccgccagcgccgtactggcctttctgtttgccatgcgcaaaccgctcagcggcgccattgccgggatcggcggcgcggtggccagcgccatgctggtggtcaccggcggcgccgcgctgctgatgccggagcggatccacggcggcatgctgcagtttctccacctgacgatacgggtggggggcgtcaacgcgctgtggctgctggccatcggcctgtcggcgctgccggtgtcattgttcaatattagctggcatcgccacccgcaggtgaaggccaacggcccgctggtcaacctgctgctggccgccgcgacctgcgcggtggtggtgaccaatatcggttcactggtggtgatggcggagatcatggcgctctgcgcggcgtttctcaccggctgcgccgcctccggtaagctgtggtttgcgctggggcgtctcggtactttgctgatggcctggacctgctggctggtgtggtcaacctacggcaccctcgagctggcgcagatcaaccttcaggcggcggatatgatgcagaacccgctgctctggctgccgggtctggtggggttcgccctgctggccggggcgatcccgctgcacggctgggcgccgcaggcccacgccggggccagcgcgccggccgccgcgctgttttccacggtagtgatgaaagtcggtctgtacggcatgctgaccgtttcgctggccggcggcgtgccgccgctgtggtggggcgtgatgctgctggcgctggggatgatcaccgcctttatcggcggactgtatgcgctgatggagcataacattcagcgcctgctggcctatcacaccctggagaatatcggcattatcctgctggggctgggcgccttcgtcaccggcgtggcgacccgcaacagcacgctgatggtgctgggctttatcggcggcatgtatcacctgattaaccacagcctgttcaaaaccacgctgttcctcggtgccggagcggtgtggttccgcaccggccatcgcgatatcgagaagctgggcggcatcggtaaaaaaatgccgctgatctccctcgccatgctggtggggctgatggcaatggcggccctgccgccgctgaacggcttcgccggcgaatgggttatctatcaatccttcttcaaaatgagcactggcgacctgtttattggccgtctgctggggccgctactggccgttggcctggcgatcactggcgcactggcggtgatgtgtatggcgaaagtctatggcgtgaccttcctcggcgcgccgcggacgaaagaggcggaaaacgccacctgcgccccctggctgatgaccctgagcgtggtgctggcggcggttttctgcctcgttggcggcatcgccgcgccgtggctgctgccgctggtgagcggcgccttcccggtgcaggctcaggtatcgagcgtggtgtcgcagccgatgatcgcgctgctgcttatcgcctgcccgctgctgccgttcctgctgatgatcttctttaaaggcgatcgcctggcggcgcgctcgcgcggcgcggcgtgggtctgcggttacgaccacgagcagtcgatggtggtaacggcccacggctttgccatgccggtgaaagaggcctttgcgccgttgctgaagctgcgtcactggctgaacccggtgcgtctggtgccgggctggcaatcggcctcggcgccggcgctgctgcgcgggatcgcgctggttgagctggcggtgctggtggtgattgtcatttcgcgaggagcctgagaatgagtctgttaattgcattgctacaggcgctggtgctgtttgccgtcgcgccgctgttgtccgggatcgttcgcgtcgcccgcgcgcggctgcttaaccgccgtggaccgggggtactgcaggagtatcgcgatatcctgaaactgctgggccgccagagcgtcggtcctgacgcctcgggctgggtgtttcgcctgacgccgtacgtcatggtgggcgtgatgctgaccatcgccaccgcgctgccggtggtgacggtagactccccgctgccggtgctgggggatctcatcaccctgatctacctgttcgccatcgcccgtttcttctttgccatttccggtctggacaccggcagcccgtttaccgcgctgggcagcagtcgcgaagcgatgctcggcgtgctggtggagccgatcctgctgttgggcctgtgggtggcggcgcaggtcgccggctcgacccatatcagcgccatcaccgataccctttaccactggccggcggcgcgcagcattccactgattctggcgttatgcgcctgcgccttcgccacctttatcgagatgggcaaactgccgttcgatctggcggaagcggagcaggagctgcaggaagggccgctgtcggaatacagcggcagcggctttggcatcctgaagtggggcatcagcctcaaacagctggtggtgctgcagatgtttgtcggggtcttcttcccgtggggccagatgaccagcttcagcgtcggcggcctgctgctggcgctggtggtcgccatcgttaagctggtggttggggtgctaattatcgcgctgtttgaaaacagcatggcgcgtctgcgtttttgtgccacctcccgcgtcacctgggccgggtttggtttcgcctttttagctttcgtctccttgctggtggcgtgattaagagagtttgagcatgtctgaagaaaaaatcggtcaacactaccttgcggcgctgcaccaggcctttcccggcgtggtgctggacgaagcctggcagaccaaagaccagttaaccatcaccgtgaaggtcaactacctgccggaagtggtggagtttctctactaccagcagggcggctggctgtcggtgctgttcggcaacgatgaacgtaagctcaacggccactacgcggtctattacgtgctgtcgatggagcagggcaccaaatgctggatcaccgtgcgcgtggaagtggacgccaacaaaccggaatacccgtcggtgacgccgcgcgtcccggcggcggtatggggcgagcgcgaagtgcgtgatatgtacggcctggtgccggtcggcctgccggacgaacgccggctggtgctgccggacgactggccggacgaactctatccgctgcgcaaagacagcatggattatcgccagcgtccggcgccgaccaccgacgccgaaacctacgagtttattaacgagctcggcagcaagaaaaacaacgtggtgccgattggcccgctgcacgtcacctctgatgaacctggccacttccgcctgttcgttgacggcgagaacattatcgacgccgactaccgcctgttctacgtccatcgcgggatggaaaagctggcggaaacccgcatgggttataacgaagtgaccttcctgtcggaccgggtgtgcggcatctgcggcttcgcccacagcaccgcttacaccacctcggtggagaacgcgatgggcatcgtggtgccggagcgggcgcagatgatccgcgccattctgctggaggtggaacgcctgcactcgcacctgctgaacctcggtctggcctgccactttaccggctttgactccggctttatgcagttcttccgcgtgcgcgaaacctcgatgaagatggcagagatccttaccggcgcgcgtaaaacctacggcctgaacctgatcggcgggatccgccgcgacctgctgaaagaggacatgatccagacccgtcagctggcgcagcagatgcgtcgcgacgtgcaggagctggtggatatgctgctcagcacgccgaatatggaacagcgtaccgtcggtattggccgtctggacccggaaatcgcccgcgacttcagcaacgtcggcccgatggtgcgcgccagcggccacgcccgcgacacccgcgccgaccacccgtttgtcggttacggcctgctgccgatggaagtccacagcgagcagggctgcgacgtgatatctcgcctcaaggtgcggatcaacgaggtttacaccgcgctgaatatgattgatttcggtctcgataacctgccgggcggcccgctgatggtggaggggttcacctatattccgcaccgcttcgcgctgggcttctccgaggcgccgcgcggcgacgatatccactggagcatgaccggcgacaaccagaaactgtaccgctggcgctgccgggcggcgacttacgccaactggccgaccctgcgctatatgctgcgcggcaacaccgtttccgatgcgccgctgatcatcggcagcctcgacccgtgctactcctgtactgaccgcatgaccgtggtcgatgtacgcaagaagaagagcaaagtggtgccatacaaagagctggagcgctacagcatcgagcgtaaaaactcgccgctgaaataaggaatcgccatgtttacctttattaaaaaagttattaagaccggcaccgcgacgcacgcctacccgctggagccgatgccggtggacaaaaactttcgcggcaagccggagcatacgccacagcagtgtatcggctgcgcggcctgcgtgaacgcctgcccgtcgaacgccctgacggtcgagatcgatctggccactaaccagctggcgtggcagtttaacctcgggcgctgcatcttctgcggtcgctgtgaagaggtctgcccgacggcggcgattaagctgtcgccggagtatgaactggcggtgtggaagaaagaggatttcctccagcagtcgcgcttcgctatctgccactgccgggagtgccagcgtccgttcgcggtgcagaaggagatcgactacgccatcgcgctgctcaagcataacggcgatacccgcgccgagctgcaccgcgaaagcttcgaaacctgcccggaatgcaagcgccagaaatgcctggtgccgtccgatcgtattgaactgacccgccatatgagggaggccagctgatgagtactttacttggcccgcgcgatgaaaacggcattcccgtgccgatgacggtggatgaatccatcgccagcatgaaggcctcgctactgaagaagattaaacgttcggcctacgtctaccgcgtcgactgtggcggctgcaacggctgcgaaatcgaaattttcgccaccctttcgccgctgttcgacgctgaacgcttcgggattaaggtggtgccttcgccgcgccatgccgatattctgttgtttaccggggcagtgactcgcgcgatgcgctccccggcgctgcgcgcctggcagtcggcgccggatccgaagatctgtatctcctacggcgcctgcggcaacagcggcggcatcttccacgacctgtactgcgtctggggcggtaccgataaaatcgtaccggtcgacgtctatattccgggctgcccgccgacgccagccgccacgctgtacggcttcgccatggcgcttggcctgctggagcagaaaattcatgcccgtctgccgggtgagctcgacgaacagccgaccgagctgctgcatgccgatatggtgcagactctgcgggtgcgcatcgatcgcgaagcgcggcgtctggcgggctaccgctatggacggcagattgccgatgactatatgcgtctgcttggccagggcgacagccaggtgctgcgctggctggaggcggagaaagatccgcgtctgaccgagatcgtcacccatctcaaccaggtggtcgagggggcgcgtatccgatgagcgagacggtggtgttcagtcagctgagccgtaaatttattgatgagaacgacgccacgccggatcaggcgcagcaggtggtctattacagcctggcgattggccaccacctcggcgtcatcgactgtctggaggcggcgctgagctgcccgtgggacgcgtatctggcatggatcgccacccttgaggccggaagcgccgcgcggcgcaaaatggagggcgtgccgaagtatggcgaaatcgtcatcgacagcagtcatgtggcgatgctggccaacgcctttgataaagcgcagtccgcgcagaccccgcagcagcaggcgtggagcaaaaccctgctcagcatgctgcatgatattcaccaggagagcgccatctacctgatggtgaggagattacgtgactgacgttttactctgtgtcggcaacagcatgatgggcgacgacggcgccggcccgctgctggcggagatgtgcgcggctaacccggccggccagtgggtggtcatcgacggcggcagcgcgccggaaaacgacatcgtggcgatccgcgaattacgccccgaacgcctgctgattgtcgatgccaccgatatgggcctaaaccccggcgacattcgcatcatcgatcccgacgacatcgccgagatgtttatgatgaccacccataacatgccgctcaactatctggtcgatcagctgaaagaagacgtcggcgaggtgattttcctcggcattcagccggatatcgtcggtttttattatccgatgacccagccggtgaaagaggccgttgcccgggtgtatcagcagctggcaggctggcagggccagggcggctttactcagctggaggccgcggacgactagccctgcggcgaaccgggctctccgccggcgcacgactggccggaagggagccccgttcccggcgctgccagttcaagattctctatcactaatttaccgggcgacaccgagactctgacctgcgtgccgaccggaaaccccgcctgctccagccagtcgccgtttaagcttaatgccgcgtggcgggtgtagcgccgcgtctcccgcgttttgcggtcctcatggcgttttctgacatatcccacggttaactggcgaatggccctggctatccctctggctgcggtagggtgctgtgcgctcatgatgtgctccttgctgaagataccccggtaaaagtactggataaaataccagttattgtaaacaggtggcaaaccagaagctggaatcaggctcgagaaaaaagcatgtaatggatgcaacagatagccgacgcccgtcccccggttagcgcggggaacgggcgcgcgtgggcgagggtgcttagtcgagatcggcgccgttactggctatcaccttctggtaccagaagaatgactttttacgcttacgcgccagggtgccgttgccggcatcgtcgcgatcgacatagacaaagccgtagcgcttgctcatctcgccggtggacgccgagaccagatcgatgcagccccagctggtgtagcccagcaccggaatgccgtcgccgatagcgtcacgcattgccctgatgtgctcgcgcaggtagctgatgcgatagtcgtcattgatgtccccattggcatcgatctcatcgcgggcgccaagcccgttttccaccaggaacagcggtttctgatagcggtcgtacatcaagttcatggtgatgcgcaggcccagcgggtcgatgccccagccccattcgctggccggaatgtgcgggttcttcagcgacttgacgatgttggcggcattggtgttgctggcgttcatctccgccgaggcgcagcgcgacgcgtagtagctaaaggagacgaaatcgacggtgtttttgaggatctcgtcatcgcccggctgtttcgcaatcgtgacccctttttcccggaacacccgcgcggcccacaccggataggcgccgcgggcctggacatcgataaagaacaggttttcgcggtccttctccagcgccatccatacatcttccggcttgcaggagtaagggtagaaattaccgccggccagcatacagccgacctgattttgcgggttaatctcatgggcgattttcgtcgccagcgcgctggccaccagctcgtgatgcgcggcctgatacttcacctgctcctgattttctccctcctcaaacaccagaccggcgccggagtaggggctgtgcagcatgatgttgatttcattgaaggtgagccagtatttcaccaggccgtcaaaagcttcaaagcaggtgcgggcgtagtggctgaaaaaatccaccattttgcggttgcgccaggagccgtactccatcaccagatgcatcggcacgtcgaaatgacacagggtgaccagcggctcgataccgtgctttttgcactcctcgaacagtgagcgatagaaggcgatgccctgcggattcggctgctgttcgtcgccgcgtgggaacaggcggctccaggcgatggaggtgcgaaagacgctgaaccccatctcggccatcagggcgatatcttctttatagcgatggtaaaaatcgatcgcctggtggctggggtaaaattcgtcttcacgcagcgtaaagcgcttctccaggcctaattttaccggcaggcgatgcgcgccgtggggaagggtatccacggtggtcagccccttaccgccttcaagataagcgccttcagactggttggcggccagtgcgccgccccataaaaatccctgtgggaaactctccatgcattacctcattatcaatagtgtattcaggcgtgggatgcctgggcccgggcctggcgcgctctggcgtcggcagcggcctgctcaacgggaatgtcctcaaagccaaggatcagcgtcagggcaaacgacagcaccaccgacagcgccatcacgccaaacacccagacgatggtcattggattggccggatcgaaaaactgcacgctggtaaacagccccggcgccgccatcgaatggctggccagtccggcaatacctgccaccgcgccgcagataaagccgctgattaagctggcgatcagcgggcgcttcaggcgcaccgccacgccatacagcgccggttcggaaatcccggccagaatcgccgatgccgcggcggccagcgccgtctggcgcagctccgggtttttggttttccacgctaccgccagcgaagagccgccgagcgacaggttggcgccgatctccgatggcatcaccataccctctttgccggtttcggcgatggtctgaatgatggtcggcgtaaagacgcggtgcataccggtcatcaccaacagcggccacagcccgcccatgatcgccaccgacagccagccgagatagctgtggatcgtatacaccagcgcggaaatggcgctgccgatccagatgcccagcgggccaatcagcaggatcgccagcggggcggcgatcagcacgatcagcatcggcttcagaaagtttttcgtcaccgccggggtaatgcgatccacccagcgctcgatatacgacaggcaccaggtcatcaccagcgccgggatcaccgtgtaggtgtatttcaccgcggtaaccggaataaaggcgaattcaacgtgttctccctgggcggctttggccatcaattcgataaacccaggatgcaccagcaccccggcgatggcgatagccagcgacatattagttttgaatttcaccgccgcggaggcggccaccatcagcggcaggaagaaaaatgcgccgtcgccgataagcgccagcagggtcagcgtcggcgagcctttcggcaacgcgccgctcatctcgaggatcatcgccagcagcttgaccatcgatccgccgataatcgccgggatcagcggtgacatggtgccgatcagcgcgtcgaggatcccggcgccgatgcgtttcagggtcagcggcgctttgccctgcggctcagccgggcgcaggtcgccaggcagcagattcaccacctcgcggtaggcctgggagacagtgttgccgatgatcacctggcactggttatcgctgcgcacgacgccgagcaccccggccaggcctttcagggtagagctatcgacctgttcgtcgtctttaaccacgaagcgcagacgggtcatgcagtgggtaacggcggcgacgttgtcgaccccgccgattgccgcgactatctgttgcgccagggctgcataatttttcgacatcggattttatcctgtttatcaatagggtactaatctgccaccgccccgcatcgccgggcgataccatgtttttataggaaaccggttccacaaaatcatggtgagtttcatttaattgcacaagaaataaaaaaatatgatctcaattttgtgattttgatcgctaagcgtcgccgtgagccggatcgcggtggtgaacaggggagtgctgtaaaagcgggaaacgtgcagtacactgcctgcaacttttgcaacaggaagaatcacatggcaacgatgctggaggtcgcaaagcgcgcgggggtatcgaaggcgaccgtttcgcgggtgctgtcgggcaacggctatgtcagccaggagaccaaagaccgggtgtttaaggcggtggcggagagcggctaccggccaaatctgctggcgcgcaacctggcgaccaaaaccacgcaaaccctcggcctggtggtgaccaataccctgtaccacggcgtctattttagcgaactgctgtatcacgtggcgcggatgacggaggataaagggcggcagctgatcctggccgacggcaagcacagcgcgcaagaggagcgggaggcgatccagtacctgctggatctgcgctgcgatgcgatcatcatctacccgcgctttctcaccgttgatgagatggacgagatcgttgagaaccactcgcagccgatcatggtgcttaatcgccgcctgcgccgccacgccagccactgcgtctggtccgatcaaaaagcctcggcgatgcgggtagtggagcggctgattgcgcttggccatcgcgatatcgcctttattaccggctcccttgactctcccaccggcgtcgaacgcctcgccggctacaaagacgcgctggctggccacggcatcgccctgaacgaggcgcttatcgccgaagggcgctggacgccggaaaccggggcggcgggggtggagagcctgcgtcagcgcggggttacctacagcgcgctggtggcgagcaatgacgatatggccatcggggcgatgaagcagcttcaccagctgggcgttaaggtgccagaacaggtctcggtggtggggtttgacgatattgctcttgcgccgtatatggtgccgtcgctcgccagcgtccgggtgccggtgacggagatgattaaagagagcatcaatcggctgatctttatgctggatggcggggaattcaactttcagcaaagctttcccggagcgctgattgaacgcgagtcgctggtggcgggcccctgtgcctgacgtcgtcagctgtcatcgtcactactgacgatgacagcaaagcccagctataatagtctttataatcaatatattaaaaacttggaacgtattatgcatactccggcgcgtaaccttcttactgctggagaaatggatgaaccgtttcattatcgccgatgcgagcaaatgtatcggctgtcgcacttgcgaagtggcctgcgtggtatcccatcaggaacatcaggactgcgcctccctgacgcctcacacctttcagccgcgtattcacgtgatcaaaggggtcaatgtttccacggcgaccgcctgccgtcagtgtgaagacgccccctgcgccaatgtctgcccgaacggcgccatcagccgcgataaaggctttgtccatgtgatgcaggagcgttgcatcggctgcaaaacctgcgtcgtcgcctgcccgtacggggcgatggaggtggtggtgcgcccggtgatccgccatagcggcgccggactgaacgtcgtggcggaaaaagccgaagccaacaagtgcgatctctgcttccaccgcgagagcggcccggcctgcatggaagtctgcccgacgcatgccctggtgtgcgttgaccgcaacaaacttgagcagatgaatatcgagaaacgtcgccgtacggcgctggcctggtaacaccgggtatgaacggggtgcaaatccgcattcgcggcaaagtgcagggggtcggtttccgcccctttgtctggcagctggcccgggcgcaggcccgctgcggcgatgtctgtaacgacggcgacggcgtactggtgcggctggtcgggggcgacgacggttttactgccgctctggctgaccactgcccgccgctggcgcggatcgacagtaccgactgcaccccctatcgctgggcggctctgccgcaggatttcaccattcgcgagagcgggacgggacggatgcgcactcagatcgtgcccgatgccgcgacctgcccggcgtgcctcgcggagatgaacgatccccgggcgcgccgctaccgctacccctttatcaactgcacccactgcgggccgcggctgaccattattcgcgccatgccctacgaccggcccttcaccgcaatggcgccgttcccgctctgttccccttgtgaggcggaattccgcgatcctgccgatcgccgttttcacgcccagccggtggcctgtcccgactgcgggccgcgactggaatggcgggcagagggggaaacgctggacggcgaggcggcgctgcaggcggctatcgcccggctggcggcgggcgacattgtggcgataaaaggcatcggcggctttcatctggcctgcgacgccggtaattccgcagccgttgccacgctgcgggcgcgaaaacaccgtccggcgaaaccgctggcggtgatgttgccgtcagcggcgggcttacccgccgacgccgcggcgctgatgggctccccggcggcgcccatcgtgctgattgctgaagcgcaggtctccggcctgtgcgacgagattgcgccagggcttgcggaagttggggtgatgctgccgtctaatccgctgcagcatttgcttctgcagggcctggcgcgccccatcgtaatgacctccggcaaccttagcggccgtccgccgacgttaagtaatgctcaggcgctcaatgagttagccgacattgccgacggctttctcttgcataatcgcgacatcgtacagcggatggatgattcactggtgcgctcaagcggtgaaatgctgcgccgcgcccggggctacgtcccggacgcgctgccgctgccgccggggctaggagacatcccgccgctgctggctctcggcgcggatatgaaaaataccttctgcctggcgcgcggcagcgaagcggtgctgagccagcactttggcgatcttggcgaggaaggtgttgaacagcagtggcgcagcgccctgcagctgatgcagagcatttacgcgtttgtgccgcagcgggtggtggttgatgcccatcccggctatcgctcaacgcagtgggcggcctccctgcccttgccgctggagacagtgctgcatcaccatgcccacgccgcggcatgcctggcggagcaccgctggccgcttgacggcggggacgttatcgccctgacactcgacggtattggtatgggggagaacggcgcgctgtggggcggggagtgcctgcgggtcaactatcgcgaatgcgaacatcttggcgggctgccggccgtcgcgctgccagggggggacctggcggcacgccagccgtggcgaaatttgctggcccactgtttggcctttgtccctgactggcaggattatccgcaggccgcccccctgcgccagcgcaactggccgctgctggcgcaggccatcgatcgtggcattaacgcgccgcgcgcctcatcctgcggacggctgtttgatgccgttgcctgcgccctggattgcgcgccggagagtctgagctatgaaggcgaagcggcctgtcggctggaggcgctggccgccagctgccccggcgtcagccacccggttacgctgccgtggtgcgacgacgcgctggatttagcgaccttctggcggcaatggctgagctggcaggcgactccggcgcagaaagcctgggcattccacgacgccctggcctgtggactggcggcgatggcccgcgactgcgccaccgtccgcggcatcgacacgatggtctgcagcggcggggtgctgcataaccgcctgctggcggcgcgattgaccttttatctggcggattttactctgctgtttgcacagcagttgccggccggcgacggcgcaatcgcctatggtcaggcggtgatcgccgccgcccgcgggcaggctcaaggaatacaaccatgataatgacagttttacgccagcagccgcgcgccgcgggtctggtgctggggttgatcgcggcgaatttactggcctggtgctgggcgctgcaggcctttggcgacagcggcgcgctgatggccgccagcctgctggcctggggctacggcctgcgccacgcggtggacgccgaccatattgcggcgattgataacgtgacccgcaagatgatgcagcaggggcggcggcctttcgccgtcggggcttggttttcgctgggccactcatcgattgtggtgctggcctcggcggcgattgccgcgaccgccaccgccttcagcacgcagatgagctggctgcatgataccggcagcgtcattggcaccgccgtgtcggccctgtttttactggcgatggcctttatcaacctggtgattttacgcagcgtgtggcgcagctttcgggcatggaagcgcggggagccggtgagcgacgaaatcgtcagcggcggcggggtgatgagctggctgtttggcaagaccttccgtctgataagccgcagctggcagatgtacctggtcggtttcctgtttggcctcggttttgataccgccaccgaaatcggcgtactgggtatctccgccgccggcgcgtcgagcgggatttccgtctggtcgattatggtctttccggcgctgttcgccagcggtatggcgctggtggatacgcttgataatgtgctgatggtcggcgcctacggctgggcgttcagcaagccgcagcgcaagctctattacaacatgaccatcaccggtacctcggtggtggtagcgctgtttatcggcggcctggaagcgctgggtctgctgatggataagtttgcgctcagcggcggaatatggcgctgggtaggggcgttaaacgacaacctcggcgacgccggatttgtggtggtcgggttgtttgtcgcctgttgggcgctatcggtgcttaactatcgctggcgcggctacgacaatctggcgcgctaggctggatatgttcccggcttgcgctgcgcttagccgggctaccaggacaataccgtagcccggctaaggtgtttacgccgcaagccgggaaaaccatcaacttaccagttgtttgagcagcgcaaaggcttccttcattttgtcttcactcaccacaaaggcgcgcagctggttttcggcatccacgcctttcgccaccagcccctctttggcggccacgatattccacgtcagatcgtcgcggcgggtgtcgccggccagatgcagcggcagatccggggttttcaccttcaccagcattggcggcagcttgagttctcccgcctgcgccagcagatttttactcaggcacatggcgctgagtaaaatcggctgcaggaacggcagtaccacgccgttgatttccgcacagtcgccgagcgcataaatcgccgggtcgctggtttgcagctggctattgaccacaataccgcggttaatctgcagtccggcgtggcgcgccagcgacgtttccgggcgcaggccggcggcggccaccaccgcatcgacggttatcgcgcgctggcgatcgagactgacgcgaatgccgtcggcggtttgctccagcccctccagctgcgttttcagcatcagatgtacgcccatctcggtgagccgatgctgcaggcggctgctggcctccggcggcatcagcgccgccagcacgctggcggagttatcgactaccgttaccgctttaccggcgcggcagaaatccatcgccagttcgcagccaatcaggccgccgccgacgatcagcacgcgcttcgcgtcgtgcagccggctctgcgccgcgccatattcgcgctggctattgagcgttagcatcagctcgcgccccggcaccggcggaataaacggcgtcgcgccggtggccagtaccagtttgtcgtagcgccactggttatcctggctcttcactaaccggttttcggcgtcgatatcgcttacccaggtatggggaaacagacgcagagtgtactgctcggcgaactcgccggcgctttgcagggtcagatcgtcggccttctgtccgcggctgatgacatggctgaggtccggtttgttgtattcatccatgctatcggcggcgatgagggtcagcgggatttgcgcatcctgcttacgaatatttttcaccagctggcgggccgcgaagcccgagccgatgatgacgatgccatcactcattttgcctccgtcgccagtacgtcaaagacatctttgccaagagaacactcagggcagaggaaattgtccggcacttcactccacggtgtacccggctgtacatcctggttaggttcgcctttcgccgggtcatagacccactggcacacgctgcactgcatcatgggaccgagatcggcggccgcggcggcggcacaggcgcagtcctgtggttccggcgttgtcgctgcttcagcaaccggcagcggcgagagggcccactggcgggcgatgtcgcgaccgtgttggcggcacagctccagcgcgtcgatatccgggcgccatttggctttcaggctcagcgacatctcaaagccggcatcctgcaggcgggtggacaggcggtctaccgcgccgccgctccagccgtgcgagccaaaggcgctggcgcgtttattgcgaaaacgcagcccggtcatctcttccaccagcccggcgattttcggcatcatcacgttgttcatggtggacgtgccgacaagtacgcctttcgagcggaaaacattggtgaggatgtcgtttttgtcgctgcgggcgacgttaaagattttcaccgctacccgtgggtcaacctcggtgatcccctgggcaatggcgtccgccatcatgcgggtattattggacatggtgtcgtagaagatggtgatgcgatcttcctgataatccgccgcccactcgaggtatttctcgacgatttgcgtcgggttatcgcgccagaccacgccgtgggaggtggcaatcatctccaccggcaggttgaaaccgaggatttcagtaattttcggcgtcaccaggcggctgaagggcgtcaggatgttggcgtagtagcgctggcactgttcgtacagttcagtctggtccacttcatcgttgaacagatgttcgtcgcaatagtgctggccgaaggcgtcgttgctgaacagcaccgcgtcgccggtcaggtaggtcatcatgctgtccggccagtgcagcatcggcgtttccacgaagatcagctgtttaccgttaccgatgtcgagagtatcgccggttttcaccacgtggaagttccactccggatgatgatggtggccgttgatcgagtcgatggcgttggcggtgcagtagatcggcgtatcggggatctgcatcatcagttcggtcagcgcgccggcatggtcctcttcggcgtggttaatgacgatatagtcgaggtcggcgaggtcgatttcgcggcgcaggttctgtacgaactcgcggctgaatttatgatcgacggtatcgatcagcacgtttttctcttcgcggatgagatagctgttgtagctgctgccgcgcagcgttttatattcggtgccgtggaaatcacgcacttcccagtcacgttggccaacccaaagaatgttatttttcaccacaatagacatagcaacctcaatcaatacagtgtgtttaaactcagttgactggcttatatcaagttgcgtgccaactttttaattcattgataattatctatttttaattttttctgattttggttgttgtcaaaatgacaatggttaaaatagtcgatatgataatgcgtattgtcaaaatgacaatggagcggcaatgagtttttccgtcgacgagctggcgagaatcgccatagatttacaaagcgatattggtcacaccgaccgcttttcgcgcctgattactaccctgcggcaaattcttggctgcgatgcctcggcgctgctgcgctatgaggcgcatcagtttgtgccgctggcgatcgatggcctggcgcaggatgtgctcggtcggcgctttgccctggaaggacacccgcggctggaggcgattgcgcgcgccggcgatgtggtgcgcttcccggcggatagcgacctgcccgacccctatgacgggctgatccccggtcatgagagcctcaaagtccatgcctgcgtgggactgccgctgtttgccgggcagacgctgattggcgcgctgaccctggacggcatggatgccgatcgtttcgatagcttcagcgatgaagagctgcggctgattgccgcgctggtggccggggcgctgaataatgcgctgcttatcgcccgccttgaagcgcaaaacgtcctgccggcgcaggcggtgaattacccgctgccggagcgccaggagatcatcggcctgtcggggcccatgctgcagctgaaaaaagagatcgatatcgtcgccgcctcggatttaaacgtgctgatcagcggcgaaaccggcaccggcaaagagctggtggcgaaggcggtgcatcaggggtcgccgcgagccgccaaccctctggtgtacctcaactgcgcggcgctgccggaaagcgtagcggagagcgagctgttcggccatgtgaaaggggcatttaccggggctatcagcaaccgcagcggtaaatttgagatggcggataacggcaccctgtttcttgacgaaatcggcgaactgtcgctggcgctgcaggccaaactgctgcgcgtgctgcagtatggcgatattcagcgcgtcggcgatgaccgcagcctgcgggtcgatgtgcgggtgctggcggcgacgaaccgcgatctgcgccaggaggtggtggaagggcgctttcgcgccgatctgtaccatcggctgagcgtcttcccgctgtcggttccgccgctacgcgagcgggaaagtgacgtggtgctgctggcgggctatttctgcgagcagtgccgcctgcggatggggctggcgcgggtcattttggctgaggcggcgcgaaaccggctgcagcagtggtcctggccgggcaacgtgcgcgaactggagcatgctatccatcgggcggtggtgctggcgcgggccacccaggccggtgatgaagtggtcctggagccgcagcatttccagtttgcggtggcggcgccgatgttgccgactgagacggcggcagcggcgcccgcgacgggaaacatcaatctgcgcgaggcgaccgactcttttcagcgagaagccattagccgcgcgctggaggcgaaccagggcaactgggcggcgaccgcccgagcgctggaactggacgtcgccaacctgcatcggctggcgaaacgtctggggcttaaaggatccccgcctggtaaaagttctgcaggttaatggcgccgaccagttggccgttctcatccactaccggcgcggcgctgattttgtgtttcatcagccgctctttggcttccaccgcgcggctatccgcctgcagcgttacgccgttgcgggtcatcgcccgagtgacgccatcgttgagcgtaccgccagcaaccagccagcggcgcaggtcgccgtcggtgaaaacgccctgcacgcggttggcttcatcgcagaccgccaccaggccgagtccggttcggcttagttcgagcatggcgtccatgacgttagcctcggtattgacccgcggcacttcttcatcacgacgcatcaggtgatgcactttgttcagcagccgcgcgccgagggcgcccgccgggtgggaacgggcgaaatcctcttcattgaaaccgcgcgcctgcatcaccgccatcgccaacgcgtcgcccagcatcagcgtgttgacggtgctggaggttggcgccagatgcatcgggcaggcctcgcgctccacggcgatatccagcaccgctttcgccgccagcgccagcggcgaggtggatttgccggtcatcgccagcagcggaatgcctttttcttccagccgcggcacgatgagatccagctctttcgcgctaccggagtaggagataaacagcatcacgtcgcggctatcgagcatgccgagatcgccgtgcagggcttccgccggatggacgaaaaaggccggggtgccggtgctggcgaaggttgccgccagctttttaccgatgtggccggatttaccgataccggagacaatcagtttgccctcgcagtggataatggtttccgccgcgcggatgaagtcgtcgcccaggcgctccggcaggcggctcgcctcctgcagctcaagcatcagggtctggcgtccggcctctaacaaaaagttactcatgatgttctccagtaataatgacttcaatgcctttggcttccagcgcccgctggaattccgggtcaatatcggcatcggtaatcaatttatccacgcgttcaaggccgcagacaatattgggacttttacgaccaaacttggatgagtcggccatcaggatcacttcgcgggcggcgttgcacatcgctttgctgacggtatagacctcattaaaggtagtgactccggcgttcagatcgataccgtcggtgcccataaacagcttgtcgaagctgaactgttcgaaggcgttttccgccagctggccgtgaaaagaggccgattttttacggaaggtgccgcccggcatcaggatggtctgctcgttatcgaactctgatagcgcgttgacgatatgcaggctgttggtcatcaccgtgatgttattaaagtgactcagcaatggcaccatctgcagcacggtgctgccggcgtcgaggataattgaatcgccatcgtggatgtatcgcacggcggcctcggcaatctgggcttttttatgggtgttgatcagcgtcttatggtcaatcggcggatcggcttcatccttgttgagtaccacgccaccgtaggtgcgaatgacggtgccggcgttttccagcgtgaccagatccttgcggatggtggtgccagtggtatcgaagtgttgcgccagctcttcgaccgagcattttccctgcgactgcaggaactcgagaatggctgcctggcgctgacgtggtttcataggcgtctatcctgcgtttaagtttcgaagtgataatttcgcaagatatttacttttacaacgaaattatccatgtttcggattaagcgctaatgatagtgcattctgacagcgcggatcatggggaaagatcacatcaggctgcaattccgcaatatgtttgcctgccagagccgggatcttttgcggactggcgaaaatggtgaagcctttcatcagcagcgtgtcgctaatgcggtcgttatcatcgacggcgatggcgacgatggcgcgcggttgaaagcgcccggcggagcggccgacgcccacccgcccctgctggcacaggctatcaaaggcgcgattgaagcggcggatctgccagccgccaaaggccagctgggtaagccaggcgatggcggcgacgatgattaatgcagtaaccataggtctctccttaaggggggcgggaacagcccaggtcacggcgcgagcgcctaacccgagcgacccgcggtgccgttttttgtcgggtggcggctaacgccttacccgacctacagttttgtagcccggataagcgcagcgccatccgggaacctgttaaaacatcacctggccgccggtgacgttgatcgactgcccggtgcagtacgacgcctgtgggctagcgtaaaacatcaatacgttcagcacatcctgatattcgcagccgcgcttcagcggcaccttgtcgatgtagtactgctcgacttcgctctcatcgataccgagcttggtggcatactgcggcagcagcgactggaacatcggcgacttcagcagattgccgagcatcagcgaatgcacggtaatgccatattccgccagatccagcgccagcgactgggtcagcccgacgccgccgaacttcgccgcgctgtagccggagttgtgcttactgccgactttgccggatttcgagttgatctgaatgatccgccccttaatgccgtcgcggatcatcaaccgcgagaactcgcgggcgcagagaaaatagcccaccagattgacctgcagcgagcggtcgaaatcccccagcgcgaagtcgctaataaacgccgccttggcgatcccggcgctgtacaccagcaggtcgacgcgcgaaaaaatctcatccaccccgtgggccagggcggtgacgctggcctcgctggtggcgtcggcgccgaagccgtacgccataccttcgccatactcagcgttaatctcctgggcgacgcggctggctttttcgctctgaatatcgaccaccgccacgcggtagccctcggcggccagcccgcggcacagaaactctcctaaggtttgtccaccgccaatgacaacagcaacctgattcatctctctctccttttaagcaacaaacttcagtacgcagccgggcgcgatggcgtccggcaccgggcccgccacatggacggtacctgggaactccgcttcacgatggccgtcaaagcgcagggtgatgtggcccagctcgcgcaggttttgttcagcgacctcgccgacggcggtcaccgggtagcgctgttcgccaagctgcagctctgcccccggctgcagcgtgccagcaagctcgccgtggttgtgaataaagcagtactcttcgatatccgccggggcgccctcgcggaaggtgatcagcatttgctcttccagcgccatcgtcgcgcaggcgccgatgtgcgtaatggtggtctggtaaatcacagtcatctgcaggaacctcttactggtaaataaatccggaaacgaaccacgcgatcagcaccgttggtgcgccggtcagaaagcggctgaccagcaccgacggcacgccgacgcgcacggtatcctggcgggcttcggctagcgacaggcctaccggaataaaatcgcaggcggcctgggcgttaatggcgaatagggcgggcagggcgaggtgcggcggaatgttgccgaggccgatttgaacgccgatcagcacgccgatcacctgggcaataaccgcgccggggccgagaaacggcgacagcagcgggaaagagcaaatcagcgccagggttaccagccccagcggatggctggcgagcggcgccaggccgtgggcgatccagtcgccgatgccggaggccatgatgatgccgatcagcgccgagacgaaagccataaacggcagaatggttttcagcaccgtatcaatggtgtcgcgcccggcctggaacagcaccgccaccaccgaacccatgcccatcccgaccttcgccagcaggccatcgctctgttcagtaatcttcttgctggtgtcgtaatcgcgacccgcgctcttgttttccgccggcggctcggaaacccctgcgctgtcgggagggatgcactggatgttgtcctctttgacgccggagacataaatatcttccgtgatgtactgggccagcggccctgatttgccggtggcatgaatattcaccgtcgggatgcggcgcttaggatagagcccgcagcgcagggtgcccccgcagtcgataattgccacgccgatgtcgctttccgctggttccccctctttaaacccgtccaccggctgccagccggtcaggctggcgatgcggtcaacgatcgccgggcgggtgccggcggtgatatagacgatctttttgccttcgacggcgtcgagctcaagcgggccgccccagccgccggtgcctttctctatacgaatacgggtcatgatgtcgctcctgacagatgcactttccgggaaagctgaatcgccatttttctctcgaaaatcgaggtggtcaggtcggtgacccagccgcggaagaagttagtcaccagcccgaccagcaggtagctcaccgccagcggaccgagcggtaggccgagggtagtgaggccgttggcgatgccgagatagacgaacagctcgccggggttgatatgtggaaacagcccgttcattgagtggcagctatacgacgccgccgcgtaatagctgggcttgtacttctctggcataaaccggccgaggcttaacgtcattgggttacaaaacacgaaggtgccgatgcagggtagcagcaggtagcgggagattgggtttcctgcgcagcgctgcgccagcttctcgatccgctgctggccgataaagttgatcagcgcgttcatgatcaccagcaggctgatcagcaaggggaggatcccggtcaccatgccggtaaatacctcgccgcctttctgaaacaggccgataaaccactccgcgccgtgggtcacgacgtcaatcattgttctctccttcagcatgttatttttcttgctaatcgcaggctgattttaatcattttgaaaggtttaaaagtgttagatggatcgcaaaatgaaagataaatattttattttgaaagatgatgcgggcgagatgaaatgttgcagggcatgaaagcacgcacgggaggagccgttgaaggactattttgtctacaaacagattgtcgctttcttgttggtcgtcgcatgctttaccataattatcccttgctgaatttgttaaacggaattcccatgttgaagcgtcgctatctggctttacttcccctttgtgtgctcctcgctgcctgcagcagcaaacccaagacccccgcggaaacggagatggcgagtggaaccggcggctttttgctggaaccgcagcataacgtgatgcagatgggcggcgacttcgccaacaacccggcggcggcgcagtttatcgataagatggtggcgaagcacggcttcgacaggcagcagctgcaggagatcctgtcgcaggcaaagcgcctggattacgtcctgcggctgatggatcgtcaggcgccgaccggcctgccgccaaccgggccgaccggcgcctggctgcgctacaagaaacagttcattaccccggataatgtgcagaacggcgtggtgttctggaatcagtatcaggacgcgctcaaccgcgcttatcaggtttacggcgtgccgccggaaatcatcgtcggcattatcggcgtggagactcgctggggccgggtgatgggcaaaacccggatcctcgacgcgctggcgacgctgtcgtttagctacccgcgccgcgccgaatacttctcgtcggagctggaaactttcctgctaatggcgcgcagcgaaagcgacgacccgctggatctgaaaggctctttcgccggggcgatgggctacggtcagtttatgccgtcctcctataagcagtatgcggtcgattttaacggtgacggacatatcaacctgtgggacccggtggatgctatcggcagcgtggccaactacttcaaacagcatggctgggtgagcggcgatctggtggcggtgcaggcgctggggcaggccccggggctggagaatggtttcaagactaaatacagcgtttcgcagctggcggccgcagggctgaccccgacccagccgctgggtaaccatcagcaggccagcctgctgcggctggacgtcggcaccggctatgagtactggtacgggctgccgaacttctacaccatcacccgctacaaccacagcacccactacgcgatggccgtctggcagctgggcctggcggttgcgcaggcccgcggcggttattaatcctttcatccggctgacaatttcccagcctccccggatagcggcgcgtagcgccttatccgggctacggtctggtatccggttgctagccccggtaagcgcagcgcgaccgggggagagttcaatgacagcttgtcgcccatcggcaacactgcggctacgttacgcgccgtcatccgcacgttggcggcggagttcgccagcgctttatccgggttacggtctggtatccggttgctagccacggtaagcgcagcgcgaccgggggatgacgccggggaggccgcgcttatccccccgttttttcccgtctccatgcctcttgttgacctttgttacatttccgctgactgacgctgatttacattctttcttcgcttcgttattgttatgttataacattaaattgaggcaggggtatgttcacatcgatttttatggcatccggcgcggcgcgcgcggctatcgcaggcgtgctgctggcggcgctatggttagcaacctggtgggcggtgacgctgccatgattgaactggagcagctggtcgccggctatgacggggtagcgatcacccctccgctgagcgggatgatatgccccggcagcctgacggcaattgttggcctcaatggctgcggaaaatcaacgctgctgaaaaccctcgccgggtttcttcctccggtcagtggccgcctgtgctggcagggaaaacggccggtgatcggctggctggcgcagcgccatgccctcgagtcgcagtttcctctcaacgtgcaggatgtggtaagccagggcgcatggcccggcgtgtcgctgctgcgcggtctggggggcggcacccggcgacgcatcggcgcggtgctggagcgggtcgggctggcgggcctggcgaaaacgccgatcgaagcgctctccggcggccagtttcagcgcatgctatttgcccgggtgatggtgcagcaggcgccgctggtgatgctcgacgagcccttcaccggtatcgacgaagcgaccagtcgcgaactaatggatttgatcctcgagatgcaccggcagggacagaccatcctggcggtgctgcatgataaccagcgggtggccgactttttccccgagacgctgctgctgactccccagcgcgcctgctggggcgctacccgggcggtgctcccggccttcagtcatgtgaggtcggcatgatctggcacaccttctttcagcctttcattgaattcggctttatgcgtcgggccctcgtggtgtgtctggcgctgtcgctgagcaccaccatgctgggcgtcttcctgctgctgcggcgcatgagcctgatgggcgatgcgctgtcgcacgccattctccccggcgtggcggtggggtatctgctgagcggcatgtcgctgctggccatgaccctcggcggcttcatcgccggcatcgtggttgccctggtggccgggtgggtgagccggcggacaccgttaaaagaggacgccagttttgccggattttatctgggctcgctggccctgggcgtcaccctggtgtcgctgcgcggctccagcgtggacctcctgcatctgctgtttggctccattctggcggtcgaccgcgatgcggcgctgtttgtcagcggcgtcgccagcctgacgctattgtgcattgcgctgtgctaccgcggtctggtcagcgaggcgttcgacagcgcctggctgcaggtgaatcaccggcggctgcctgcgctgctgcatgggctttttctggcgctgctggtgcttaatctggtggccgggtttcaggtgctcggcacgctgatggcggtaggggtaatgatgctcccggcggtcgccgcgcgctgctgggcgcgcacgctgccgggcattctgctactggcggcgggaatgggcgcgctctgcgcctggctgggattaagcctctcctgggcgattagtcttcccgccgggcccgctattgtgctgaccgccagcgcactgttttttgtttcgctattttttggcacgcgcagccggctgctggtcggttggcgcacattgatggggtaaggaaatgatgaaacgtagtgcaatagtggtcgcgctggccctcggcctgatggcgcagggggccatggcgaaaacgctgaatgtggtaagcagtttttcggtgttgggtgatatagcgcagcaggtcggcggggagcatgtccatgtggataccctggtcggcccggacggcgatccgcacaccttcgaaccgtctccgaaggatagcgcgctgctcagcaaggccgacgtggttgtggttaacggcctggggctggaagggtggctggatcgcctgattaaggcctctggttttaagggcgagctggtggtggcatcgaaaggcgtcaagacccatacccttgatgaagagggtaaaacggtgaccgatccccacgcctggaacagcgcagcgaacggcgcattgtatgcgcagaatatcctcgatggtctggtgaaagccgacccggaagataaagcagcgttgaccagcagcggcaagcgctatatcgaccagctgacgtctctcgacggctgggcgaaagcgcagttcagcgccattccgctggccaagcgcaaggtcctgaccagccatgacgctttcggctattttggccgggcttaccacgtgaccttcctcgcgccacaggggctctcttcagagagcgaggccagcgcggcgcaggtggcggcgctgattaagcaaatcaaagcggatggcgtccatacctggtttatggagaaccagcttgacccgcggctggtgaagcagattgccagcgccaccggcgcgcagccggggggcgaactctatccggaagcgctatctaagccgggcggcgtcgccgatagttacgtcaaaatgatgcgtcacaacgttgagcttatcgctaacagcatgaagtaacaggttgtctggtcgtcctggttatcacaggacgacccatttctggatcccccctcgtaaaatcgccgcttcatccccatatctctgtcgaaagtgctatctttgatggcctctttatccagagcaaagcggggcgataatgaccgattcagaattaatgcagctaagcgagaagattggccgggcgctgaaggcgcgtggggcgacggtgaccacggcggaatcctgtaccggcggctggattgcgaaagcgatcaccgatattgccggcagctcggcgtggtttgaacgcggctttgtcacctacagcaacgaagctaaatcgcaaatgatcggcgtcagcgaagcgacgctgcgcgacaacggcgcggtaagcgaaccggtggtggtggagatggcgattggcgcgctgcgcgcggcgcgtgcggattatgccatctccgttagcggcgtcgccgggccggatggcggcagcgtcgaaaagccggtcggcacggtatggttcggcgtcgccagcgtgagcgggcaaggggtgacgcggcgggaatgctttgccggagaccgcgaagcggtgcgtcgtcaggcgacggcctatgcgctaaatctgctctggcaacaatttctacaaaacacttgatactgtatgactatacagtataattgcctcaactgaacaaatattaacggcgaagcgaacacgctttaccctgcatgattaggagtaacaatggcgatcgacgaaaacaaacagaaagcgttggcggctgcactgggccagatcgaaaagcaattcggtaaaggctccatcatgcgcctgggtgaagaccgcaccatggatgtggaaaccatctccaccggctcgctttctctggatatcgcgctgggcgccggcggtctgccaatgggccgtatcgtcgagatctacggtccggaatcctccggtaaaaccaccctgacgctgcaggttatcgccgcagcgcagcgtgaaggtaaaacctgtgcgttcatcgatgctgaacatgcgctggatcctgtctatgcacgcaaactgggcgtcgatatcgacaacctgctgtgttctcagccggacaccggcgagcaggcgctggagatctgtgacgcgctggcgcgctctggtgcggttgatgttatcgtcgtcgactccgtcgcggcgttgacgccgaaagcggaaatcgaaggcgaaatcggcgactctcacatgggccttgcggcgcgtatgatgagccaggcgatgcgtaagctggcgggtaacctgaagcagtccaacacgctgctgatctttatcaaccagatccgtatgaaaattggcgtgatgttcggtaacccggaaaccactaccggtggtaacgcgctgacgttctacgcctctgtgcgtctggacattcgccgcatcggcgcggtgaaagagggcgacaatgtcgtcggcagcgaaacccgcgtcaaagtggtgaaaaacaagatcgccgcgccgtttaaacaggccgaattccagatcctctacggcgaaggcatcaacttctacggcgagctggtagacctcggcgtaaaagagaagctgattgagaaagcgggtgcctggtatagctacaacggcgacaaaatcggtcagggtaaagcgaacgcgatcacctggctgaaagagaacccggcggcggcgaaagagattgagaagaaagtgcgcgaactgctgctcaacaatcaggatgcgaagccagacttcgttgttgacggcaacgacgcagaagaaaccgaacaggatttctgatatcgtctgcaagactgacagggctgcttaggcagcccttttgctttgtgagattatcgaggtgcctgtgactgaaccttcatcacgccgctccggctacgcccgcctgctggaccgtgctatccgcattctggcgatgcgcgaccacagcgagcaggagctgcgacgcaagctggtcgctccggtgatgagcaaaaacggtcctgaggcgctggacgtcacccccgacgagctggagcaggttgtcgcctggtgtatcgaaaaccgctaccttgacgacaaccgcttcgtcggccagttcatcgccagccggagccgcaaaggctatggtccggcgcgcattcgccaggagctcagccagaaaggcattgcgcgccaggtcgttgaccaggcgatgcgcgaatgcgatatcgactgggtgagccttgccagggagcaggcacagcgtaaatacggcgaaccgttaccttccgcctttactgaaaaagtgaaagttcagcgattcctgctttaccgcggctacctgatggaagatatccaggaaatctggcgaaattttgcagattgacccatccgggattttacttcgccgtaaagaaaacttatcttattcccactttattccgtcgggccgctggttgtgactgtgcaggcagcggcctgggcgattattcctttacacaaaatcattcaagctgcatcagggcggcaagagagactctctttcgcaacgtacgtcagttcggtgccggaagagcaagcgcagccaggacagaggcgacttgaaggatgacgtgtagcttgatttcaggataattatgagcaagagcaccgctgagatccgtcaggcgtttctcgactttttccatagcaagggacatcaggtagttgccagcagctccctggtgccgcacaacgatccgaccctgctgtttaccaatgcagggatgaaccagttcaaggatgtcttccttggtctcgacaaacgtaattattcgcgtgcgaccaccgcacagcgttgcgtgcgtgcgggtggtaaacacaacgatctggaaaacgtcggttacaccgcgcgtcaccacaccttttttgaaatgctgggcaacttcagctttggcgattacttcaagcaggatgccatcaaatacgcgtgggaactgctgaccggtgagaactggttcgcgctgccgaaagaaaaactgtgggttaccgtttacgagaccgatgacgaagctttcgacatctgggccaatgaagtaggcgttccgcgcgagcgtattatccgcatcggcgacaacaaaggcgcgccgtttgcttctgacaacttctggcagatgggcgacaccggtccgtgcggcccgtgcaccgaaatcttctttgaccacggcgatcacatctggggcggccctccgggaagcccggaagaagatggcgaccgttacattgagatttggaacatcgtcttcatgcagttcaaccgtcaggctgacggtactatggagccgctgccgaagccgtccgtcgacaccggtatgggtctggagcgtattgccgcggtgctgcagcacgttaactccaactatgacatcgacctgttccgcgatctgatcgccagcgtggcgaaagtcaccggcgcgaccgatctgacgaacaagtcgctgcgcgttatcgccgaccacattcgctcctgcgccttcctggttgccgacggcgtgatcccgtcgaatgaaaaccgcggctacgtgctgcgtcgtatcattcgccgcgcgatccgtcacggcaacatgctgggcgcgaaggacaccttcttctggaaactggttgccccgctgatcgatgtgatgggctccgccggcgacgagctgaagcagcagcaggctcaggttgagcaggtgctgaaaaccgaagaagagcagtttgcccgcaccctcgagcgcggcctggcgctgctggatgaggagctgtcgaagctgaaaggcgacaccctggacggcgaaaccgccttccgtctgtacgacacctacggcttcccggtcgacctgaccgccgatgtgtgccgcgagcgcaacatcaaggttgatgaagctggttttgaagccgcgatggaagagcagcgccgccgcgcgcgcgagtccagtggtttcggcgccgactataatgcgatgatccgcgttgacggcgcctctgaatttaaaggctacgatcatctggagctgaacggcaaggttaccgccctgtttatcgacggcaaagcggtggatagcgttagcgctggccaggaagcggtggtgatccttgatcagaccccgttctatgcggagtccggcggccaggtgggcgataaaggcgaattaaaaggcgcgggcttctccttcgcagtcagcgacacgcagaagtacggccaggctattggtcatatcggtaaagtcgccagcggcacactgaaagtgggtgacgcggtgcaggccgacgtagatgaggctcgccgtcagcgtatccgtctcaaccactccgcgacgcacctgatgcacgcggcgctgcgccaggtgctcggcacccatgtggcgcagaaaggttcgctggtcaatgataaagcgctgcgctttgacttctcgcattttgaagcgatgaagccggaagaaattcgtgcggtggaagacctggtcaacgcgcagatccgtcgtaacctggctatcgaaaccaacattatggatatcgatgccgcgcgcgcatccggcgccatggcgctgtttggcgagaaatacgacgatcgcgtgcgcgttctgcggatgggcgacttctccacggagctgtgcggcgggactcacgcggcgcgtaccggcgatatcggcctgttccgcatcacgtcagagtccggcaccgctgctggcgtgcgccgtatcgaagcggtgactggcgaaggcgcgatggccatcctgcatgcgcagagcgatcagctcaatgatatcgctcagctgctgaagggtgacagccacaatctcggcgagaaggttcgcgccgcgctggagcgtacccgtcagctggaaaaagagctgcagcagctgaaagagcaggctgcggcgcaggagagcgcaaacctctccagcaaagcggaagagattaacggcgttaagctgctggtcagcgaactgaccggcgttgagccgaaaatgctgcgtaccatggttgacgatctgaagaaccagctcggttcgacgatcgttgtattagctacggtagcggatggtaaggtttctctgattgcaggtgtgtctaaggatgtgacagaccgcgtgaaagcaggggagctggttggtatggtcgctcagcaggtgggcggtaaagggggcggtcgtccggatatggcgcaggccggtggtaccgatgcgtctgctctccctgcagcgttagccagtgtgaaaggctgggtcagcgcaaaactgtaataactataaacgcatttaccctaaataattcgagttgcaggaaggcggcgacgcagcgaattcccaggagcttactctagtaagtgactggggtgagcgaggaaagccaacacgcatgcaacttgaagtatgacgggtataggtgccataaccagagggttacggcaccttgcgtcagaaacactgataacgataaagtcgggttgaaattgtgtatatcggctaaacttaggtttaacagaatgtgatgccatgactgcttataccctaaggtatttgtcatcgcttactttttggcgttatatgatggataatgccgggatacgagagacccgactcttttaatctttcaaggagcaaagaatgctgattctgactcgtcgagttggtgagaccctcatgattggagatgaggtcactgtgacagttttaggggtgaagggtaaccaggttcgtattggcgtaaacgcccctaaagaagtgtctgttcaccgtgaagagatctaccagcgtattcaggctgaaaaatcccagcagtccagttactaaggtttccgcgcctcgctgtgcagtgaggcgcatcacttaccgccgctttttccctttttctgttttttccccctgcgccataccgcttttcattaccctttgccgctttggtcgtttggcgttatgccagcgtcagggctgatttcctgttgataaattgccctttttgccgtttttgcacgcgaattgcgtgcgaagtgtgcaaacgaaaaaaggtctcgaaaaagtgtttgacttataagtaccagaaagtaatatgtgcgccatcgcagcgacgaagagcagaaacaagttcttcgaagcactcgaaagaggcgtgtgtggtgaggtggccgagaggctgaaggcgctcccctgctaagggagtatgcggtcaaaagctgcatccggggttcgaatccccgcctcaccgccattttgcatccgtagctcagctggatagagtactcggctacgaaccgagcggtcggaggttcgaatcctcccggatgcaccatcttctttctgaattaagagagaagagcgctgtgaaagcagcggcccgcagtgcgaggcataatcgagtcactctaccgattaggccatcatactcagtgtggcatgtgttagttgtgacactgacgcgtagtaaagcaagtttcccgatgcatccgtagctcagctggatagagtactcggctacgaaccgagcggtcggaggttcgaatcctcccggatgcaccattctttaataagaatggcaaatcgcgaaatttgatatcagaattacagcagtaatcccgatgcatccgtagctcagctggatagagtactcggctacgaaccgagcggtcggaggttcgaatcctcccggatgcaccatattctccttgataacagcgacgatgttgttttatggtctgcgaaattatcgccagcaccagggaggataacgttgcgtaagcaacggcccgtagggcgaggcgcagccgagtaatcctcccggatgcaccatattctccttagtaacagcaacattgttgttatctggtttgcgaaaccatcgtaagtgccaggagagtaaccccgcagtaaaatagctttcccgatgcatccgtagctcagctggatagagtactcggctacgaaccgagcggtcggaggttcgaatcctcccggatgcaccatattctccttagtaacagcgacgacgttgttttatggtctgcgaaatcatcgccagcaccagggggataacgttgcgtaagcaacggcccgaagggcgaggcgtagccgagtcatcctcccggatgcaccatattctcctcagtaacaacgacgatgttgttgcataggctgcgaaattatcgcagcacccgttctgaatgcataatcttcactcttctctcaccatcccgattacctcgttttccatcactggcttcatcctgacttttttattggcaagacgcgctttccactataatttatccttgtatatcagcgttatcaggctgagataaatgcaaggagagaaatccatgaaatggttcaaagcaatacctgctttttgcgcgacgctgctggtaacgacggccctcgctggctgtgcgggatcggctacaaaggagagtacgggcggctatattgacgataccgtggtgaccaccaaggtgaaaacggcgctctttaacgataaagacattaagtcctcagaaattagcgtccagacctttaaaggccgcgtccagctgagcggatttgtctcctccgcggagagcgctaaacgagccgtagaagtcacacgccgagtgcagggcgtgcgaatggtcgagaacgatctgcgtattaaataaggctggttatccggcctaatgtttgggggcgcctgagggcgcctttgtcgtctgcgccgctggccgcgacaacggcgggcttttgcgttacagtaatcattcccaaaccggttggtgagaagacaatgtacgaaggttacgcaggactgatctttgatatggatggcaccattctcgataccgagccgacccatcggcaggcatggaacgaggtgttgggccgctacggtatgcgtttcgacgaacaggcgatggtcgcgctcaatggctcaccaacctggcgaatcgcccaggcgattatcgaactcaaccaggccgatctcgatccacatcgcctggcgcaggaaaaaacccaggccgtcaaagcgatgctgctggacagcgtacgcccgttgccgctgattgaggtggttaaggcatggcacggccgtcgcccgatgtcggtgggaaccggcagcgagagcgccgtcgccgaagcgctgctggcgcacctggggctgcgtcattacttctccgcggtggtggcggccgatcatgtggtcaaccataaacccgcgcccgataccttcctgctgtgcgccgagcgcatgggcgtcgcgccggaaaaatgcgtcgtcttcgaagatgccgactttggtctgcaggcggcgaagcgcgcgggaatggacgcagttgacgtgcgtttgctgtgagcgacgcgctgtcactcacctcgctgtttgccagtagctttttaagcgccacgctgctccccggcaattcggaggttgtgctggtggctatgctacttgcgggggtcagtcatccgtggtggttagtattaatagcaacaatcggcaatagccttggaggggtaactaacgttattctggggcgcttgtttccgctgcgcaaaacctcgcgctggcaggagcgggcggccggctggcttaagcgctacggcgcggtcacgctcttactgagctgggcgccggttgtcggcgatttactgtgtttgctggcgggatggatgcgcatttcctggggaccggtactctttttcttatgccttggtaaggcgctgcgctatatcgctattgcggcagcgacgcttcagggcatgacgtggtggcactaattggactgacagttcatccattacaattatgcttattcaaacgatttcgacaggcgggaggtcaaattgatcccggacgtatcacaggcgctggcctggctggaaaaacatccgcaggctctgcagggtattcaacgtggtctggagcgggaaacgctgcgcgtgaacgcagacggcacccttgcaacgaccggtcaccctccggcgttaggctcagcgctaacgcataaatggattaccaccgattttgccgaagctttacttgagttcattacgccagtagatggcgatattgagcatatgctgacctttatgcgcgatgtccatcgctataccgcgcgtcagcttggcgacgagcggatgtggccgctgagcatgccatgctatatcgcccccggtcaggatattgagctggcgcagtacggcacctctaacgtggggcgcctgaaaacgctatatcgcgaggggctgaagaatcgctatggcgcgctgatgcagactatctccggcgtgcactataacttctccctaccgatggccttctggcaggcaaaatgtggtgtggaagatgccgagagtggtaaagaggccatttcggcgggctatttccgctcaattcgtaactactatcgctttggctgggtgatcccctatctgtttggcgcctcgccggcgatttgctcctcattcctgcaaggcaaaccgacaacgctgccctttgaggaaacgggcaacggcatgtattacctgccgtatgccacctcgctgcgcctcagcgaccttggttataccaataagtcgcaaagcaatctcggaattacgtttaacgatctgcacgagtatgtggcaggattgaagcgggcgattaaaacgccgtcggaagagtacgccaaaatcgggctgcagaaagacggcaagtatctgcagatcaacagcaacattctgcagattgaaaatgaactttatgcgccgatccgcccgaaacgcgtcacccgtcggggcgaaaccccgtccgatgcgctgttgcgcggtggtattgagtatatcgaagtgcgttcgctggatatcaatccgttctcgccgatcggcgttgacgcccagcaggtgcgtttcctcgacctgtttatggtctggtgcgcgctggccgacgcgccggagatgagcagcgatgagctgctgtgcacccgcaccaactggaatcgggtgattctggaagggcgtaagccgggcttaacgctggggattggctgcgaaagcgcgcagttcccgctggctcaggtgggcaaagatctgttccgcgatttacgccgcgtggcgcagaccctggacagtatccacggtggccaggcatatcagcaggtctgcgacgagctgctggcctgctttgacgatccggaattaaccttctcagcccgcattctgcgttctatgattgaagaaggcattggcggtaccggccgtgcgcttgccgatcgttaccggacgcagctgcgcgaagagccgctggagatcctgagcgaagacgattttatcgccgagcgcgacgcgtcggtggcgcgacaaaagaaagtggaagctgaagacagcgagccgtttgaggcgctgctggcgcggcacgcgtagcgctggaaaagaaaaaggccacatcactgtggccaaactttcatctctgattcagggatgatgatgataataaatgcgcgtctttcatatactgagactcgcggctgaacaaagagttcattttattttaaaaaaattcactcccggaggtgacgaatgccgttgttagatagtttcacagtcgaccatacccgaatggaagccccagcggtgcgtgtcgcgaagaaaatgaacacgccgcatggcgatgaaatcaccgttttcgatctgcgcttctgcgtaccgaaccaggaagtgatgccggaacgcggtatccacaccctggagcatctgttcgcgggctttatgcgcgatcatctgaacgggaatggcgtggaaattatcgacatttcgccaatgggctgccgcaccggcttctatatgagcctgattggtacgccggacgagcagcgcgtcgctgacgcctggaaagcggcgatggccgatgtgctgaaggtgaaagatcagaaccagatcccggagctcaacgtctaccagtgcgggacttacaccatgcactcgctggaagaggcccaggacatcgctcgccatatcattgagcgcgatgtgcgcatcaacagcaacgacgaactggcgttgccgaaagaaaaactgcaggaactgcacatctagtgcttccgccacggcccgacgcctgtcgccgggccgctcttctgacgccgcgatgacgacgacgctttccttctcctttcagcaccgcccactggtgccctttgcccatgattatgcccacggtgaccaggaagactggcatcagcatgactgcgcccagctgctgcatatactaagcggcgtggtgcgggtcgcgacgccggtaggctactgggtggtgccgcccgggcgcggcgtctggctgccggcgggaacgccgcacgcgctacgcatgaccggcaacgtggcggcgcgcaccctgtttatcgatccgctggcgcgcgccgatcttccggcgggctgccagatcgtacagatcacgccgctgctgcgggaactgatcgtgtcatccctggcgctggcggaacgctatgcccccgccagccgcgacgaaagaatttatgaactgatcctcgatgagatccgcgggatggcgatcctgccgtttggcctgccggagccgcaaagcgaaacgctgcgtcggctgtgccagcaggtacgcgaggcgccgggcgaggcctggagcagcggccaggcggcgaaggcgtgcagcatgagcgagcgaaccctaaaccgccattttcagcagcagactagcctgacgtggagcgagtgggtgcgccgggcgaagctaatggaagcgctggtgcgcctggcgcagggccactccgtgctgcgggtggcgctggagctgggctacggtagccacagcgccttcagcgccatgtttcgtcgggtgatgggcgtcgcccccagcgactattttcgtcccccggcctgatcggcggcgctgagcgcattgcacagcgcctgcagcgaggcgcgcgccacgtcattatcgatacccacgccccagtagctttctccttgcggaaaaacgcagcggatataggccaccgaccggctgtcgctgcgcgcgccgagcgtatgctcatgatagtccttgatcataaacggctgccgaaacagcgcgctgagcccgctggctgcggcggagagcaggccgttgccctggccctgcaggcgtcgggtttcgccgtggtgacgcagcgttgcctgcagggaaagctggccatcctgctggctggcgctctgataatcgagcagcgtcagcgccggctgcgcctgcagcccgtagcgcgtgcggaacagctgccacagcgcatggtgggtcatctctttgccgtcgctatcggtggcctgctgaacgtgctggctgaagtcctgctgcagcccgcggggcagtttcagaccatgattttgttcgataagccaggcgctgccgctcttccccgactggctgttgacgcggatcaccgcctcatagctgcagccaatatcctgcgggtcaatgggcaggtagggcatctgccacggatcgccaggctgacgggcatcaaacccttttttgatcgcatcctgatgggagccggagaaggcggtgtaagccagacttcccgcccacgggtggcgcgggtgaacggggatctggttgcagttttccaccacctccaccacccggttcatctgctcgaagcgaagctcagggtcgatgccctggctgtagaggttcatcgccaaagtcaccagacagacgttgccggtgcgttcgccgttgccaaacaggcagccttctacccgatcggcgccggccatcaccgccagctcggcgctggcgacgccggtgccgcgatcgttatgcgggtgcacgctgatgcagacctcgccgcggcgggagaagtggcggcaaaaatactcgatctgatcggcatagacgttgggggtgttgacttccaccgtcgccggcagattgacgatcatcggtcgctcggcgcagggctgccagacatccgccaccgcttcgcaaatctcaagcgcaaacgcgggctcggtgaagcagaaggtttcaggcgaatattcatattgccagcgggtctccggctgctgttcgcactgctgacggataagccgggtggcgcgggtcgcgagggcgatcacctcggccttgtccatgccgaaaaccagctcgcggaacagcggcgcggtggcattgtagaggtggacggtagcccggcgggcgccgcgcagcgcctcaaaggtgcgcaggatcagcgggtctcgcgcctgggtcagcacctggatggtgacatcctccgggatgcgctgttcgtcaatcagctggcggacaaagttgaaatcggtttgtgaggcggaagggaaggcgacttcaatctctttaaagccgcactccagcagcagatcccagaactgcagtttgcgggcgctgtccatgggctccgccagcgcctggttgccgtcgcgcaggtcagtcgagagccagcgcggggcgtgactgatttgccggtctggccagcggcggtcaggcagggcgatcggcggatagggacggtacttttcagcaggatggctcagcatagtgttctccttaatggtcagcctttatcctgcccgagcgcagggtgacgggctttcgcaaacgagacagaaactagcgagaactggacaacctgacgccgtaaaaaagggacccggaggtccctttatgtgaggcttagtgcgcgccgccgccgcctccgccggcgctgaacggtggtctggcgaaccacaccagccccaacagcaggatgaaaatagccgcagaaatccagaagatttcgttggcggagataatcagcccctggttggttatctgctgcgctatccagccggacgcctgctgctgcgtcattcccatgccctgcagctgatcgtatatctgctgcgcgttggggttaaagggggtcaccgattcggtgagctgcgcatgatgcagcgcctcgcggttggtccacagggtggtggtgatcgaggtcccgatggagccggcaagggtacgggtgaagttcgacaggctcgacgccgccgccagccgctccggcggcaggccggagagggtgatggtggtcaacggcatgaagaagcaggccaccgcgaagccctggataaactgtggccacgccgaggcgccaaagtccatccccggttcgaaggtccaggcgcgccagtagaagcagaccgcgtacataataaagctgaaggtgaccagccgccgcatgtcgagcttatgcgcgaagcggccgataatcggcgacagaatgaccgggatcacccccaccggcgccgacgccaggccggcccaggtcgcggtgtagccgtagacctcctgcaacagctgcggcagcagtacgatggcgccgaagtagagcatataggccagactgatacagaggcagccgatggtgaagttgcgcgacttaaatagcgacagatcgacaatcgggttatcgtcggttagctcccagacgatcaggaagcttatcgccaccaccgccacgatggtcagaatgataatctcattggaggagaaccagtccagctctttaccccggtccagcatcacctgcaggctaccgataccgatgatcagcagcgccagaccgacgccgtcgatccgccgctgttcggttttggtttcccggttgcgcagggtctgcagggtcatcagcaccaccgccacgccaatgggcacgttgataaagaagatccagccccagtgataattatcgctgatatagccgccgaggatcggaccgcagatgggcgcgacaatcaccgtcattgaccacagcgccagagcgatagagcgcttcgccgggggatagttgctgagcagcagactttgcgacagcgggatcagcggcccggcgacgatcccctgaatgacgcggaagaaaatcagcatcgtcaggctgttggagacgccgcaggcccaggaggcaatggcgaaggcggtggttgaccacaggaacagcttcacctcgccgacgcgcttggccagccagccggtgatcgggatggagatggcgttagcgaccccgaacgaggtgatgacccaggtcccctggctcagcgacgagccaaggttgccggcaatggtcgggatcgccacgttggcgatagtggaatccagcacctgcatgaacgtcgcgagcgacagcgcaatggtcataatgaccagttgcgcgccttccagcggtttttgctgttgcattacactcaccccgaattatccggcgttggcctgaatgatctcgtctatcagcttattaaccggatcgagagcgatttcgcgggcattgctctcgtaaaccggggagctccgcacctggctggccagcatttcaccatcgcgatcggtggtgttgacttccaccagcgtcgagagaccgatacgcagcgggtgttccgctagttgtttttcatccagctcgatacgaaccggcaggcgttgtaccactttgatccagttgccggtggcattctgcgccggcagcagagagaaggcgctgccggtgcccatatccagaccgaccactttaccggtgtatttcacgtcatcgccatagatatcgctgatcacggtggccggctggccgatacgcatatgcgccagctgagtctctttaaagttagcatcgatccacaggttggtcgccgggaccaccgccatcagcggcgtggtggtgccaatctgcgcgccaggctgtaccgagcgacgggaaacgtagccgctaatcgggctgacgatctgcgtacgctgcagggccagccaggcgttacgcacttcagtggccgcctggagcaccgccggctgctgttccagcctggtgcccagcacgatcgcctggttggcgttgtactgctggattgccacgtcgagttcggcctgtgcgctggcgacggtatcgcgggcgtgctgcagctcttcgcggccaatgaggttcgcggcgcccagcgggatgcggcggttcaagtcagcctgcgcctgggcgagggcggtttttttgacgtcgatatttgcctgcagctgcttgctgttgatcatctgctggcgggtctgacggacgctggcggccagttgggtcttagccttttcaaacgcctgttgggcatcggtccgatcgagcgtgaccagcggatcgcctttctgcacgtagtccgtgttgtcagcccagactttggtcacgctgccagcgacctgagccataatttgtacctgattccctgccacgtaggcatcgtcggtctcttcgtagtgacgcagtaccagaaaccagtaaatcccatatgccacggcaataataatgaagagcaatgtcagcaacagaagggcgcctttacgctttccttttttgctgcctggttgctgcggggtttggctctccgcatttgcactcatgttattctccacgatcttattatttcacatcggctgagccgacctgtttatcagaaaggccagcagagatctgctggcctggctgttttccttgcaacgtaaaaatgggctgagcgacgccgcccttagcgtagagagtccgctagcacgccttcttcttccatctgatcaaggcggctcaggagtttgcgggtgatgtgttcgagctgatctttttcgctggtgctaagtgaagaccacagctgatgcaggcagttatgctgcggcggcaggacttcacgcaaaaactgatggcccttttcggtcagttgcagatgcaaacagcgacgatcgttatcgctctcgcggcgctcaatccagccgcgtttttccagttcatcagcgatacgggtggcgttggtacgtgacgagcccagcgcacagctcagctcggacggctggatgctgtggttttcctgtgactccagcgtaatcagcgccataaataatgtctcgttaattccctgcgctttgagcattttattgcgattttccagcagcttaccttgcatatgcatgcaaagacgagttaacaggatctcctgaaacgggaaatcttcatggcggctggcgcggaacttgagcatttgctcaatgggagtaaacgaactatccatttgggtatgacctcattaattacagccgatataataactattgtgacaaataaatcaaatgaattattgaccaaaattgatacgtaaagcttagagcccgttggtgattttccatgccagaccataggcaaacgccgacagcagggtcgggacaatgatgctgcgggttttccagaaggcggcgcccagcaccaggaagccggtcagcgtcggcgccaggcgatgggcatcggctaggatctccggcacgctggagaccaccagcagcgcgcaaatcgaggcgatgccaatggtatccagcagcacgctgaccgggccgcggcgggcaggacgggcgtggccgacgcgcaaacgcagaggaagatagcgaaagagatagttgacgccgccgactatcaccccgagcagaaggacttcactgttcatccggcatccccttgagcatggcctgaagcagcgccgtcagacacccgcagacaattccggcgaggatcgccgccggaatggaaaataacaaaatgccgcccagcgcgcccgccagcgccgccgtgacgcagagtgactgctgacgctggaaagaggccagcaggaagctcataaacagcgccggcagcataaagccgagggcggcttccaccgccggataatccaccagcaggccgttgccggaccaggcgccggccagcgtgccgcacacccacgatgcccacgaggtaaaagcgagaccgagcatccagttttcgctccagcggcggttatcgcgaaccagcctggcggtagcggcggcgaaaacctcatcggtcaggccgaaggcccagagggcggttttctttttatccagcgctgagcgaatgcggctgcgcaatgaggggccatacagcacgtggcggacatccatcgccattaccgtcagggcggcgacccacagcgaactgccggcggccaacatggcggtgatcacaaactggctggcgccggcgtaaataatgcaggagaagaacaggctttccagtggggtgaagcccagccgggtggcattgagtccgaaggcgaatgccaccggaaggtagctgatgacgatggggagactgtctttgacgccttcgccgacggtggcgacacgttcaggtaaggcacaggttaagggcgcggggttttccatatgaataacttatcgctggatccatgtgaaggtggcaatttgaccgatgtctccaccttaacagagcgcgatgcgccttaacactatggaaattcctggaatcgcttttctatgacctgaccacgagaaaggggggcaaggggaccggataaggcgctgggccttatccgtgagcgggtttactgctgcgcggcgagggcggttttcacccagctgtcgaacagcggctggtgggctttgatccagccatcaacgtggccgttaatgtcggcttcggaagcatggccttcatgcatcatcgcattctcggcgttgatgtcggcgatcggtagcttcatgacgctaaacagagtggcggcggccggatttttctccgcccaggctttgttagcgacgatgtgcatggtgttcaccgggaagccatagttggcgccgttggccagtttggtgtcgatgtttttctgctcgcccggcagggaggagaacggcacctgcagccagacgacgtccttgccaggcttcagcacgtcgctaacccagtacggcgtccaggtgtagtagagcactggtttaccctctttataccgggcaatggtgtcggccatcatcgccgcgtagttgccctggttatgggtgacggttttgctcaggccataggcgtcaatctgatggttaatcactgcttcgcagccccatcctggggtacagccggtgagatccgctttaccgtcattgttggtatcaaacagtttggcgatctgcggatctttgagctgatcgatggaggtgatgtggtactgctcagcggtttttttgtcgatcaaatagccctgggcggcgcctgagacgtacactcctttgcgatagaatttgttatcaccgcccgccgcggcgtacatgtcatcgtgcagcggttgccagttggtggcgataaaggtggtatctccggcggcaatcgacgtataggcaacgttatagtccacttcgctgggtttctcgacggtgtagcccagcttctccagcgcgcgactgaccagcagggtctggaagctctcttcggagatagtgctctgagcgggcttcaccgtaatccctttacccggcaggtcggcggcgaaggcgctggtggcgagcagggtggcaaaggcggcggtggccaacatcgtactatgtcgcatggtggttcctcttattgtttaacgggaagggccgctcccgggcatcggctggtgccggggagcggcgctgttatcgacttatcgacagaaagggcgagtgataagccccagcgggccgggggtgtaccagcggcggttgccgcgactgcgggcgtcgcgaccgacggcctgggtgaggcggtcaagaataatcgccaggatcacgatccccaccccgccgacggtcgccaggcccatatccaggcgaccgataccgcgcagcaccatctggccgaggccgccgacggcgatcatcgaggcgatcactaccatcgacagggccagcatcagggtctggttaaccccggccataatggtgggcatggccagcggcagctgcaccttaaacagcagctggcgcgggctggcgccaaatgagcgcgacgcttcgatcagatccgcaggcacctggtttatcccgaggatggtcagacggacgatcggcggcagggcgaagataatcgtcaccaccacgcccggtacgttgccgatgccgaacagcatcacgatcggcaccagatagacgaacgccggcgtggtctgcatggcatccaacagcgggcggatgattttcgccgcccgcgggctgcgcgctagccagatccccagcggcaagccgataaccatgcagaacagcagggcggtgaggaccagcgccagagtgaccatggcttgcgaccacgcgccgatggcgccgatggcaatcagcgataccagagtggcgacccccatgccgaggctggagatctgccaggcgattagcgcgaagacgataatcgccaccggcgccggcatccccaacagcagctgctggaaggcgctgaggatgtagtcgatcggcacgcggatcccctggaacagcggacggaagtgcagcacgatccagtcgatggcgtgggtcacccagctgtcgagcgggatcagggtcttatggaacggatccatgatattgaactgttccggctgcggcgcaggggcgctgtgcagccagtcggcgccgccgccattagccggcgcggcagtagaggcgccaccccaggcgtcggcagcctgcgaggcgctgtcggttgacggggcgctgccccatggattggtctgatcagccatgattcaccccctcgcgatctaaagcctggagcaacatccgtttggaaatgatgccaatatattgttgttcttcatccactaccggcacggcgcacggagcgtggccgacgtgggagagcagatcgctgagcggggtttgcgcttccaccgccagcggggcgtcaatcagcgctgcctcgatcccctgcccggcgctgagggctgttttcagagaatcaatcgagacaatcccgacaaagcgattaccgcgctctatgacatagccatattcccggtcttcatcctgtaataatttcagcgccgaacgggggccaaaaccaggcgttttacgaatcaggccaaccgggctgcggcgggcaatatctttcgcgctgaatacctggctaatatccacgccgcggaagaaggtgcgcacataatcattggccggattatttaatatttcatccggagtgccgacctggaccacttcgccattttgcataatggcgatacgatcgccaattcgcatggcttcatcaaggtcatgggaaataaagacgatagtgcgttgatgcttcgcctgtaatttgatgagctcatcctgcatttcggtacgaatgagcggatcgagcgcagagaaggcttcatccattaacagaatatcgggattaatcgccagggcgcgagctaaaccgacgcgctggcgcatgccgccggagagttcatccggccaggcgtgggcataattctccagccccacctgacgcagcgcctcccgggctttttgctctcgttcggcggcgggaacgccggcaagcgccatgccaaacgccgtgttgtcgagcacgctcatgtgcggcatcagcgcaaaggactgaaaaaccatcgcaattttcttgcgacgcacctcgcgcagctcggcatccgacattttggcgatatcgaccccgtcaatcagcacctggccgcgggtgggttcaatcaggcgattgagaaggcgaaccatggtggatttccccgagccggagagccccatgatgacgaatatctcgccttcttcaatggccagactggcgtctttgacgccaagcgacagccccgttttttccagtatttgcgctttgttgagtcctttctcaatatatttgaaagcacggtgtggatgctcgccaaatatcttataaagatttttgatttctaatttaattgccatgcaatagagaagttcctgttatttgtttattgcgatatgatacccgatggtgattatgatctttttacaccctaacatactcagattctgtgacaaccctcaatggcaaactctcggcaaaatcagatgggggcaactgtggctaagcccccgtgatataagggctgggcggtaatttgttgttggtaatattttttgattatctttggataattcgactgaaatggaccggttttctgctaaatatgacgaagtgatgacggttaggtcatggagagaatatttggtggattaaacgctattttgtgaaattaatcaccaggaatccgcctgcgatattcctggtgaaagtacggttaaaagtcccaatcgtcgtcggcggtctcttccatttttcctatcacgtaggaggagccggaaccggagaaaaagtcatggttttcgtcggcgttgggcgacagcgctgcgaggattgccggattgaccgccgccatctccgccgggaacagcgcctcgtagccgaggttcatcagcgctttgttggcgttgtagcacaggaaagcgctgacgtcgtcgaaccagccgctctcgccgtacagctcccggctgtaggccagttcgttgtcgtaaagatccatcagcagatcgagggcgaaatttttcaattcttcgcgcttgccggggctgacgatctccagtcctttctggtacttgtagccgatgtaatagccatgcaccgcttcatcgcgaatgatcaggcggatcagatccgcagtgttggtcagctttccccggctggagaagtacatcggcagccagaagccggagtagaagagaaaggattcgaggaacacgctggcgatttttttcttcagcggctcgtcggcctgatagtaacccagcatcagctgcgccttgcgctgcagaggatcgcagctttcgctccaggcgaaggcggcatccacctccttgctgtggcacagcgtggaaaagatggagctgtaagagcgggcatgaaccgcctccataaagctgatgttcgacagcaccgcctcctcatgcggggttaaggcgtccgccattagcgccggggcgccgacggtgttctgaatggtgtcaagcagggtcaatccggtaaagacgcgaatggtcaactgctgctccgccgcgctgagggtttgccaggcgggaatgtcgttcgacagcggcactttctccggcagccagaagttgctggtgagacggttccagacctcaagatctttatcgtcatcaatgcggttccagttgattgcgctgacgcgcgttaaatgggtcatcctgttctccttacagcgcgcaggacacgcagccttcaatttcagtgccttccagcgccagctggcgcagacggatgtagtagagcgtcttgatgcctttcttccaggcgtaaatttgcgccttgttgatatcgcgggtggtggcggtatcggggaagaacagggtcagcgacagcccctggtcgacgtggcgcgtcgcctcggcgtaagtgtcaatgatcttctccggccctatctcatacgcatcctggtagagggccagattgtcgttattcataaatggcgcggggtagtacactcgcccggttttcccctctttgcggatctcaatcttcgagacgatcgggtgaatgctggaggtggcatggttgatgtacgagatcgagccggtgggcggcaccgcctgcagatagcgattgtagatgccatagcgcatgacatcgtcgcgcagctggcgccagctttcccggtcgggcagagagatgccggcgcgggcgaacagcgcgcgcacccgttcggttttcggctgccactcctcctgcagatatttgtcgaagtacgccccgctggcgtagcgcgactgctcgaagccggcgaagcgctggccgcgctcgcgggccagctgcatcgaggtgtgcagcgcgtgccaggtcacggtgtagaagtagatattggtgaagtccagcccctccgggctgccgtaggcaatgccttcccgcgccaggtaaccgtgcagattcatctgccccaggccgatggcgtgggaagccgcgttgccggccgctacggaaggaaccgactgaatgtcgctcatgtcggacacggcggtcagggcgcgcaccgcggtggcgattgtgcggccgaaatccggcgagtccatggtatgggcgatgttcagcgagccgaggttgcaggagatatcttccccgatatgggcatagctgaggtcttcattataggcggacggcgtactgacctgcaggatctccgaacacagattgctcatggtgacccgcccggccaccggactggcgcggttcacggtgtcttcaaacatgatgtacgggtagccggattcaaactggatctccgccaggcgctggaacaggtcgcgggcgcggatccagcgtttgcggacccgctcgtcggccaccagctgcggatagaggtcgccgatggcgcaatcggcgaaaggtttgccgtacagccgttcgacgtcataaggcgagaacagggccatctgcgcatcttctttcgccagctggaaggtgatatcagggatcaccacccccagcgacaaggttttgatgcggattttctcatcggcattttcacgccgggtatcaagaaagcgtaaaatatcgggatggtgaacatgcagccagaccgcacccgccccctggcgggcgccgagctgattggcataggagaaggcgtcctccagcatcttcatcaccggcaccaccccagaagactggttttcgatgcgcttgatcggcgccccggcctcgcgcaggttggagagtaaaaaggccaccccgccgccgcgcttcgacagctgtagcgccgagttcaccgcccggccgatggactccatattatcctcaatacgcagcaggaagcaggagatcagctccccgcgctgctgtttgccagcgttaaggaaggtcggtgtggcgggctgaaagcggccgctgagtatctcctccgtcagctgccgcgcctgctgttcatcgccccgggccagcgtcagggccaccatcacgctgcgttcggcgaaatcctcgaggtagtgcttgccgtcaaaggtcttcagcgcatagctggtatagaacttccaggcgccgaggaaggtctgaaagcgaaacggagcgcgccgggcatgggcgaacaacgccagcacaaacccgcggtcatagccggccagcacctgcggatcgtaatagccctcgctgacgagccagctgagcttatcctcctggctggggaaggtgagggcgttgggctgaacctgggtcgccataaaggcctcaaccgcctggcgatctttctcaaacgggatgcggccctcgctgtcgtacaaattcagcatcgcgttgagggcgtgaaaatccacggcggcggttatacgttctgcggttgtcgttgccaaaattcgctgactcctttacgcacggtgttgatatcgtcgggggttcccatcagctcgaagcggtagagatagggcacggcgcatttttgcgcgatgacatctccggcacgcccccagccgtcgccaaagttgcgattgccggcggcaatcactccgcggatcagctggcggttatgcacgtcgtttaaaaagcggatcgcctgacgcggtaccgcgccggcggtgccgccgccgccatagctgggaacgatgagaatatagggctcgtctacccgcagatgttcacgctcgttcagcgggatgcgcaccgccggcagccccaggcgctgcacaaagcgatgggtattctccgaacggctggagaagtagacgatgaggctcatgcgctggccgccgtaaaggaggggcgcaggcgattgatcatatccgggcggaagccgctccagcgcagctcaccggcgatcaccaccggcagctggcgaaatccctgctcgcgcagggtgtcggcggcatccggctgctggtcgacgttgaccatttcaaaggccagtccccggctctccatggctcgccgggtggcatggcactgcacgcagtcatttcgagtgtaaataataatgcgcatgattcgtatttccatttaagataacagcacggcgctaaacatagcgtcgaacgtagtgggccattcgataaggaaatactagatgtagttatttaaaacttcaaccactcaatatatagcgtttttggcaagcgagtcccccgccgggatagatcggcggaggaggggggaggctgtgcggaactacaggcgcatggccacggcgaggcggttaaaggcgttcatcagactgacggcgaaggtcagatcgcttatctgacgcggggtaaaatgttcgcgcagcggctggtaaacctcatcttccgcatggctggcggcaatgtcggtgaccgactcggcccaagccagcgccgcgcgttcggccggagtaaagtgggcgcttacccgccagcccgcaagggcatccagtttgctttgcgccatgccgcctttgcgcagcgcctggctatgtttctcaagacagaaggcgcagccgttgatctgcgagacgcgtaaataaaccagctctaccagggcgttgcccagctcgcttttctccagcgcgatgctggcctgtaccagccctttatagacttccgggctcagttcactgaatggctgacgtaattggttcatggtgttctcctctctaagacggcagccaaaatagcattataatggactgcaaaagatagccatattgtgatgaaaaaagcagaccataatggaagcgattaacctcccgctttatcagcgtatcgcccgccagttgaaatcggcgattgaacgtggcgaactgaccccgggcagccgtttgcccgccagccgggtgtacgctcaggagcagggcgtttcccgggcgaccatcgaaaacgcctggggagagctggtcgcccagggatggctcgaacggcgtgggcaggcggggacctttgtcagcgagcggctcagcccgcgccagctggcgccggtaccgccagtgcaaccggccgcgccgacggagccgctgccgtttcagatggggctgccggcgctggatctctttccgcgcgggcagtgggcgcgggtgatggggcgtcggctgcggacgcagtcgcggttcgatcttgcacccggcgatcccggcggcgatccgcttctgcgccaggctatcgtcgattatctacgcctgtcgcgcagtatcgactgtcagccggatcaggtgttgatcaccggcagctatgccgcctccatgaatcttatcctgcgtaccctggcgcagccgggacagcatatgtggatggaagatccggggtatccctttatccggccggtcgtcgaggctgggcagctggcggtggatgcgattcccgtggacgacgaagggatggacgtcggctggggccagcgtcatcacccgcaggcgcgatttgccctgctcacaccagcccatcagagtccgctgggggtcgcgctgtcgcttccccgacgccgccagctgctggcgtgggccgcggagcgcgacgcgtggatcattgaggacgattacgatagcgagtttcgctatcacggcaaaccgctgccgccgctgaaaagccttgatgcgccgcagagggtcatctacgcgggcaccttcagtaagtcgatgttcccggcgctgcgcaccgcctggctggtggtgccgaccccgctggtggcgcgttttcaccagaccgcggagcgccagtcctgcaccgttcccaccctgtggcagcagacgctggcggattttatccagcagggacatttttggcgtcatttgaagaaaatgcgcgccagctatagccagcgtagacagtggctggagtcggctctgcaggcgcagggctttcaggtcacgccgcagctggggggaattcaactggttatgtcggtcagcggcgacgatcggctgctcgcgcggcgggcggttgtggccgggctggcggtgcaggcgctgagcgactggcggattcgccacgcgggcgtggggggattattgatgagttttaccaatatacgttcgccggcgatggctgatggacttgcccgacggctgagagaggcgatcgcgatttgatggcgcttaagtcggggaagcagaaaaacccctgcggccagaggcgcacaggggctgacgcgtatttgttatcttcattgccttccgtaaagctcgcgggctaccgcgcgccaatcgcgcggcggcagccgacgcttaagctattatcgacgtaaattgagcaatacgccaataaataccccgacggcggcggcggcgcccacactgtgccacggtttattgcgcacgtaggtatcggcacagcccagcgcatcgcacgctgcctggcgcgcatccagcgccgcctgctgcacccggttgtggccattaaggcgggcacgagtctcttttaacagcgactgcgctttgacacgcgccgcttccgcttcctctttggcgtcactgccccatgatttcagcacctcttccagcgtatccgctaattggctgacatcgttatgaatatcttcggcgttctcgtcaaaattgttgcggttcacatggttagccatcgttatctcccttaattccatcgagtgagtaagtgtaggacaagattttgaattatgcttactgttgtggtttctggaattttccgaaagcactgtccttaatgaataaggtaaggtcaatgtgcggtaaaagataacgaggaatcagtatgtatttaagacccgatgaggtggcgcgtgttcttgaaaaagccggcttcaccatggatgttgtgacgcaaaaagcgtacggctatcgccgcggcgataattatgtttatgtgaaccgcgaagcgcgcatggggcgaacagcgttagttattcatccggcgttaaaagagcgcagcaatatgctggccgaaccggcttcagatatcaaaacctgtgatcattatgaacagtttccgctgtatttagccggggatgcgcaacaacattatggtattccgcatggatttagctcacgcatggcgcttgagcgttttctgaatgggctatttggcgaagcccagccggcaatgtcgacgaattaatacggcgataggcatttaaggatccaggcgaggcgggctggcgggaagaggcgactggcagagccagtcgctgctaacgcgttggtcaggccttcgcctgctgatagggcgccacgcggaacaggcggcggcaatagtcgaggaagtagccgtaggcggcgcccatcatcatcgataccgccaggttcgagctcaccgcggcgacaatctggtgccagtcagcacccacgctccacagaatagcgacatacaccggcgactgaaaggtgacgtaggccagcacgtcggccatatttttcatccacctggccgggctgatgcgccgggcctgacgcatggcgaaatcgcgataaatcccatagggtacggcaataataatgttgaccgggatcgccaccagacgcgacgataacgactgctcaaacgtcataccagagagaaaaatttcgatcatcatgttgacgacggtgcagtaaaccaccatcgcaaaggtgtctgcaaccgcatgcgggagtgcgcagagaacatcggagtgctcctcgaaaatgaagtcattaacgccgaaaaatgcgcgttggtatagcgtttttgggctgcctgttttgatgtgcgtagagtatatctctgcattaaaagtggcaactagctataaatttttatttatcgcctttttgtcgataaaatactctgcgctggtttgttttttgttcgttacgctacttttattcctgtttttacaaatatcaatatttatcaatgtgttactcttgattgcgaaatcgagactggccgaaggaacggcgcctgatagccaaccatggcgcaacatcacgcgagtgtgtgattccgctctcttttaggattttttatgccgtaagtcgcttttttatggtgaaaaattctgaattgcgaattgtcgttttattcccattttctgattaactattcactgtggccaaaggtatgtatcagtgcggccacgtatgaacagcaggtaacccgctgaccataaagctaatattcctggcgagaacggtggtttttcccgtcattctgccttttttatttattcattctcttttttgcctgtgcttatgaaaaaggctcaggtatttgccaatatagttccaggggataaccgctaatatccaccttatatatttatctggacaaccgaaggctggaaataaataaacgtttctattacacttgccgcgttgtatcttttaatttgctatttggaattttttaattttatgtcttcaatgttacacaaactgaataatatccgttcactgcgtgccctgtcccgtgaattctccattgacgtgcttgaagagatgctggaaaagctcaggatcgtcactgaagaaaaacgtacgcaacagcagcaggcagctcagcagcaggctgaatatcaggagaaagtgaatacctggcttgaactgatgcgcgccgacggtatttctcctgacgagctggtggccgatattcagccgccaaaggcgggaggcaaaaagcgtcaaccgcgcccggcgaaatatcgttataccgatcatactggcgcagagaaaacctggaccggacagggaagaatgccgaagccgattgccgaggctgtcgcccagggtaaatcgctggatagctttttaatttaacgccttcgggccagcgccagcccggtggtgagagacccaccggcctggccttacgactttaagcgaggggctttagcagacgccgaagtctccctcttcctgatacggcgtgacctcgtccgacttcagcgaatagcgctctccctgctcctgtgcggcctgaaccaccaccagttgctccccttgcacttccaccactttcagttttggtccgcccgctcggggttgtaccagatcgccgacagcaaacataattcactcctcactgttaacaccatggataaacctaaaccatagctcaacgcccgctcactgaacaccgggcgtgctgttttttgttaaaacaatttggagttatatgtattaacattgttaatgttttgctggcgccataccgctgctgagaaagggggacggcgagggtagggttaccaccaatcaggtcaggaaagacaccatgaagtatatcattctgttgatcattgttattgctgtactgtatgtccattaccgcggacgggtgcgctatcgtttctggcggcagctctccgaccattccacatttaccgcgccgctgaatggatttatgtatttattttcccgcgtgccgaatacgccttatctgcggccggagatgtttcccgagctggcgatattgcagcaaaactggcaggttattcgcgacgaaggtctccaccttcagcagctggagcagattaaagcggccgataaatataacgatgccgggtttaactcatttttcaaaaccggctggaaacgcttttatctgaaatggtatgaggatgcccatccttccgccagccagctctgtccgcaaactaccgcgctgctgcgcgatatcccgtcggtgaaagcggccatgtttgccactctgccggacggtagccgtctgccgcgccatcgcgacccctacgccggctcgctacgctttcatctgggcctggcaacgccgaacgatgaccgctgctttattgaggtggatggccagcgttacagctggcgcgatggagaaggcgtgctgtttgatgagacctatatccactatgcggaaaataccagtggtgagaatcgcctgattctgttctgcgatattgaacggccgatgcgctaccgctgggcgcagaaagttaaccactggctgggacgtcatctgatgagcgccgcttcggcgcccaacgatatcggcgatcgcaccggcgggattaaccgggcgtttcgctatatttaccagatccgtattgttggtaagcggttgaaaaaatggaataagacggtctattacatcgtcaaatggctgctcttcggcggcattgcctggcttatctggagcgcgttttaaccccctggcgccggttccacggcatggtcgccagcagacgcgccatgccgcaaaagccggttacgccggcgaaggtgagcccggcgccgaccgcgccgctgagcaggaaaaagccgccgttaacggtatagcccagcagcacccccagtaaaatcaggacgccagcggcaatttgcacctggcgcatcagcggcagcggctgcgatgaatcttccactaccggcaaccccgcggctttccacgcctgaaatcctcctgccagcagacaaggctgcgccggcgcggcggccgcggccagacgaatcgcattattctgcgtccgggaacccgcctggcagtgaaagatgaccgtctctccggcccgggcattgaggggcgcaccgctggtcagagtggcgagcggcaccagctcggcatcggggatatgttcgcgcgcatattcatccgcatcgcggatatcaatcagtctggcgccctgggcaatctgcgcctgggcctcggcgggagttaaggtggcgatggtcataggatcctcacgggcaatagagcgttttcagcgtattgatcacctgctgtaccgcagggtgggtgatgaaatagtggatacgctgggcgtcgcgctcgctgtcgatcagcccctcgtcacgcatccgcgcgaggtgttgcgaggtggcggaggggctcagccctgtagcccgggcgagttcgccggcgctggccctgggcgcatcgcacagcatgcacaggatcagcaatcggtgaggattgctcatcgctttcatcagcgcggcggcttctccggcgcgggcctgcaggtcttcaggtgtggtcatttattttagctttgtctaaatttagataactctaaaataaaaaggccgccagcgccagcacaatttctccacgactcaggccggaacggcgagccgggcaatctgcgcccgggcgctggcgatcccggcgtcgcgaccatgcgggcgattgtccagcccttcggcatagataaattccacctcctggatccccatcagccccagtaccgcgcgcagatagggcgtgacggcgtcggtagtttctccctggtgaataccgccgcggctgctgacgaccaccgcccggacgccctccaccagcccctgcggccagctctcggtgtagcgaaaggtttcccgcgcccgcgccacgaggtcgaaccatttttttagatcggtcgggacgttgaggttatacatcggcgcgccgatcaccagcaggtcgctggcctttaactcggcgataagctggtcggagagggcgaccgcctcgcggatagcaggctgcggatccactgccccgcgcagggcggcgaacagggggcgatccagcgttggcagcgccatggcgctgagatcgtgttcgatgagccgatcgccgtgtcccgccgcctggcgcgccgcgagaaattcgttaatcaactgattggtcagggatgtttcgccattaatgctggattttaaaaccagaacgttagccatgatgagtgcctcaaatgaaagatagaagcaaagactaacactgtcttttttgtctcaggagtgacattatttttccctattgtatcccgtaaggaaccaatctgtgcgcgacgatctgaatgcgatcccggtatttgtcaccgtggtcgagagcggcaactttgccagcgcggcggcgatcctccatgtgacgcgttcggcggtgggaaaaaccattgcccggctggaagcgcgtctcggcgtggcgttattccagcgtaccacccgacggcaactgctgacggaagagggggagcaattctatctccagtgccgggaagcgctggagcgcatccgcgaggccgaagagacgctgcagcgcggcaaagatgaggtgcaggggcggctgcgggtgtcgctgccggtgctgtttggccagcgctgcgtggcaccgctgctgttccgcctcagccagcgctatccgttactgaagctcgagctccactacagcgaccggcaggtcaatctgctggaggaggggtttgatcttgcggtgcgtatcgggagcctggccgataccgggtcgctgcgggcccgtgcgctgggagagcacggcatggtgctgtgcgcggcggcggagtacctgcgccagcagccagcgccgcagactattgccgggttgaacgagcaccgtaccctcggctatctgcacaacggccagctgcaaaaatggcaactgtatgacccgcagcagggcgaagtgcgcttcagtccgcagacgtggctgatacaggatgattttgccgccatcgcggcggcagtgcagcaggggatgggcatcgcctggctgccggactggctggtggcgcaggcgcttgccgatgggacattgcagcaggtgttggcgcccagcgctcaggtgcgtttcgccatccacgcggtatggccggaggggccgtggctgccgcaaaaaacgcgggcggcgatcgatgccctgcgggaagggctgcctcttaccgcaacacctggttagcgcagagagaaataaccgccatctatggcggcggaggttttccgacagcgtgcaagctaccggcgcgctttacgccatagcctcagcgacgaggccgtccggcacgggcggcacggcggtacaacgtgctgcgggcgatacccagtatctgcgccgcccggctgacgttgccgttgaccctggccagggtatcgacaatcaactgctcatcatgggcctgcaatcccccgcgcggcaacggcgcaggcgcggcgcgatacgcctccggcagcgcgtcgggcgtcagcgtggcgccctcatcggcgagagccagcattaccttcaggacgctctgcagctggcgtacgtttcccggccacggcagctggctgaggtgaaccagcagcgcgtttgaaagcgtcacccggcgtgaagcaccgcccaggtcgtgccacagggtggcgataaaggtttccagcgccggccactcgcgcagcggaggcagcgccagggcgtattcccgcaggcgccacagcagatcttcacggaattctccggcgctgacccgctgggtcaggttgcggtgggtggcgcagatcaaggcgaaattcaccggcacgctgcggctggcgcccagcggagcgacctctttctcctgcaggacgcgcaggaggcgggtctgcagcgccagcggcatatcgccgatctcatcaagaaacagcaccccgccgtcagcctcgcggattttaccgatatagccatttttgctggcgccggtaaacgcccccggctggtagccgaagagctcggattcgatcagcgattccggaatggcggcacagttaatggcgacaaatttaccgctgcgccagcggctgtgccggtgcaacgtgcggctgacatactctttgccgctgccggtttctccttcaatgcacagggcgatgccggcgttgagcagccgcagcagcttttcgccttcgcgcggactggtaaaggggagatgcatggccggcggggcgcttaccgccacccggcggcgggtaggctcccgcaggcgatagtggtagcggccctgcggcgtggtcagcggcagcgggacgctgaccgccgtttgcgtcagcgtcggaaaaagcgaggcaaaggtgagctggccaaactgcgccgcgctcaggccgaactcgcgcatcgccagccggttgccggcggtgaggacgttgtcggaaaagaccagcagcagctcctcgacgctgtcgagtttgtccacctgccggtgcaggctcatcagccactgctcaggatgcagactctgtttcacccacagatattcaatttgctttgccgccgcttttacccagccaaaggtgtgctggtggggaaaattcgccgggccggagatatccagcaccccggcgatgcttccgtccggtcgctggagcggcatcgccgcgcagtacagattctggttgcgggtaagaaagtgctgacggccatcgatctcgcagccatcgtcaatcgccagcgcggtgccgatggcgttggtcccgcgcccgctttcactccacagattgccgggagccagcgccacgcgctgggccttttgcagcgcctgggtatcgccgagagtatgcagcaccaggccgtcggggtcggaaaggatcaccaccgactgcaggtctgcgacctggcgcgacagggcttccaccaccggctgcgccagatgctgcaggccgcggtggctggcgagccggtccgccagctcgccggcgccgaggcggggaaaatcctcggtggcgggatccagcccgtagcgctggcagcgagaccacgaatcgctcagcaggggattcgcattaacctctggtgcgagaagaaagggattgcctgccacagggcacctctgggtcgatgttgctgtgttgcaatattgtagccatttggtttatttggtgttgcgatttgcaacacataagtggaaacccgtgcgacagtggctgaccatctgctcggttagtgaaggcaacgtattaataaataaaaaatatttaaagaaaataaaaaactggcataacccctgcaaagtgagaagcgttcggcggcaaatttaaaaaatcaatatgccgctgcgtctcaaccctacagaaggagatttgcgatgcgttatgcacatcctggccagcccggcgccgtggtttcatttaaatcggcttacggcaactttattgacggtagatttgtcgagccgctgagcggtgaattctttatgaatacttcgccggtcgacggcagcaacattgcgcagtttccccgctcggatgccagagacattgacttcgccctcgacgccgcccatcgcgcggcgccggcgtggggtaaaacctcagtgcaacagcgctccaggctgctgctgcaggtcgccgatcgtattgaacagcatctggaatatctggcggtggcggagagctgggacaatgggaaaccgatccgcgaaaccctgaatgccgacctgccgctggcggtggatcattttcgctacttcgccggctgcctgcgcgctcaggagggaagcaccgccgagattgacgaaaccacggtggcctatcatttccatgaaccgctgggggtggtcgggcagattatcccgtggaacttcccgctgctgatggccgcgtggaagctggccccggccctggcggcggggaactgcgtggtgctcaaaccggcggaacagacgccgctaagcattaccctgctgctggagctgatcggcgatctgttcccggccggggtgcttaacgtggtgcagggtttcggcaaagaggcgggcgaggcgctggccaccagcaagcgtatcgccaagctggcgtttaccggctccacgccggtcgggcggcatattctcgcctgcgcggcggaaaatattatcccctgcaccgtcgagctgggggggaaatcgcccaacatctacttcgccgacgtgatggacggagaagaggaatttattgagaaggcggtggaggggctggtgctcggcttcttcaaccagggtgaggtctgtacctgcccgtcgcgggcgctgatccatgaatccatctatgagccctttatggcacgggtcatggagaaggtggcgcagatccgccgcggcgatccgttagataccgacaccatgatcggcgctcaggcttcccgccagcagttcgacaagatcctctcctatattcagattgcccgggaagagggtgggcaaattctgaccggaggcgagcgggcggctatcgcgccggcgctggataatggtttttatattcagcccacgctgattaaaggtcgcaacgatatgcgttccttccaggaggagatctttgggccggtgatcggggtgaccacctttaaggacgaagcggaagcgctggctatcgccaatgagacccagtttggtctcggcgccggggtgtggacgcgggataccaacctcgcctatcgcatgggtcgcggcattaaagccggtcgcgtgtggaccaactgctatcatgtctacccggcgcatgcggcgttcggcggctataaacagtccggcgtcgggcgggaaacgcacaagatggcgctggatgcctatcagcaaaccaaaaacctgctggtgagctacggcaccgcgccgctgggcctgttctgaagtccatctcatttctgaccgatcctcagtccgcaatccattcgggttgcggattttttttacttcaaaataaccatgtgaagatggtggctattttgccggcggcagcgcccatgtatttatgtcacttatgtattggctttcacttgaaaataaaaacacttccataataagggattagccggtggaggtggcgcaccctggcgtcgtttgtgtagaaattatgaatattaataccaggaaaattcctaatttttgtgtacgctctgacgagcgcacaataaaacaagacgaatttttgaacaattgtctttaaatttgttaattgaattgatctgttgttgtttaaaggtatttgaatttcttttgtatagatatgtaaattaacattgaaaagccatttcaaaaattaaatatatggcgaacatagctattaacttatagttaacatctccccgggttgccttttgatacttcgggtaatatatttatttcgcacatcaaaataactcttttttcttctgtttgttattcatggccatctattggcgaaataaggcagagtagagggggatgtgcctaatatcctgcggaaggaacgcaacgtacatttacagggaggagctgacgagccgtttcgcgatagctttggggctattgtcgatgatggaaaatatgttcgttaacgatgagataaataatgaaaaaacaacctcgctttataaccatcctcataggagcgctgctttctggcgtagccttgcaggctaccgcggccaacactatcaatcctgactcgggcaccagttcggaaggcgccggcgggcaggtcatcttcaatgggtcaatcaccgacagctcttgcaacgtcgatagtagttctaatggccagaaggttgatctgggcaaatgggccagcaactattttaccggcactggttttgaaaccaccaaaacccccttccatatcaaagtgaaagattgcccggccagcgtgactacggtcgccgtgctgtttgacggcgcgcgcgatcagtctgataactccctgctggccatcaacggcggcgccagcggcgtagcgattaagctgtatgagcacgatcggtcgacggctgtcagcctcggtaaaacgtcagccaaacagacggtcactccgggtaccagcggcggcaccggctctgccgacctcgagttttacgccgactatatctccaccgcggcgaccgtgacggcaggtaaagccgacggtacagctaatttcaatatgatttataactgatctaattgcgcgttattcagagtcagcccactgcgtcttgattaattacagatagctaatgtgttaattgtcacgaagtcacgaaatatattcgtgacggtatagttgtttttgctaattatcccgtcgagtactggctctgttattcactgctttattttgttgtctgttcaacttttacctgatggtaagtcatgatgaagaaaataattgccgttgcggcttttctgctgtgcaccacggcagcgcaggccggtattgtcatgggtggaacccgtgtgatttatcaggaagggaagcgtgaagccgctatttcagtcaccaatgccgatacccatacgccctatctggtgcagtcgtgggtggaaaattacgcggaaaacgataaggccagggtgcccttcattgtaacgccgcccttgttccgtctcgatccggagcaaaataacgttctgcggattaactttattggcgcctcgctgccccgcgaccgtgaatcggtcttctggctgaacgtcaaaagtatcgccccgacgcgtcagggcgaggtgaataagctgcaggtgaatattaaatcgaaattcaaaatcttctatcgccccaacgacctggcgggcgacccggcaaaggcctggcagcagctgaagtttagccagtccggcggtcggctgacggtgataaatcccactccctacttcgtctctttttacgccgtcgaagtgggcgggcaaagcatcgacgatcccggcatggtggctcccttcggcgagaaaacgtggccggtgagcgggcacggcaccgtcaaatggcgggcgattaacgactacggcggcgtcagcgatttcgcccagcagtaattcccctttttgatgagcttaccggacggcgccagcatgaaaagaataacaacagccagggtgcgggagtatgccttgttgcccgttaccgccgggcgggcggtggcgctggcgacggtgccgacgatgatgttttgtctcagtccgttgagccgggcgctggccgacgactattttgacccggcggcgctggagtttgctgacccgcagcagcaaacctccgatctgcactacttcgccaaacccggcggccagcagccggggacttatcctgtcaccgtggtggttaatgaccaggagctgggtcaggctgatatcacgtttgttgacgatggcgggcagctgcgcccggtgctgacgcccggtcagctggcggagtatggcgtcaacgtcagcgcgtttcccgcctttcaagcgctgcatgaaggcgaaaccttcacccggatcgagaagtttattcccgacgccagcagtcggttcagcttcgctaaccagcgcctgacgctgagtattccccaggcggcgatgaacgtgcaaagccgcggctatgtcgatccgtcgcgctgggacgatggcgtgccggccgcgtttgtcgattactatttttccggcgcgcaaataaagaacgccgacgaaggggagagcagccgctcaaactatctcaatttacgcagcggcctcaacctgggcgcctggcgactgcgcaacatctcctcaatgcagtatgaccagcagcgccggcactgggatacccagagcacctggctgcagcgcgatgtccgctcgctgaagagcttgctgcggatcggcgatacctataccaccggcgatgtgtttgacagcatacagtttcgcggcgtccagctgatgtctgacgatgaaatgctcccggacagccagcgcggctttgcccccaccattcgtggcgtggcgcacagcaatgccaaagtgaccgtctctcagcacgggtatgtgatctacgagacctttgtgtcgccgggggcgttcgccatcagcgatctctaccccacctcgcagagcggcgatctggaggtgaaggtgaccgagagcaatggcgcggtgcgtacctttacccagccctattccgcggtgccatatatgctgcgcgaagggcgcggcaaattcagtctcagcgccggccgctaccactccgggggggagtcggtgcgctcgccggaatttctgcagggcactttgttctacggtttgacggcgggattcaccctctacggtggtacgcagctggcccgggactatcaggcgtgggcgctgggcctgggccgcggttttggcgagttcggatcgctgggaggggatgtcacccaggccgtcacccgtacgccgtcgggcaagcgctatacgggccattcgctgcgcgctcagtatcagaaaaattttgtcagctcgggcactgcgttcagcctcgccagctatcgctactcgtcaagcggctattacgattttgccgaagccagcgcccttgaaagcgcccaggggcaagtagacaaccggcgtcgccgggaagagctgtcggtgtcgcaaagccttggtggcctgggcagtctggcggtttccgcctggtcgcaggagtactggcatcggcagagtcgggatgagacggtgcaccttgggttctacagcgcctggaaagggatctcctggggcgtgggctattactacacccgcgccagcggccagcaaaaaaatgaccgctcctggtcattcaatatcaatattccgctgggtggtccgctgtccgacagcgcggtgagctacaacaccacctcggacagcaatggctatacctcgcagcagatgtcgctgtatggcgcggtgccgacgcggccaaatctgttctactcggttcagcaaggttatggcaaccagggacgaggcagcaacagcagcgcctccctggactaccacggcggcttcggcaacgcccagatcggctatcgccatgacgccgccagcaaccagttgacctggggaggcgccggctcggtggtcgcgcatccgcacggcgtcaccttcggccagacggtgggtgagagcttcgccatcgtccgggcgccgggggccgccggcgtggcggtgcaaaacggcaacaatgtgcacaccgactggcgcggctatgccgtggtgccctctctgaccgcctaccggaaaaatgtcattaccctcgatacggagtcgatggccgacgacaccgacgtcgaccagcaggggcagaccgtgatccccggcggcggcgcggtggtgatggccaactaccagacccacattggcaaccgggtgctgtttaccctgcgtaatgcccaggggccgctaccgtttggcgccagtgcgcggctggtcgaggaggaggagagcggcaatccgccgggcggcatggtggccgacggcggccaggtgtatctcagcggtgtgccgcaggagggaaccctggcggtgagttggatcgtcaacaaccagtcgcagagctgcacgctgcattttcatcttccggataacccacagcagagtctgaatacggtgaaaaccgtctccggactgtgccaggcacgctgaggcggctatgaaatctgtttttcgtctacttcctttcctctttctgctggggctgagcgcctatcttcccggcgtgcgggctgaaacctgccgcgcaaatatcggccagaccacggtcaatattcctaatatcaagtatttacccacgctgccggtcaatacacagatgaccagcgcgatggcggataacggcagcgggatccctttttcctgcgacctgcagctgccgacggcgagcgccaaacgcatcgtctataagcagctgaaaaccggcggctcgccgatggtgattaacggacagcatgtctaccccagcgctatcgacggcattggttacgccctcagcttccagtgcgccggcggcccgatgcgtgccatcgatggcagccactccgccggcggcgagtcggtggtggtatgcgacagtgcgacgctcccggcgctgatgacgcagcagcaaaccacggtgaggattgcggtaaccttctataaaaccggaacggtgcaactggcggacgggacgcataccaactcgccgccgctgccgcaggtgggggagatgaccattgaacagcaggccagcgcaagcgccagctttgtcgccagcgcgccggtcagcatcgatatcgccgccctgaatgtggacattggcagcagcggcagctgccaggtagcgacatcgacgacccaggtcagtctgggtacggttaaccggggggagtttcatggcaaagggactaccggcggccaggcgaagcgcttttcgattccggtcttctgtccgacgccgaccgacgtgcgcatcggctttttcggcgtcagcgtggagagcgataccctggccctgagccaggccagcaacagcgccagcggcgtcggcgtgaagctgacctacggcaataaccccggtgcggcagtgcccgacggcaccagcgttaagatcaatgaggccagcaacttgccgatcctgaaaagggtgaccggcgccagcgccggtaccgccgaggcgatcaatttcaacgcccagtatgtgcagactgacgccacggtgggagccggtacggccaacagcatggtgactttcgccctggagtataactagcctggggcggcgttattcaaaggtcacggtgattttggcggtcgcggaaaaaggccccagcttcggcgttctcgacaaccagagcagccccgccgtataggtgctcgcgagggtcgcgcccgttgccagcgtaaagtgaatcggagcattcatctcaataaggggatgcatgctggcgtttggcgagatggcaatgccgaagccgctgtccggctgcggcaaaataatggcgctctcctgtatcgtattagtggtgctaaacgtagcaagcataggttcggtcccgcaatcactgccgttaccctgcttgaccagaccataggtgacggtaaaggggcgtgttttttcatagtagcccggtcgggcgttaccggcaggaatatcgccaaagttaatttcgcttggcgaaatagataccgtggggacgcaggccattgttcggatacggttcaggccggtaatgaaaagattatagttggcgccagcggtgccgttgcgtagaccgccttggccatctacctgaaaaagcgacaattttaggttatcgtctattttaccttccccggtcactctgcggcccgtcgagatgatatagacctggtaaaccaggctgaatgtctgcccaatggccggggacttacaggtattcccgcttttatcacacagcgtcgccgggccaatctccaccgattttttattttgtagcagatagtcgatgccgttgtaagtaatgcctacctggataaagtcgggcaagctgctggctttattttccggatccagccagaaataggcgctttcaccgttcggaaaattatcggtatcttcgcaactgaaggtggcggtaatagggctggagacccatatctttttattggcaataagctcgctgctggagactttaatgatgctctcgatattcacgacttcgctgatcgtggacgaggtggtcttgcaggtcagcgcctgcgccgggaaggcgctcagcatgaacagaacggaaagccatgtcagaaataacgtatcgctaagtcggcgcataattacctcgagggggttactgtgcagattaaggataattcacgccaggccgtcgcctgctgaggctcctggcgcagttcgggcagggtgatttcgcagctttgctggtgcgtttcgccccatttcatctgcagcttttcgcctgaatcgactccgctgacgtaaacttctcctcccgggccgaccagaccattgctgatcccactggcgcgatagagctgtgcgcccaatggtggatagctgccgtcggcgagggtggtatggatcagcacgctatatccccggaatgtatcaaagcgcacccgggtgattgccccgcgggtaggcacggtatccgctaccgcgttagggacatcaagaaaggtatcgaagtcctgagggttgagcacgacagaattgacccgatagggaacgctttgtggtacgacagcgtagccgaagggatcgatgcgcacgccggtctgattctctatccctaccccctgagcgtctttggcctccactagcgcaaaggttgagcccagcggttgcgagagggtaacgccgccgcggtgcgccaccacgccgccgctcagattcagactcgcctgacgatggcttttgctgtaggcgtagccagtatacagattaccgtactggccgagataacccaggctggcgctgttggtgctaaggctggtgtcatcataggcgctggtgacggcccagctcaggcgaccatcatcgagcagcgtgccgtttaccccagcctgcccggacgtgccagacgatttactgtgggcgagggtaaatgcggtattgatccggcgatcttcttgcagagtaaaagggatggaaacgcgcagtgttatgctattgtcgtcatgggtgaagtggctgcgcgtattctgatagtacagaccatagttcacgttatggatagtgctgttaaagcccgcctgcagcgagatatcgcttcctgagctattccagtaattttgctggctgaagttaaggaagaaagcgctgttcttaccgagagtttgccgggcagaaatatcaaagcgatgctttttattataaaaccaggacgtgtaatagtgttggggagcgcttgcctgccagctttcgtcttcgtcagagggccagtaatcattttcgtacaggccattgtgccagcgtcgacgctcgttaaccgcatcgctgaggctataataacctgcggttgagtaacggtagcccgcgatttgaaagtcggtcttgctcgacaaaaaggatttagcatacagaaaacgcacgctccctccctgcttgcgctggccattcgccagcgtcgttcccgccagcgtatagtcggctgagagggcgccaatctcccccagattgctaccgacgccaaaggcgccggcgcgatagttctccgctgcaagggcgccaccgtacagtgtgaaggtattattcaggccataagagagcgagctttgcatcagggcgggggcatagccgtcagcgccgtcatgatacttacccgccgacagctgataattccattggcctgcccgcaccagctgtggcagggtggtgtaggcgacagtaaaggtcgtctggctaccgtcggcttcaatgacggttacgtagaaatcaccgctgcggttaacggcgctgatatcatttagctcaaagggaccggctgggacgttctcgctgtaaatcagatagttgttctgccgaacttccacccgggcattgctgttggccacaccgcgaatgaccggcgcgaagccggtctggctgctggggcgcatttcggcatcggtgccaagctgtacgccgcgaaactggacgctatcgaagacgctgttgtcggtactggtctggccgacgacaagccggctgcgccagggaatgatgttcgtttccgcccaactggcgatgctttgccacttatccgcctggccgctgaacttattccagtaggcattattgcgcaatcgccacgatgcaatattgatcccgctgtttagcgaaagatattgatactggtggctgcccccgtcgccattattggcatcggtagaatagctgtagttgacgaaagcagcgttaataccttcatcaaagcgcatgggggaaacatagtcacggggatagtgctcgatatattgctgagggatatgaatgatcagctgatgattagcgatatccagctgttgctctgcctggcggatcgtctgcgacagcgcgaaacagggctggtggtcatcgtcaatcttgacgccatagcggatatattccgccgcgctcaggcagggggccaacccgccatgtgcgctatcctctgagaagcgaacggggcggctatccaccagcagatcgttaatgtaaatattaacgtcataggtgcccggcatgacgtcgccatcgctggcgacaaactgattaaaagccagcgggtcgatgccgttcacaaactgggcattatagcgttccgtgctgtctgccggtaacgtgatggagattaaccatgcgctggcaaaatagcgtaatttactatcgtccatcactctatctccctaaagaggtgcgacgtttatttttttattggaatatcaacaacggcgccgtaatcattaatatatttcattttatgcaagcgctgcatgctggcgatattgacagcgtgatgactgtacggcagcaacataaagtttttcagaggatagattttgcctttgttgtcgatcgcctcggcattaataaccgtaatatgcagtggactgttgttagtaaaagataacgtgttagcgctttgctgccactgcagattttcaacggctttgggcagcgatgtggcaatcccttgcgggcgataaaatagttttaatcgggtgcgaatcgcgaactgcaggatattattttcctcaggcgcaggagggacctcctgaatattcacccaaaacagactttccctgtcggcaggaagaccggttcctgagtaaataaagcgcagttgtgccgattgctcggggcgtaatttgaccaggggcggcgttgccacaatgggtaagccgctgctgggggtctccggacccgtatcaagctaggtctggacgatatagtttttgctgcttcggttgttaattttcagactggccgatttatctttgcccgaataaataacccgtgaggcatcgatggtaatggccgcctgggtctgaaaagccaaagcgcctatgatcactgccagcagcgttttcatatcttaccccttatccgcgtcgtgccgtccctggccaggcattattgctgtataatggtaaaccgggcggtcgcattgccgtcgccagcttcggcgttgtctttatcccaggtgtagtaataggctttcaggttgaaggtaccggtgccatcggcattgatcgtaatactcgggtcgacgtcgggatcgaaaggtttatcgagcgtgaccggggtgttattgcggtcggttagcttaatgccgactttttctgccgtaggattacccgcatcgagagccagtatgttagtgctaggcgcatcgagggctggagcaccgtcgagcacaataaagtacgtgcccgcgtcacaatttttgacgctaatattgaccccaacttctggcccggtgccattggtatcattttttaatttagacagcggaacagagcccatcttaactacaatgacaccgttctcattgtcgcttactagcgtgcaagatgagttgacaattttaccgataaaattcagcgtaccgtccgccgcggcggcatagtgtgaggtcaagccgacgagtgccattgccaggcaaagtgatttcattttcatagccaattccttctgttgtgacccagggaagctaatagccaggcatactcattgacgctgcataagccgttagctctgttgttgtgatagccataaagcgaacttatccctcctccagggagtgcaggaaatgatacaggcctgcaatattgcggacattaagtttctggtagatgtttctccgatagtgactgatcatcatattgctaaggtcggtggcctgagcaattttcttattatttaaacctgagatgatataggggagaagagagtcctcctgtttcgtaagtttaatattgacacaactgtccagcgagctaattgattttctgaacactttaatacagcgatgatcagacgcattctgtaagtatttctgcagccgttgggtaacatctatataatcaagcacgatcgtcgaaatagagtttatgataatgttttcgactggatcggcaagaatctcacttttaacgacaaaaacgatatcgccatgaatgatcttttttttacgatagagcagtgcggctaattgttgaatgtccgggtggctatagtccacgataatggttctggctatggttagacttttatcattcacgtcagaaatattatccagaaacaatgtttgactataccgacgttgagcactcatggtcatgttaaccagagaccggatgccgttaataaaaaatttattggcggaaatgataataatcataatgtatttccttatacactgcttctgtaaccaagtattactgctggagaggaggggagtaaataagatgataagcaggatcattagaaaaatcctaatgaaagatgttgcatgaagtgtttttacttattaatcaggaggttataatttaagattcaactattaacgcataagaggaaagtaaaataaacgataataaataatatattaaacgtatggccaggaataaaatatgaatgcgctgcggggcattttactgaaagtcaaaacaaccagcaagcttacagcgagaaagaggattaattaacgttttgccccacgtcgggttgtatgtcccggtgtttaaaaataggatgaatgccctggctcgcgcggcggatactgtgactgatgcggccggtcactctggcatgaaaaacgataactttaaggatggcgaaatgagactgacggtggggctggcgctgacgctggcgataatgacctgcggcgcccaggcgcgcgatatgcaatccatcgagcacagcggtgaactgaaggtgggcgtgccgggcgattacgcgccgctggcgtttcgcaatgccgccggcgaactgcagggctatgacgtggacatggcccgcgatctcgggcgcacgctcggactcaaggtgagcttcgtctacaccagctggcccgcgctcgccgccgatctgcaggcggacaagtttgatattgcgatgggtggggttaccgagaccccggcgcgggcgcaagccttcgccctcagccatccggtggtggcgaacggaaaaatcgccttagccaactgccaggccgccccgcggctcggttcgctggaaaaaattgaccgtccggacgtgaaagtgatcgtcaaccctggcggcacaaaccagagttttgtcgatgaacacatcaagcaggcgcaaattattcgcgtgcagaacaatgtcgataacctgcaggcgctgcggcagaaaacggccgatatgatggtgaccgatctgattgaaggcgactattaccagagcaaagagcccggcgtgttctgcgttgctaacgaaacaccgttcgccggtaccgccagcaacaaggtgtatatgatgagtaaagataacccggcgctgctgaagaaagtgaatcagtggctggatagccaggacaaagaggttctcaaacggaagtggaaaattcgcggttaaccgcggcggcgcgccaccgccggcagacacgcccggcggtggctatcgtctacgattagcgctgcggcgacagcgcctgtcgcgccagaccgcgaaagtagcaggcgtagcccagggtggcggtcaggcacagcatatagccaaacgactcgctgccttcctcgaccgtattttttaccacccgggcgtagttctcttccagcacggcgtaccacaggccgtgcatgccaaacagccgcgagaagaccagaatcgccagcaggccgctaatcatcatcccgtaatacggggtgcgggtatactccgccagctgcgacagggtctgacgcagatggcgcaacggcaacagcagcgaccccgcggtggccagcagggcaaaccacacccagctgccgtgggagagtaaatcaaacaggccatccagctcacggatcagcatggcgagaaagaagccgccgatgaggatattgctatagcgcaagtgggcatatttccgcgccagcagcagatgaaccagcacgataacggccagcacgctctcctggaccacttcggtgagcgacacctccgggatgtcgttgccaaacacccgaatatccacccacaggcagagtaccgcgagggcggccgcgaccgccgcgccgaaaaagaaaagcaagcttcgtaacagagacattaacaccacaacttatgcttaaaacaaatatcataagttctgggaatacatgttcctgttcactttgtgcgactttgccgcgtttttttaacattttgcgctttttagcgcccgggaaggcggcaggggagggggctcccctgcataaaggggattcagagaatatcatccaccacgccgccatcgacgcgcagcgcggcgccggaggtggctgacgcctgcggcgagcagacgtagaccaccatattggcgacctctgccaccgaggccgcccgctggatcaccgagctcggacgatgggtcatgacaaacgctttcgccagttcctccagcgactgaccggttttcgccacttcgtctttcagcatttcggcaaagccgtcggaaatcgttggccctggcagaacgctgttaacggtcactccgctgccggcgacatatttcgccaggccgcgggccagcgagagctgcgcggtcttggtgacgccatagtggatcatgtccgccgggatattgcgcgccgattccgaggagataaacaccacccgcccccagcctttgctgaccatcgccgggagcagcccccgcgacaggcgcacgccggacatgacgttggtctgccagtagttgtcccaggtcgcgtcgtcggtggcgtagaaatcctgcgggccatagatcccggcgttattgaccagaatatcgacgccggtcacggcccgcagcagctgcgctgcgccgtcggcgtcgctgaggtcggcgatggcgggacgcgccttcgcgcccggcacctcattttgcagccgggcgatcgcggcgttcacgctctgctcgctgcgcccgttaaggatgacctctgcgccgctctccgccaggcctttggcgatggcgaagccaatacccgccgtggaggcggtgaccagcgcgacttttcccgctaaatcaatcttcatgttcatgccttctggttgtggatctcctattaagcgtagcagcggcgatatagccggggatcagtaaccggcgtgcttattgaccaggtttttcagcggcagcccgcggcgctggcgctgaatgttctccagcagctggcgggcgatcacctcggcagaggccgcagatgccatatgtggggtgatgaccacctgcggatggcgccacagcggctcgtccgccggcaatggctcctgcgggaagacgtcgagcaccgccccggcgagctggccgctctccagcgccgccagcacatcctcattgaccatatgctctccgcggccgcagttgattaacaccgccccggcggggagccggctgaacagcggcgcggcgaggataccccgggtctgcgcggtgagcggcaggaggttaatcagcccgtcaagcgacccaagaaagtggtcgagcgcctcctcgccgcgatagcaggtgacgccagccagctgcttttcactgcgcgaccagccggagacccgatagccgaggcgggccagctggtcggcgatatagccgccaatttcgccgagccccataatgccgatatggaagtcggcggcggcgcgctggggatagagcttccaggtttgggtccgctggtgggccagcgcccggtcgaaatggcgctgaaaccacaggacgctccacagggcatattcgaacatgccgtggcgaaaatcttcatcgatcacccggcacagcgggatctcgctggcgaacagcgcgggcggcagatgatcgaccccggcggacgcggcctggatcagcttcagccccggcgaacgggtcaacagctgcgggtccgggaaccagcagctggcgtactgggcgtcgcgcgccgtctggtgatggggcagaagcgccgtgacgtcgggaaactgctgcagggcggcgcagatatcgcgggcgaaatccgcgtcgttacaatccaccacgatagtgatatcagacataggcgttagtctttgtaagaggtatcgagacggtcaagacggcgcagccacgcctgccagacctgttgacgttcatgctccacgcccatcagctgctcgcaggcgtgctggctaaggtgcggggcgatggtgtggatcgggctgagggccgccagctgggcggcggccatctggatctcgcaggcgcggttcaggtagtacatgatgtaaaacgcgtcagccacggtgcggcccaccgacagcaggccgtggctctgcaggatcatagcgatattattccccagcgagcgctggatgcgcgcccgttcgtcgaggtcaaaggccaccccttcatagggatggtagccgacgcgctggtaaaactcggtgctgatctggttgagctgcagcaggccatcctcgcaggcggccaccgccatccccggcagcgtatgggtgtggatcacgcagtgggcgtcttcccgggccatatgcaccgcgctatggatggtaaagcccgccgagttagccggcgcgtcgcccgctacgaccttgccctgcatatccactacgatcaggttgctggcggtgacttcgtcaaacatcatgccgaagggattaattaaaaaacgcggctcgccgtcgccgggcaggcgcacggagaagtgagtgtagagggtatcctcccagccgaacagcgccgccagccggtaggcggcggccagctgctggcgcaggtgttgctcagttgccatttagcgtactcccataaattcacggattcgttgcagagaaggcgcctccagcgggctgcggatcacctgcggggcgatatcggcctgcaccacgccgttctccatcagcaccacgcggtcggaaatcgacagggcgaagtccatctcgtgagtgacaatcaacatggtcatgccttcgcgggccagcgactgaatgaccttcagcacttcgcctaccagctcgggatccagcgccgaggtcggttcgtcaaacagcataatgtccggcttcagcgccagcgcccgggcgatcgccacgcgctgctgctggccgccggagagctgtccggggtacttgtgggcatgggccagcaggccgacgcggtcgagcagcgccagggcctgctcgcgggcgaccggctggtccagcagctggtgatagcgcggggccagcatcacgttgtcgagcaccgtgcggtgggggaacaggttgaagctctggaagaccatgccgatgcgccgtaccccggcgcgcatctggcgtttgtcgacgatggctccgcccttaagatagtcctcgccgtagagaatgatctccccgccatcaaggctttcgagggcgttgatggtgcggatcagggtggttttgccggagccggacgggccgatgatgctgatcacctccccgttctccacctgcagatcgatgcctttcagcacctcatgctgcccccaggatttgcgaatgccccgcagatcgagcgctggcggcgcgccgttgacggccggcgttttgatctcttccgtcagcgccggcaggctctggcgcagcgcctggcattccgcctcgctgagggtttgcggacgcttacgctgaatatcgagacgattttccagcgcccggaacagccaggtgaagacggtaaccaccatcacgtagtacaccgctaccgccagcagggtctccatcacaaggaaattctgcgcatacaagcgctggccggtgagcagcagctcgggtaaggagaccaccgacagaatcgagctcagcttaatgatggtgatgtattcattgatcagcgtcggcagcgagatgcgaaacgcctgagggatcacaatcagccgctggatgccgataaagctgaagctcagcgcatggcctgcctcgctctgccccttggccaccgacagcagcccgccgcggtggatctccgccatataggccgcctcggtgacggtcatcgacaccagcccggcgataaacggcaccccgagcagcggctgggtcaccggaaacagctgcggcaggttgtagacaaacaccagcagcaccatcagcggcacgctgcgaaaaaaccagatatagagttcgacggggatcttgacccagcgcggcgccgagagcttcgcgcaggctaacagaaaaccgactaccaggccgataccccaggacaaggtgctgattacgatgacggtcacgcacgcctgccagaatgccccaatgctaaacaatgaaaaaaagtatccccaatcgaacgccatactgactcctgttgcgcagtgcttattgtcttaatcgatgctttctaagttgtattttttgatcaacgcggcatattggccgttggccttcagcgtggccagggtggccttgatcgcctccgccagctcggtgttgcctttggcgacgtagatccccagcggcagcgggtagaccaggcgcgtagagcttatcgccaggcggccgcggctcttgtcgacaatgatctgcgccgccggggcaatctcaagctgggcgccgatgttcttcgacagcagcgcctgggaggcttccggcgccgtcgggaactcctgaatggtgatggccggtttgccgtttttcaggcaccactcatcggagtgttttttcaggctggtcacccaggtggtgcccgcctgcagaccgaccttcacgccgcacagctcatcttcggttttcggctgcaccgcgccgcccttcagggcgatgatcgacgcgccggagagggcgtaagggatggcgtcggcctgcttctggcgctccggcgtcacgtacatcccggagatcaccgcgtcatatttcttgccgatgccgaggatcaggctggtgaacttggtgtcgatcagctgcggtttggcctgcagatgttgggcgatcagcgcggcaaactccgggtcgagaccgacgatgttgttattgctgtcataggactcaaacggcgggtaggtgacctccatccccaccttaaagacgccctcggtcagcagttccgccgcctgggtgacaggggagaaacaggcgctgacggcgagggtaagcgcgacacggcgcgagatttttttcagggtgctagtcatcatggatcctcacgggtggttagggttttttttgctgagcctgttttttcaaatggccaaacgtattggtgccgcgcgcgcgctccggtagctgaagttcaccgcgattgaccttctcgcgcaggtagcgataggtttgcagggcctggctccacatatgctccccgatgctgagctcctgatattcaccggcttcgccggcggcgagaaaggtcggcagcgggcggatcagcgtgtggtaatcgcaggcgaaaaacagcgggaaggagtaccgctcctgcggcactttgcgcacccggtgggctgtagcaacaaatgtgccagcgctgagcacttccagcatgtcgccgatattgatcacgaacgcctcttctccggcggcgtttttgacgggaggtgcatcgatccacacgctttcttcattgagaacttcaaggccgggctggtcggcgagcagcagggtgaagcactcatagtcggtgtgtgcaccaattccgggaacatcttcgacgctggcgtcgaacgggtaatggatcagccgcagcttagccggcgggcaggtcaccatcggtttgaaatacccttccggcaggccgagcgcgagggcgaaagcgtcgaacagacggtggccgagggcgaaaaccgcgtcgtagtaggccagcacccgcgcgcggaaatccggcagatcgggccactcgttggcgccgatcagcggcgtaccggcgagcaccagcggatggtcatccgctgcctggaagccgatatcgaaagcctctttatggtccggcttgccggagccgtagatctcttctccttccggaacgtagcccttatggcttttggagtggccgatgtaatagttcatcttctcctccatcggcagggcgaagatctgcttcgccgcctcgcggacgccggcgatcagcgccgggtcgatgccgtggccggtgatgtagaaaaagcccacctcgcgcgccgcgcggccgatggcgtcggccaccgcctgacgcctggcgaggtcatcgccggccagatcgcggatatcgatggtcgggagttcagtaaaagcgtgcttcacggcgatcatggctgcggttcctgttcagtgagcgataaaaactgctgaaagtgggcctgctggcgcgtggccatccaggcgttgagcgaccagagatcggccaccggaacgttggtgaacggcagatggtgcagatagccgtcggcgccaaactccggggtcagcgtggtctgcgggtagccgcgctggcgctgcgaacgccagatttgctgccagaagcgctcggcaaaagccagcgccggctgatactcaggcgccgccgggtgcggcacctgcggcccctggtcgtagcccacccgagcctgcacgtgatgcacgcggtcgataaaggcgctgaagtcatcgctggggtcatccagcaggcgctcgctgaccaccacccagtggctgatgtcggcggtaaagcgcagctgggggagctgctgaatgatctccagggtgagccacgggctgtacagcgaggtggcgcgatgggtttcaaagctgcaggtcaaaccaaacccggcggccagctcgtgcgccttgccgagaaaatcgacttgctgcgccagcggccagcgatcgttgcccgcgagcagattgacaaagcgcgggttgaggccgctggcctcggcgaaacgggtctgcaggcgcgccagatgctgctcgggcgtttcatgctgggcggggagcaccccgccgccgctgaaaagaatggcgatatactccagccccgacgcctgcaggcggtcggcgagctgccgccgctcggctaccgttaacggcacgcgggcttcgataccgcagcagccgacgcgctgcagttcatccagcgtttgcggccagggggtcgtcactccccagagggtgcgaaagcatttcagctccatggcggcttcctcaggcgtacttcacgccgggcaggacgcagagcatctcgtacagcaggttggccgccagctgggaggtattaccgctcacgtcgtaggggggcgagacctcgaccagatcggcgccaatcagattcaggccgcggcagccgcggacgatctccagcgcctgaatggaggtcagaccgccaacttccggcgtcccggttcccggagcccagatgggatcgaggctgtcgatatcaaagctgagatacaccggcccgtcgcccatctgctggcggacttcggccatcagcggcgccagcgaggtatgccagcactgctccgcctgcaccaggcgaaagccctggtcaacgccccactggaagtcgccggcggcatagccctgggcgcgctggccaatctgcaccacccgtttgaggtcgagcagtccctcctcaacggcgcggcggaaggtggtgccgtgggcgattttctctccgaacatctcatcattggtgtcggtatgggcgtcgacgtggatgaggcccaccggaccatgttttttggtcagcgcccgcaggatcggcagggtaatggtgtggtccccgccgagggtcagcgggatcagcggataactattcaaaccggtgtagtaatcttcgataatttgcaccgatttgagcaggctgtaggtattgatcggcacatcgccgatatcagccaccgacagcgagtcgaacggcgcggcgccggtcgccatattgtacggacggatcatcaccgattcggcgcgaatatagcgtggtccgtagcgcgtgcccgagcgctgcgaggtgccgatatccagcggaatgccgacaaatgccgcgtcaagtccctgtaaatcttcgataaacggcaggcgcatcattgtggcgcgtccggcgaagcgtggcatctcattgccaccctgcggttggtgaaagaggttatccatgtctgctcctgaatctgacggatgaaacgtaacaggagagatagtgcgcaacccgcgctggactttacatcgtctggcgtaaatactcagttcatttattggtgaactaaatacgatgcatcacgacgccagcctcaatattcgccagctgcaggttttcgaggcggtggcccgcctggagagctacagccgggcccagcaggagctgggtatttcggtctccgccatcagcaatgccatgtcgcagctggagggacagctcggcttcaccctctgccagcgcgggcgcggcggcttttctctgaccgagaaaggtcagcagtttttacagcaggcgatccgcgtactgagcgaactcaatgagctggagcggcagtcggcgctgctcaaaggggagcacagcggcaccctgtgcatctcgacgctcgactccatcgagaccgaaacggcgctctcgctgccggtggttctgcgcagcttcagcgacaaatttccccatgtgcatatcaaactgattatccgcaccccggcggagcaactgaacggcgtgctgaacaaccatatcgacctggctatcggcagctacaactcgcaggtgcataacatcatcagcgagccgctgtaccgtgaacagcactggctctactgcagcgatctgcacccgatgttcttcagccgccagctcgataaagagcagatcagccagtgcccgctggtgacccgcagctactggaacaccagcgatctccgccgtcggggcttcagcaaagggagcgccaccgtcgagaccgtcgacgcccagctgctgctgatcctctcggggaaatatattggctatctgccggagcattacgcctggccgtggatcaaagagaaccgcctgcgggtgctgctgcccaacgagtttggctttcagtcgccgttctcggccatctgtaagcgcgggcgcagcaatgagccctacctgaaagcgttccgcgacctgctgaagaaaaacacggtggcgcggccgaagtggaattattaagcggggcgggcgcttccctgtgccggggtggtgattttcgcgcttagcgcgctgcccggcgggggagttttccctgttcaaaaaacgaacggctgccggtagcccgcccgggctgcggctgccaggcaactgcctccaggttatccacagggttaggcgccgctggtgtggacaggtcgcggggcgacagggcgcggctagcggaacaaaggatggcgtttgcgttaaataaaacggtacgaaggggaatctgtgtttgccccgcctttgcccgtgaaatcagaaaatttacttcgcaggctaaccgcagattgcttcaaaaaaattcccgtatttgttatattgttgttcattgattattcacctctgcggtgccaaaaagaacaagattcaccgcaacccaggacactgccatgttagattaccgcttcccgacagctttgcagatggttctcagcgtagcaatggcggagcagatgggtgaacgttcgacgagtgcgattctggcctacggcctggaagcgaacccgagctttatccgtaaactaatggttccgctaactcgtgacggcattatcgtctccacgcttggccgcaacggctcaattcatcttggccgtccggcggacaagatcaccctgcgtgatatctatctttcggttatcgaagataaaaaactgtgggcgtcgcgtcctgacgtcccggcccgctgcgtggtcagcgccaacgcctgctggtacttcaaatcggttgccgacgaagcagagcaggcttcgttaaacgtcctcgctcgccataccgtggccagcgcgctggaggcggtcaaaaacgccgataccagcggctgcgacccggtgccggaaatgatcgcccgctttaaaaaagcgcattaatcgttttctggtgacgaaaaaaaaccgccttcaacttgtgaaggcggtttttttgttatctgctgcaggctaggcgggcagatcctcctggaccggcttcctgcgggtcaccagttttcgcagcgtcacgtaaaacaccggcgtcaggaacagaccgaagagcgtcacgcccagcatcccggagaacaccgtgatcccggtgacgccgcggacttccgcccccgcgccgtggccgaggatcagcggaatggtcccggcgataaaggcgatggaggtcatcacgatcgggcgcagacgcaggcggcatgcctccagcgcggcttccatgatgcctttcccctggatctccagctcgcgggcaaactcgacgatcagaatggcgtttttacaggccagacccatcaggaccaccagccccacctgcacgaagacgttgttatcgcccccggtcagccagacaccaaacagcgcggagagcatcgtcatcggcacgataaggatcactgccagcggcagggtccagctttcatacagcgcggccagcacgaggaacgccagcagcaccgccaccgggaagacgatcagcgccgtgttgccctgggtggcctgctggaagctgagatccgtccactcaatattcatcccattcggcaggatctgcttcgacagctcctccagatgcgtcatcgcctgcgaagaagagaggacccgcggatcggcatcgccaatcaggtccgccgccggataaccgttgtagcggatcaccggatccggcccgtaggtggtactgatattcaccatactgccgatcggcaccatttcgccctgattattacgggtgcgcagattggcgatatcttccacgctctcgcggtatggtccgtcagcctgggccatcacgcgccaggtacgcccgaactggttaaagtcattgacataagacgagccgagataggtctgcagcgtaccgaatagctcggttagcgataccccctgcgctttcgccttatcgcgatcgacctgcacgtccagctgcggcacgttagcctggtaagtcgagatcgggaagtgcatccccggcgtctgcataatcgccccagacatcgcattcaccgcgctttgcagcgcgccatagcccagcccaccgcgatcctggatgtacagggagtagccggaaccctgacccagtcctaaaatcggcggcggcaggatggagaagccaaagccctgctggatttgcgcgattttggcgttgatctccgcgttaatttccgccgccgtgtgtttgcgctggtcgaacggtttcaggccaaaaaagaccgtcccggtattcggcgtgttggtgaactgcagcgcgttaagccccgggaaagcgaccgcatagtcgaccccttcggtattcatcccgatctcgctcattttgcggatcaccgcgtcggtgcgcgccagcgacgacccttccggcatcttcacgccgccaatgagatacagcttatcctgggtgggaataaacccgcccgggacgactttaaacatcaccccagcggcgcagagcagcagcagatacaccgcaaacaccgcgccacggcgtccgagggttttgctcaccagcccctgatagccgttcgagctgcgcaggaaaaagcggttaaacggacggaaaatccagccaaacagacgatcgatcagccgggtagggaggtctttcttcgcgccgtgcggctttaacagcagggccgccagcgccggggagagcgtcagcgagttgatggccgagatcaccgtcgagatggcgatggtcaccgcgaactgtttgtagaactggccggtgaccccggagagaaacgccatcggcacgaacaccgcacacagcaccagcgcaatggcgataatcggcccggagacctcacgcatcgcctgatgcgccgcggcaagcggcgcaagcccctcttcgatattacgctcgacgttctccaccaccacgatggcgtcgtccaccacgataccgatagccagtaccagcccgaacaggctcagggtattcagcgagaagcccagcagatagagaatgctgaaggtacccaccaccgataccggcaccgcgatcagcgggataatcgacgcgcgccaggtctgcaggaacaggatcactaccagcaccaccagcactaccgcctccagcagcgtctgcaccaccgcgcggatggagtcgcggacgaaaaccgtcgggtcgtacggcgccgcccattgcatatcttccgggaagcgggtggccagctcggccattttggcgcgtaccgcgttcgacagatcgatggcgttagcgccgggtgactggaagataccgatcccgaccgcatccttattgttgagctgggagcgcagcgcatagctaccggaacccatctcgatgcgcgccacgtcgcgcaggcggaccagcgagccatcctgcgccgttttcagaatgatattgccaaactcttcttcggtatgcagacggccctgggcgttaatggagatcaggaaatcgctctcctgcggcagcggctcggcgccaagctgtccggcagacacctggacgttttgctcctgcatcgccgtcaccacatccgaggccgtcagaccgcgggccgcgaccttattgggatccagccagacgcgcatcgcatattcaccggagccaaaaatctggatctggccgacgccgggcaggcgcgccagctcatccttcactttcagcgtggcgtagttgcgcatatacagcgagtcgtacttaccgtttggcgaaaacagatgcaccaccagggtcagcgtcggagactgcttctgggtggtgatccccagacggcgtacatcctccggcagacgcgcttccgcctgcgcgacgcggttctgcacctgaacctgcgcctgatccgggtcggtacccgggcggaaggtgacggtggtgaccagcacgccgtcggagccggcgaccgatttcatgtacatcatgttttcaacgccgttgatcgcttcctccagcggcgtcgccacggtctcggcaatcactttcgggttggcgccgggatactccgcgcgcacctggacgctcggcgggacgacatccggatattcgctcaccggcagcagcgggatagcgattaacccggtgataaaaattaaaatcgacagcaccgcggcgaaaatcggcctgtcgataaaaaagcgggaaaagtccatgtcttggattctctgattagggatcagttaagggtggcgctggaggtcatggcaacggttttggcgttaaccggcatacccggcataaacactttttgtaagccgtcgacgatgacgctatccccaggattcaaccccttctgaacgatgcgtaaaccgtctgccagccgccctggggtaatgtcgcggcgctgtgctttaccatctttatcaacgatatagacgtatttacgatcctgatcggtcagtaccgctttgtcgtcgatcagcgtggctttgaactctgcgctgcccggcagacgcacgcgggcaaacagccccggtgtgaacagacgcggcgagttatccagcagcgcacgcatgcggatggtgccggtactcggcgttaactgattatcgagaaaatccactttgccctggtgggggtaaccctcctcgccaaccaggccaatctccaccgggagcgcctgattatcgctggacgcgccttgcccgcggcgggcgaggttttgatagtggaggtaggttgactcgtcgacgtcaaagtagacgtacaccgtcttctgcgagaccagggtggtgagcacgctggcggtgtcgcccgcggtgaccaggttaccgctggtgatcagcgcccggctggcgcggccgtcaataggggcggtcactttggtgaagtcgaggttaagctgcgcggcatccaccgccgcctgcgcggcgcgaatgtcggcctgcgcctgaaccgcggctgaccggcgctgctcccactcttcacgggagacgaggttggtatggactaatttatcggtgcggttcgcctcgctttgcgccaggctggcctgcgttttggctcttgccaacgccgcctgcgcctgctccagcgcggcgcgataggttctgtcatctatcgtgaacagcacctggccctttttcacctcctggccgtcggtgtaattcactttatcaatgtatcccgagacgcgagggcgaagctgaacgctctccaccgcttcaatgcgaccgttaaaactatcccactgactgatcgacttcaccagcaccttagcggcgctgaccgtcggggcgggaggcgcagcattctgcgcgacgctgtcgtcgcagccgacgagcagaaaggagagcatcatcgcgccgagcgcggtcaggtgaatgtttccccaggttttttgcaggctcattatttttattccggtaaatgtagccgccgggcaagacgcagcgtgagaagccgcgccacttcctttgtccgggctggcttaaggccatttgtgtcgatcatcgccacaaaactgtaacaatttcgaatacactatcgcggcgattgtaggaaggcacttaactaagtgcaagaataattgttgcactttatgtgcggtccagggggagataaaaaaccgcgatcccggcgtggatttaaatgtaacaataaaacttgcattttgtgtaaaaacaggccacctttaaatgcaactgacaaagatgcttttaaccggccgcgagggggtaacatgatgaacactggcgccatcattcaggatctgatcgactggatcgacaaccatcttgatagccgtctggatattgacaccgttgcccgacgagccggctattcgaagtggcacctgcagcggatcttcaaagaacataccgggcatcccctcggagaatatattcgggcgaaaaagctgcaaaagtcgatcgaacgcttggcccacagcaacgagccgatcctgaacgtggcgattgccctcggctttgactcccagcagtccttcaaccgcagcttcaagcgccagtacggccaggcgcccggcgtctggcgccggagtatcagccgctctgttgcgcagacatctcgtcagcgatccgcatgaccggggagggtcagtcctggcccggcccatgatcgaatttgctgcctttgccgatggcatagaactgcccgcctgcgacatagtgaacggtccgtagctcgtccggcgcatcatcaaaaatccagtgtccgttgcggaatacccggtcatcgctccaggcggcgacgatatcgcccataaacagattgtgttgctgctgaatgtccgggtagggcatcactttgcacaccagccagcccgcacagcctgccacaagaggaagatcaaattccggctgataaaagaaggggatggtgtcatttttatccggcgcgtcggcatagctgcgcccgccagcgtagaggacggttgccatctggctgactacggggatctgcaccacgaaatagccgctcttttccaccagctgacgagtgaaagcctgggtgccaatataggccaccacttttcgctcgcctgccagcccaacccaggcggctgacatgacattttcgacgccatcatattttgcggaaatcatggtggtggacccgacctgcaataaacgataggccttacttatttcgacaggctgaacggacatggtttttcctttgtgcatgctatttaacgtaatgattatctggatatttattgaggccatgttcattttcgggccctctttcgtaatccaccgtgcaacgatacgccaggcgattaagcgtaaaaaggtgcgtaaattgttttcattattcataatccacgaataatcatgccgtctgtcggtaagctgctcgctacaggagagaaagaaggtggatcgtattcaggctatgcagatgtttatgcgcgtcgcggaggcaggaagcttcgtgcgtgccgcggaaaccctttccctgccggcctccactgtcaccagtaccattaaaaaccttgagaaatacctgaaggtgcggctgctgaaccggaccacaaggcgggtgagccttaccccggaagggatgcagtatctggcgcagtgccgggaaattctcgccctcatcgaacatagtgaatccaccctgagcgagtctgtcgcgcggcctcaggggcgcctgcgggttgatatgcccgcgggcatcgcgcatttcatcgtcatgccgcatctgccggacttttaccggcgctatcccgatatctacctgatgatcggcgtcagcgatcgccaggtcgatctcattcaggaaggcgtcgactgcgtgatacgaacgggagagctgaacaactccagcctggtggcccgccctctgggccgctttcgctgggtcacctgcgcgtcaccggactatcttcgggaatatggcgtgccgccgtcaccggaggcgctctctcagcaccgggctgtgcattatttctccggtcaggcgaggcgggccgatgagttccgcttcgttcgccatggcgagaccttttctgtacccgtcagcggcaacgccgcggtgaatgaaacggggctctatataaaaatgtgcctggcaggatttgggctggcgcagctggcggagaatatcgttgctgaccacctgcaggaggggagactggtggaagtgctgacggactggcagccgcccccgctacccgtcacattgctctatccgcaccagcgctttctctctcccgccgtgcgggcgtttgctgagtggatgagcgaggtggtttgaggggagtattgcttgcatttagcgcttcgcgatggagggtagggttccagcagaaatatctggtctgctgatgaatcgctcgatattctgtaatgctttgtcttttttgtgaacaggaaaaagtatgcttaatacgctacccgatttacacagaagttttgcagagcaactgaagcttaaattacagtctgattcgcggatccactcccttctcgccggcggctcgtttatccatggcgggtttgatcaatactccgatctggatttcgtggtggtgatcgaccctctccccatccatataaaccagttcttggtttatttgctcgagacgggaatagacagcaaaggtaagggcgtacataggacacaaccgttttttaatgtgcctgttgcattgctgcacaggtaatttatcgtggtgatatcttgtactgtaattgcatcttcatttataccgtaaccgatttaaaggaactgtaatgaaaaagacggtggctcaaccccagttgcccaattccgttcaacctgaaaaaaatgatgaacaaaacagtaaaaagtcagcagtcggaggaagcgcggctgaaaggggattagattaccaggctcgtgttgcagctattgctatgacgtctctccttctggaacagaaagtcagctggattgaggatgttttcaatggtgtaccggttttgattgatgctgagacgggggggcccggtgatgatatttcattaaaaacgaacacgggaaaatcggtggaggttcaggtcaagcgaggcctgaagcgtggcagtgatttatgggatgcactttgcgcgctggcaacaggcattaacgacaagagcattgcttgtggaattttggttgtttgccccaacagcagtacgaccatccgctcgaatctggctgataatattgttcgtattgggaccgggagaattgatggcctccacgaaataggtgatgatttcatcaagaacgttggccttgaattcccggagttatcccgggtgtgtcgttcccttcgaattgtcacggtagatgctgtagacggaaatgatagtgctgaggtcaatgccattagcctgctggggcgtttattcaatgaaccacgtcgagcgtggtcagttctggttgaacgcgcgcgaaaactcatcagaataagaggtcgcgcaacagtaacctcgttgcttcatgacttcagaaacgttggtatcggcatcaaaatggataccacagaaagcggtattcaactaagagcagccgtttgtgattggcttgagaaaagttattctcagtttacaatcccggggcaggcaaaaccggtttcactacagaaatgttggatcccactcaaagcctctgtcattaaagatctagagcagtttcctgatgacttatccaaagcgcttaacagctatcaccaatattcagcaaagcgcaggagtgacatcaacaagtttgatgctcatacccttggcagatatgttaccaggggcattatcattggtgggccagggattggaaaatcattactgcttcgccgcatagcattaacatatgcagctgaaggccatttggtattgctggcacgactgcgtcaggttgtctcgcttatcaatcataaaggcatccgttttgaagaggcccttatcgatgtagcgcttagcagctctggattgaaatacaaatcacctgacctgcaggatgcagtcattttatgtgatggcctcgatgaatgtggggtcagccaaaacctcgttactgatgccattcacaaatttgcagttgcccatcctgacgcgagggtattactcaccagtcggcctgtaggctaccgaccaggtcagctgggaaactggaaacattatgagcttcttcctctggaggagtctcaggctgacgacgcactaatacaagtgatggaagccttacctttcgaaagcccggaggttcgacggcacactttcgatgtcgcaaaagagcaactgaaatccttgcatctcaagggtgttgcatcgagaagtccattgattttaaccatgctcgcatccttatcttccagaggtattgagccagaaagctctcgaatttctctttatcgacagttattcagattgctggaaacggcatacccctctgtacgttctgaagtgattggaccaagtgaaccagagcgaaagtggttcatctctttgttaggctggatactgtttgagcacggtactgaaccctttgaagaaacattccgacactgtgtatctgaatggcaaaaagaaatgccaggcagctatcttgcttgcagtaataaggttaaggcatgttttgatttctgggaaagcgtaggcgtcatcgagcgcatacacacgcttaatcaagaagcagtaaccttcattcataaaacctttgcagagtatagcgccgctgtctttatcgaacagcaaccgcaaaacctaaaacgaaacttgctcattaacgtgattcaaagagatgccagtagcgaactgctctcttttgcaagccaccttgggctgatagaagacattctggatgcttggcgcgaattaatgctccagggaaaaacgacatcaacgaaagagctggtaaaggttctggacttgattattgaagcaggaaggcctgttacggatgactcattatgcatctttgccgactgctgctggaatgccttatcgtcatcctcaagcatgtattcggcaggagacgccctttgccaggtgtcaacgtatagctgggatgttgtaagggaaaaggtgagagcgaaccttcattctcatgatggctggctttggctggtttcctgggcatgtattctctctggtagcccctcagaggttagctaccaggatgcaataattgcattgaatagtattaagtcaaagtggccaaagcagctaagggaaaaacattctctgtttgatttcataggcgggaggaaagtgcaggattgtatcattcttggcgctgcaaaaattatcctccaaaaccctgaggaggtcgggcttagtacacttgacgccatcgtagataaaggacgaggggtgtccgccagctgttttgttgggttaatggaatgctatgcaaaagcaggtattgagttaccggatgaagtcactcgctatccgggaagagagaaagatttttatagcgtttacgctgaaattgatgtgaattgcatcggtctcctctctgtgctggctggaaacgataaccatcaggttttggatgagattttacctgaacacatgcttgagctcggcgcgtttttgaatataagtcgctttcatcacctcagcctggaagacctgctacatcttgaaacaacggataaagatattgatagaagcaagtttttgtaccagatagctaaagcttcaggccttgaaccagataaactcagacagcaggctgccagtttaaaaaggcagtgcgagggaaaaacgcttgtactggtttcagcctttggcaggcttcctgctgtcgatgcagacatgtctccagaaagggtcgatatcgatccagacgatttcgatgatttaatttcaacaattctgcacgccagtcagttctacagtgttttagccgccactgttctttatcagcacaaaacacatccaaaagtcatagacggaattaaacgcatccttatgcaaggagagggaacagctttgtttataggtacccggtttattacggatatgccggaccaggattggcagcaattactcctgcaacgactggaaacctctatgcctgagcagggtgcttcacacttgtttgaggcccttaccgaacctttcaattcacgacatgaaagtattgcaaaactggggttacggagtgaaatgctggatgtagcacttccggcggcctcatttgcagccaggcttccccagtctgatgaattatctcaggatattcgtctcatatatgaagactggaagctgcgggagaaaccctatccagagaatggtggtgttatcccggacagccctcgtgatgccttgtctggtattttggtcaaggataagggcgacgctaatctggcacttattcttgagatggtgcaggaaaaacgaacaaaaattcgtgggaatggtgagaaggcactcaagaatatgctcgatggatctgccgaattacagagaaacatttccaaatggatcagggatggcgtttgcaaacccacgctgttacgacagattattactgaagttaccttgcacccagaagctgttatgacgcttatacctttcctcaaagatgagtcatccggtattcgatatgctgctacagcacttcttaacacgcggttcatgacactcgagcaaatcgaattgcttgcccgcgatctttcaaatgacactgaaattgagattagagaaatcgcatctgcaacactctcttcacttatgcccggaaagggggtgatgtaagctcttccgggcaccacatcgggccccgttgtattggtgatggcatatcttgccagtccacagtatgcggggctcggaaaccggattagttcgggtcgcctgtcattctctgcacttcctctgcctcaaaggcgtcgttaagcatcttcaactgttcggattggataagaagcaaaacgtaatttggagcggcatcgtccggtttatcaagcatgacgttggttaaaacgcgagagcgatcaagcagctctcttgctgatggggattctgaagaagttaccttgacttctccaggacgtgtacggtatcaccctgacacaatggtcaattaaaacggctatatgagagcgcttcccttagtagcagaggcctcgaggcgcattttaaaagcaaggcttatcgccgcaggggaaagtactaacaggctgctttctgaatgtaagcaatgactgcttctgcaaccgtacttttgtttattgttgagtgcgggtgcagccaacctttcttttggcaatcaacggaagtaacctgtaacgcgttgtaaataattgcgaataacgcaatactgatttctctgaaaattcatgtcggacagaccgccttgttgcggaatggtctgtcaggctccatcagtaacttaatgcaaattaatgccagaaatatcactcattccccggattgctctggtgcctgaactcgatttcataacaggaaacgtaatggataatattgacgatatcataaaggacgctattcaaaaggccaccacggagcggggcaatatttcgatactgattgctggccgttctggggtagggaagagcacattaatcaacgcggtattccagcagaaaatggccgaaacgggccagggaaaaccagtgactcaaaatacgcgtgagattacgaaagagggtgtaccactcactatttttgatacccgtggtctggaaatgtctcagttcaaggagactcatgctgatcttgaaaaactgataacagaacgctcgtctgacagagattcaaatcgccatattcatgtcgcatggctttgcatacaagaagacgggcgtagggtcgagcaggcagagattgatttacacactatgctggctcgtcatatgccggtgatttgtgtggtcaccaaggcgagaagtgacaatggtttcaaaaacgaagttcagcgcttgcttcctgaatccaaaaatgtaattcgagtccgtgcgattcaggaagagatggatgatggttacgtcctaaaatcaatgggattagaaagcctgatagaactgacatcagaggttatccctgagggaaagcgtagagcgttggctgcagcgcaaagggccaatattaactataggaagacacagtcgcataaaattgtagcggcttccgcgacggccgcagccgcagcgggcgcgagtccgatccctttttctgacgctgtcatccttgcacctattcaggttggtatgattgcgggtattacatccgtatttggccttgagctatcaaagggaacccttaccacgctggtggcatcggcgatcggcgtcgggggcgcgacgtttttaggccgcaccgttgttgttaatattctgaagtttttcccgggagtcggaacggttgctggtggggcaatatcagcagccactgccagcgcaatcaccgttggtctgggggaggcttacatcaccgtgctggctgaaatttttactcaagatcctgatgcagagccaactgcaacggaaattggcgaaaagcttaaagaaaaaatgataaagatgggctcatgatcgtctaaagcgttcggtgtcaggcggcgtgctgcgctgcctgtgaacgctgagatgttttttcatcacaattttttttcgtgaaaggcacatgctgtgtcggtttatggattaaaacctagttttaagtcatgatttggaacatctttgtaagttaatctgagacacacaccatcgttgggaactctgttatggctggcgttagcaaaatacatctgacagaaacggacatcatcacaaaattcattctgcctgcaatcaaagaggcgggttgggatgtaatgacgcagatacgccaggaggtaaaactccgcgatggcaaagtggttgtacgcggcaaactggcggcacgcctgacagtgaagtcagccgatattgtgctttaccacaaaccagggttaccgcttgctgttattgaagcaaaagccaataagcatgagattggcaaagggatgcagcaagggctggattacgcgcgtttgcttgatgtgccgtttgtttttgcctccaacggtgatggctttatcttccatgataaaactaatcctgtgcagcttgaatctgagattaagctagaagatttccctggtcctgaacaactttgggataaatactgttcctggaaaggttttactaccgaacaaatgccagtcatcagccaggattactatgatgataactcaggaaagtcccctcgctactatcagttacaggcaatcaataaaacgatagaagccgtatctgccgggtaaaaacgtgtattgctggtcatggctaccggaacagggaaaacctacactgctttccagattatctggcgtttatggaaagccaaaaacaagaaacgcattctgttcctcgctgaccgcaatatcctggttgatcaaacaaaaaccaacgacttccaaccctttggcagcgcgatgacaaaaattaccgggcgcaatatcgacccggcatacgaaatccaactagcgttgtatcaggccatcaccgggccggaagaacatcagaaagcgtttaaacaagttgcgcctgatttctttgacctgattgttatcgacgaatgccaccgtggcagcgcgtcggaggatagcgcctggcgtgaaatcctcgaatacttcagcagtgccacgcagattggcctcaccgccacgccgaaagaaaccgaagaagtttccagtactgactacttcggagaaccggtctatacctattccctgaaagaaggcatcgaagatggtttcctggcaccctacaaagtggtgcgcgtggacattgacgtggatttacaaggctggcgtccgaccaaagggcaggtggataagcacggtgagctgattgaagaccgtatttataatcagaaagactttgaccgcaccatggtcattgatgagcgcaccatgctggtagcgcaaaccatcaccgactacttaaaacgcaccaacccgatggataaaactatcgttttttgtattgaagccagtgaacttctcgccatagaagaaggtattgatactgtgatgcgctggtcgctgcctgaacgtcttggctcctttgccctaactgaacaggatcacattctgctgatgggattcacgacaaggctggctttctatgatctcaacagcggattaattaccccagtggctgcttcactgggagacaccggcacccgtatgggtgatggacggtgcgaccgtgccggtaattttgtcttcgggacgatggatgacgattatcccgttaaagtcatcggtaagtttcatcgactcaatgcggcaacgctgactgctgagacgtttgcatcgcccgatgtcgctataccgaacagcatctgtttcagccccgatggtggcacgttctattactgtgactcgatgcagggtcggattatgtgctgcgattacccctcgctgcaaaaccagcgcgtgttcaccaaaatcgaagacggcggcgcgcctgatggttcctgcattgatgagcagggctatctgtggaacgcagaatggggcggcagttgggttgtccgatacagtccggtgggagaaatacacagcattctttctgctccagccctccagacaacctgcccggtgcttggtggttcgtcactccacacactttcatgtaccagtgcccgggtaggactcgcagagccaaccgcttatgacggtgcgcttttcagcattcggtcacctttttttgccggattaccagaaagccgttttgcagcgcacaaaatataacctctggcatttgatcagattcaggctgagagaaagcgtccgcttctggcactgagcggactaggtaactaagctgaaggtctgctacgagcgaaaaatagacttagggaaactggtttgtttagatcaaatcaatagagaaattttttgttctacccattgaaatgaggctgataagcacggatataaatgaaagcagctgcgctgggcatctgcctctggagaaaatagcaatggaagatttctacatttcagcaatcaaaatggacagcaacaatcagcatattgagttcgtaaaaattcatgagaacctaggtaagaagatcggacctggcactgttaattcgcgtgcattcgttggtgaactgatcagaaaagggaaagcagaattcaaaacaattacttacaacaaagaaaaaaaatcatggtctgtaggggcaaaggttgaagttatgactgatgatttcattactaccgatccaaacaagactaaacatgacaatcttggcaaccttcctacatttatctaacgtttgaagttttattaaaatcctaagccgttgcctagaacggcttttttccagattttatgccctgaatgtacgctgagtagtctcggcattttctgtgttgctatgacttctcagtatatctttactgttcgtaatatccccttgcgctgtcttgtaaagtctagttttggcacaaaccagactgtcagattcgattgcgatctatctacgattactccaggtctggtttgagccaatgcacctttgcggggaaagcaccagtccagttcaaaactcagcccacaagttttaaccccgttttcccgctttcaacaatgctcccgctatcggccttgctaacaaaatcagcccaccattgcatcattggacgtcgttgctcaagataatcgcttcgattataagctcgtcgtacctcatttttgtctatatgagccaatgctgcctcaataacatcaggcggaaacccttgctcattgagagctgtacttgcgatagaacgcaaaccatgggaaacgagaacgccccctaaaccagcacgcttgagtgctgcattcactgtttggctgttcatcggctgggttggtttgatgcgactgggaaagataaattctcggccaccactgagagacttcatcatttccagaatagcgatagctccatcaggtaatggaaccgtatggtcccgattcatcttcattcgagcagcaggaattttccattcgctagcatcaaaatcgatctcatcccatcgagcttcagcggcttcggcagggcgggtaatggtgagaagctgccacatgaacaggcatcgtgtggacaggctgatactcgccatgcgtatagtctgcattagttgtgggagttgatccgggcggatactaggcatgtttttcttctgcggtttctcgaacgctttcccgatgtttacgctgggaactgcatcaatcaagcctgtgttctgcgcataaatcatgacttcgttaatacgctgacaaaggcggcgaacagtctctaatgcacctctggcctgaaccggctgaactgctttaaccagagtatgagccttaatctcagtgacactgatatcaccgattgccgggaaaacatctctctcaagagagcgccagatatcgtcggcatagtcctctgttacgctggttttcttcacattccaccaacgctcggcaactaataagaaggtgttggttttagcttcttgagaattcctcacctgttctttctgatgctcctgaggatcaatgtcttttgctaataaaactcgagattcagctcttagtttacgcgcatcagaaagtgagacggcagggtaggctccaaagctctgcttagttcgctgctttgtcagaggtcgatagtaacggaactgccagagcttactaccgctggacttgattagcagagtaagcccatcaccatcatacagctggtaatcggcatctttaggtttggcggctttgatttccgtatcggttaaaggcttggtttttcttgccatggggagtctccatgcgtttaggcccaacgaaaacaatagagcttttcgttgggcccatcaatgggcctaaaaggtgcggatttaatgagttctcttcggacgtcgtggggcaaattgagggcacaaaaaagcccgcagggcttgcgccgtgcgggctttcaggacttcatcggatgactctggtaatcaccgatggagaattttggtggagctggcgggagttgaactcgcgtccgaaaacgatataacttgctgaaaaatattgttatgtgtattttttttcccagcgcgtgcattttaagtgcattttgttgtccgctccaagtccatgcatcaatgttaagtggccacttgaagctctggacccgtgtcgctatcaattaacggctgaccttgaaccattttttcgacagtttcgtttgaaggatatggaaccccgagttctactgtgtttgggtttgaacgatgggtttcaacaaacgaggttccgttccatttttttgaaagataaataattccttcaaaggccgctggatcctgtttctgagattctaaaatcatgtggaatccacggcgttctattccgcgtaagaagctggaaaaacactccttcagcaactcgtcatccaaatccttgaacttgattccctgcgcaagaaactcgaaataattaagaatgtacagaaggccgttaatggcatctctatactcgtcgggtaccttcatgttcttgtattcttctttatccgggttgcagcgccactcagagagttcttgtggcacataacgcataccccggtaaaattttgtgctgttccgtaactgtttttggtattcgggactggtgcgtgtgttaatgatcatgttaagggtatgtgacctgcgcgtattcgctgctgacgttatacactggatccaccaccccatcccaacgagcatacctgtaaccataatcgaaagagatgtttgataagccggagtgtatctcaggattgcatacccgatcaggactatcacataacaaacagtactgaacattggaagaaattctgcagtgtctgggtagcgctttttgataaagcagaagatagaagaaatggcagcgccagatccagcaatgacgaccagccaatcaatgattgccaggttaaaggggagttttccagggtagatataagtaaatagtgctctgacaatcaacatgagagcaaaaattgtagcgctgacgtttacaagtgttctcgccatcttattgattcctataacaaaagacctccgcaagggaggccttattgtgctaatggaggtttgtgttacaaatttaggtcgtagttaaccttcaccaaaacctacagttagtgtgtttttcatagtggtcactccagttgtaatactgcgccagtacctacgttaagctattgaaaattaaaaaaacataaaatttcttgtattagtggagcacaggataacagtttgtaccgtaactcttcaagtactatcagtatccctgtgctgtcctaatgagattttaatatcataaaaatcaatgtgttatatattgtcaagaaatatatttacattgcgtttattgctatagtctaacttgttgtttttaaatgaatttacgtttatgtaaacgcaatagtgcaactatcaattacatagatgatagctcatttcacaaaaagcaatggtagcgtcattcttaattttcttcagacgtaggcagttttactcaggttgacactacctttatagacgtctttccatcatatactgcaaggtatttaccataattgcggaacaacatttccggccctttgtggcccatctgtccggcaagccagaagaggttaacaccctggctgatatgcttggtggcgaatgtgtgccgcgtctggtaagggttacggtagcgcacgccagcttttgtcagggtcggcacccatgcctttttacggatcgcgtcggcgtttgcccagggttctcccgttttcggatcgctgaatatgaactcacttttcagaaaggtgtattgcttctgcgcctgcagggctgccagcgcctcactgttcagctcaaccttacgggtaccggcttttgtcttggtgcctttgagtacccctacgacactggccgcttgaacgtgagctgtgttccctatggtgtcgagatcaggccagcgcagcgcgcatagttcggagctccgcagaccggtattgaaggcaaagcggaacaggttttcccattccgggtacctgcagctctgataaatagcgagggtttccgctggcgtgaacgggtcaacctcgtaatcgtcggcgctcgggctgctgtcgatcacgtggtaccggctggcgctgacgaggcttaccgggttaatggtcagcaggccgtctgtcaccgcttcatctatggcgctgcgcagaaacgaaaggttattccgggtcgttttcagctttgttttcctgctggctatccagtttttaaggaccgctggcgtcaattctgacacgtgaagtttatgcagagctgacagcgccgacagacatttttcataaccgttgatagtcgacggggacaggttgcggttctggcagattttcaggtactcgtccaggtaagactttatgtttttggttttcttcactaccccgaacagctccagctttttggagttggggaaatatttcgcatattcaaaggtgccattgacgatctggttttgtatctctccgcgtaggcgctcggcgtatttcacaccgcgtgcgtttgcttccagtttggagaggggctcccggcacagaacccctttatatgtgaaagtgataaccagagtgtcaccagttttatgctggcggatggttacacctcttgggagagatagagatccttgttttgtcttgcccaatttgcaatctcctttaagtcgatccaacgttcttttgacccatcgacttttaaaacatgaaccccttcctgccacactccacgttgtaaccgtttgttaacggcatccagcgtctcgcccatctcttcgcagtactttgtaatcggcacaacatccagataaatcatcttcacctcacaccacaatcaggccacgacagtggcgccacgtctcatacatccgcttaaccacttcccggcagtagtagccgtgcccgtctcgcgtcaggtcataccggccgccgtagcgcagccggacccacatttcgaacgatttgtgcattgttatttacgcccattttttttgtcgcccagggatcgtccgtccacccttactacattggcgttaccccagacgttcggggtcctcactcttgacggtgttcgggaatagttttcctggagaagggcggttatcgtccatccgatagcatctttgcttcgggatttacgggcctgaatgcctcgcttttcataatttttcattaaaaaatcagcctcatcggaagtgagattttcatgtctaaattcactgtaaatctcttgcattacttcacctccttgcgatacccgacatcgaaaatgctcgtggccataacgatggctctttcagcggtcagcgtttcttccttcacgcaaagcaccgttgcgatctcttcgatggccttcttgcggtactcagcctgccgatcggtaatgatttcgttgcacaggtcgacgcattccgagcagatgtttacgctgggcccggcgatcagtttgtccgcggcagtaatctgtttgcagaagttgcaaaccgttttcgggtctggctcgcgctgcggcatatggcgccatttatccaggttgttatagatagccatcactttccctcctcaataatttcaacgcccgcagaaatcagcgtggccgcacatgcctcgcgcatacttccggcgccggcggcaaacccctgataccattcggcgtcagaaccgagttttggcagccccggcagcttaatctgcacggctgttttcgccggagcaccaaagcccagcttctgcctgagttcagcgatagcggcatcatgctctgcgcgggcctctggacccatagcatccaactctgcgtaacgttcagcgcggttcttaagtgctcgcagaaccaggtgagtgctaacgccttttccgaaccggaagccgggctcgagaatgaccgggcagggcagagtttcgggataatctatcggctccgcatgctcataaagcggagttacatcacgcaaaggatctgcgtgggcgacgcgctcatcgagcgttacatggcccggggctccgccgccttccagtttccatgcggtcggtttgccgtccattgcggccagcgccagcttgaacgcggccagcgtattactgtcgctaataccggcaacctcaatttcggaaatttgatgttgcagccattctctggttagtttactgctcatcgtgttgcctcccactgaagcgatttatacgcacggagcacgtgcgacgttttgccggaaatcaccgttttcagaatgaagaaaccactgttgtgcgacagaacgcccggagacataaacaaggcggcatcgacagcgcgattgtgccggcggaactcgaataccgaactggtgacggtggcggtcgcaatggcgccctgatcgttaaattcgactttcatcggatctgacctccttaactgctgcaatgtagccatcccacccgccatagctgttaaccatttcgcccaggcgtgaaaggcacgcattcatccagcggatcccacgaggagtcagcgctggcactgttccccagtcgataaattccgaattgctgcgatgcatatatttaatgaggtccagaatgttgatgtaatgcgcccagcgccgttcggtatcccatcccttatctttcaggtaggagtcaataaacccttgtagtgctggctggttaagcgagatatcgccatactggtgacggtataccgggcggcgatgcaggctgaccagatagaacaggtaggcatcgcaaacccacgttaaggcccgctggtgggcctcctcgacagaaccggctggcatccagatgtcgctattgctcacagttaacctccggctcctcgcgttggttccagttccagatcgcgccctctttactgtctggctgttgcgaagcgttacagcaaccacagttcacgaaccaggtactttcaccatcaaattcccgcaaggtttcaacgaggcttacgtgcgggtttccgcagaacgggcacggtttaagcaggccgtcacggtttattgtttcaatggccagcgggcacaggtaaggaacaactgacgcgatggtcagattttctttgccgatgtggagatctgcggctttagccgtggccagctcaatcgcttgctcaactccagaggcgtcgacctcgtatttaagcgggtaacggtcgccgtctggatagttggcaataaaagtgacttcataggttgatcccggcattatttttcctccggtgtataaatggctttgtcgtggatgaattcgccgttccaggtctttttcatcggcagctcacccttcatgtacaactggtacagacgatggcaacccttctccagcagcgtcggggtaaacttcgtgaaagcgtccttgccgtgtggggtgatctgcgtctggtcttctgtcaggtacttatcacgggcataagaggcgacacgccagcgcgggtctttctccggatcgcgttgttcgttaaacacccagtcacgctcgaaggcccaccacatcattttgttgatgttgacgccgttcagggctttgcagaatgctggaatggtcacgcctttggtgaagtgcttctcaagactttcaacggtagcgctgagtgttttgttttccagtgcggcagcttccgctcgttcctctgcctcaatcaccatcaaagccagttctttacggctgatagcgacctgggttgacggagcggggatagcgttacgctgggtaaagtaaaactccacgaggtcttcgtgatatccccacgcctgatcggtatcgacgacttttgacatgcgagccgcgccgcgttcggtccagagaatcagttggcttgtgtgtttattaaccaagtaactcatggttactaggttcttaaattcctttaattctgaaccagttaagaggaagtagtgtttaccatcctcaaaacgttccaggtttcgcgacaggttattacggatgtttacctcatccgtgccatatcccgccgccaattgttcagtggtcacgacgcgctggccgcgatactcgataatctgcagatcgcgagctgccacagttgccagttcagttttcattgccattttcgctacctctcaatgcactatcggttttactggcaatgcctcaccagcgttaagtcgcatggacaggccgacaaaaatgtcgtccagaaagtcgtcaaaccatgaatgcccatcctcctttaatatctgatcgttggcgtaatagaactggaacaccgcgagatagcgctcttcagggttgaactcaataagcgctgcttcaacgtgctcgataagtaaattttcaataaggtcccgcgttaagccgaagacattctttccggccttaaactggtattctccgttccgcagcccccaacgcttttcgcatccgatgaggtagagcagggctactgtgctgcgcatggaatggacgattgattcagcccactcatgctgttcggctaaactcagggagcctttgccgtagcggttttcatcaagcatccaggcagggatcgtgacgtcggattgctcctgtattaccttcaggcgagcaacgagctgtttcacattttctttttctttgtcgatcatttgctttctatctcccggttgtacgtggaatggctcatcactacccagttacggccgtcgtcttttgataacagccgccagcgcgggttaacctttaggctgaggtatccggtgcggcgcatgcgccgtgcataaatacgtttccggcggtaccgcagcaggacctgcaacgcctgcaggtgtactcgctcaggaatgcgtattgctgttagtgccactggctccctcctgattaggggcgatcacctgatacccagctttctttgccatccagaaaaaagtgtccatcgtcgcgataagctcgttatcgcgaactttgcgggtatcaattacctggccgttttcaatcgtcataacgacctgcactttttcgtgtgtaatggggggggtaaattagccattagttaatttctccgcttttagtgactgttcggccagcgtggcaatgagcgcattcatgaaatccacaccatcaggtgttaacttattaatgcccatgcaattcgaataatgctcagcaatcaaatgctccgcctgctcgcgtttatggttgtcataaatcatcgattcgaaaaatttgattaatgattttgttaaaatatcttcatcaagttcaacaggtaacgttgttccatcgtccatttttacgagatgaaaataactcccagtccttcgcatcattgaatcaagcttggcgcgaacgaggtgacggcgacgcgtttcaatcagatttgttttcacggcgccttgcctcttcgctaatccatgtaaagatgtcacacgatatattcattgcaaggccgattaatgcttcggtttggcatgaattcattttgctaaagcaaagatgcattaaatccagcagctcgttcaggttattggcttgagttaatacctcttcaatgcaggtatctttttccgggtcccacataattacctcccgtacgctttacgaagataaaggcccgcaatcacttcctgtccgcatgatgcataaagcagggcggttttatatgcattgtggtcgatgatgaatgtcatatttagcgaccttttctaatgttattcactgtggagtcagtcataacgcaaagttcattgagcagactggtaaagcgaccagcgacatgcttatctgttctggctatcgcagcaaagagcaatgcattgaactcatccctgagttgattggcgtacgcatctgcgtgctgtgctgtccggagtgctccacttgcttcaatgagtacagggaaatcagtactcattgttatttcaagattatcttttttacgggatgcaacattcattacgctttcctcaaaatgagtgaggcctaagcaattaagccgttttatcctttcgggtttttaagttaatttcggacggttattttttattgtttggtcataaaatagatgtggcttgtaatatcaaatctctgacatctggataaatatcgagaatattcttcgcctcatcacatgcttcttcatatgacttgaagaaatcaaccagaacaaaatgattatctacacgttcgtaaactgcgaactccatcccaccaacaaatgtcgtattgaattggtaatcaaaacctttatcgtgaggctgcacagcatggcaataagaccagtgcgaatttgctgctctgagcttggcgtggatatcaaatgcctggctagctgggtttggttgggaggttgtattcatctcattggctccgttgtttgccgatgagttaatagtaccttaagtactagtattatcaatactaatactcactaattctataaccataggtattagttcatgaaatataatggaatttagttgtaaaaaaaaccggctttcgccggcataggttgggggagggggggggaggggatctttcaaacgaagcggtattttgcctcaactacaacccctacaatcctacagttaccatttacttgcattagggggtactgtggattcaatggttttagatacttctgtccgccatcaataactagttttttgaacgtagcttcatttgcatcatctaacttagctataaccaaactgccgttcttgggctctcttcctgtatcgaccaaaatgtccattccttctgggatgcttaaccctgttggcgatgtcattgaatcaccttgaacacggagccaaaaaccgtctccttcaacattgatatccgactcaagccactcatcaatatccttaatattataaggctcacaggcttcagcccaggcaccagcacttacccagctgatcagagggtaagaaggccttttttcgtaagtgcccacaaatttgatgttctgcgccgcagcatgcataagctccagctctttagctaagtgcgggctaaactcctcgatttggacctctaaaatttttgcaaacatcaaagcggaacttacatttagcgcgtttcgcccgttcagatagtgacccactgcgctttgcgtgatgtttagctcatctgctatgtcctgctgagtgatccccagagtttttttctttgagtcatatatagccttcaggcgctctgcgtctttctgctgttcttcggtaaggcgatttttatttttcatgactgtattttattacctttagtttgaaaatgtctcctactgatagtactatagattttagtacccatgatactattaattaggctatcaatatgatgacttttaccttgaaagattatgcatcccaagttggccaggtgcgagctggcgagcgtctgggtgtgactcaaattgctataagcaaagccgtgcgctcaggtcgaaatattgtcgtgcacgtgacggatgatggaaaggttagcgcatatgagagcaaaccatttccagcgaaggccaaaaaaaacaagtctgttaagtccattcattcaaacagcggatcaggagtgtgatatgtcgcactcgatcactaccgaaaaccaagttaagccattggatatcgattatagcgatccgcgcggtgtgattgtgcatgtcaccggctggaatcgggataagcagcaggtttatttcaccagaccgggttatccgcatgaatgcatgcagccagtctggaagtttcaacagtacttcacgaggctaacatcatgagcagcaaaattcagggatatgtatgggatgcctgtgctgtctctggcatcaaaggaacacgccttatggtcatggtgcgtttggcagattattccagcgatgaaggtacgtgctatcccggcgtcaaaacaatatcacgtcagataggcgccggtgaaagcacaatccgaacggcattgtctgagcttgaagcggaggggtggctgcgacgagagaatcgccgaaacggtaaccgtaacacttcaaacatgtatcacctcaatgttgagaagttggaagaaatcgcactccagcaaagaacgctaattcgactggagcgtatcaaaaacaaccgttttgaccctccagaatctgacgcttcggattttgaacagtcagaacctgacgcgtcagaaatgagaggctcaagtgcgcttgacccgtcagaatctggcaaaagcaaccgttttgaccctccagaatctggaggacatgatccacaaggtttaaaacctgatccacaagtaaaagatcatgaaccacaagaagcggtcgcaaagcgccagaaaaaaacatcattcgaccctgcaaggctaaaacctgaaaacgtcagtgacgaagtctggcaggactgggctaagttccgacgggaaacccggaaacctctaaccgaaacaacctgcacgtaccaggctaagcaactcgctggccaccagaacgccgatgaggtgatccgtcgctctattgctggtggatggcagggtctctttcctgaacgcgtgcccaatcaaccgccagcgccagaggtcattacgaccagcgctggcaatggcgcagggaatacctggtacacacaatccaacgacggctccgcagaggtgtttatcaatcaggccgctattgaccgcctcaagcgtggagccaaccgcccatgaaaatcatcctgaaacgcatgctggttgccggttttaaccgcggctttctgcgcgaaggattcgtgacgtggtgttttataaaattcgatttacggagtatctaatgggcccggctgaactatccgaaaaactgtgggacaacgccgaaagggttgctaaatacctcctgcctcgcgggcatctggagggcaaagagtggtgcgcgggtaataccaacggagatacggggaaaagcctaaaaatcaatctgagtgggaaaaaggcctggtcagattttgccagcggtgacagcggcgatctgctcgatttatgggtgctggtgcgcaactgccagttgcatgacgccatgcgggaggctaaagaattcctgggcctgaaagatgacgatcatcacttcgaggccaagaaaaaaacattctcccggccaacgaaaaagggcgtgaaaaaagcgaaccattgctacgactatctggcctcgcgcggaattactcgcgagactgctgaccagttccgcgtttctgatgcggtggtctggtaccacgatgaaaaccgcgaagtaccggcggtggcgttcccgtacatccgcaatggcgagctgctgcaggtgaagcggatcggcatcgaacgtcctggcgggaaaaagctcattatggctgaggctgactgtgagccgagtctgtttggctggcaggctatggacgccaaagcccgcgcagttgtgctgtgcgagggtgaaatcgactgcatgacttactcgcaactgggtatctgtgcgctgtcggtgccgttcggtggcgggaagggagccaaacagcagtggatcgagtacgagtatcacaacctggaccggttcgacgaaatctggcttagcctggataacgacgatgtggggcgcgaagccgcgaaagaaatcgcgcgccgcctgggagagcatcgttgccgcatggttgagctaccgcacaaagatatcaacgaatgcctgatggccgggatgagcgaggatgatatctggaactgtctgggtacggcgaaattctttgatcctgacgaactgtgctccgccggcgatctgcttcaggaaaccattgatgcgttcgagcatcgggacgccggtctgttcaccagcccctgggcatcattgaacagcaatttcaagttccgcgccggtgagctgacgctggttaacggggtgaacggccacggtaaaacggaactggttggacatatcgccgtagaagcgatgagtcaggatgtccggacgtgcgtcgcctctctggaactgaagcctgggaaaatgctggcccgcctgacccgccagaccatctgcaccgcttcgccgaaacgcgaagaaatcgtcacgacgaatgagtggttctccgatcgcctgtgggtgttcaagcttaccggcaccgcgaaggccgaacgcctgctggaaatcttcgcctacgcccgccgccggtatgggattgacctgtttgtgatcgacaacctggcgaaatgcggactcgacgaggaagactacggcggccagaaagaatttatcgacacgctgtgcgacttcaaaaacgagcataactgccatgtccttctggtcacacacgcccgcaaaaccaacgaagcggcacctacggggaaaatggacgttaaaggcaccggcgcattaaccgacatgcccgacaacgttatggccgtatggcggaatatcccgcgtgagctggcgcagcgcaaggctgatcgcatggggtatgagagcctggacaaggacgaacaaaccgctattcagatgccagcctcaatgatacgcctgttgaaacagcgagagggcgaagggtggattggtgacattggcgccacctttgacgcccggtcacaccagtttcttgaaggcgacaaggggccgtttaactacctggtcggtaaacaacaaagtgaactcgatattgagtgggacgctgataacgttacgaggtactgagtatgaaaaacgaagttttaaaagaagcaatcgagaactatcagtgcctgaaagcacaggtcagccagcaggagtctgatgatcccttatcgttcggcggtgttgatgtggacttgttcgaagcgtttatgtttgcaaaaagccagcttcaggaattgattagccccgatgaatatctggagttaaagcggaaagtctctcatctcaacaatgaggttggtgcgttgatacttgaaaatatcattcttaaaaatgaggtagccaagttaggcggcgatcctgattttttgggtaacgtggccgctgaggggaaagcatgaaactggaagcttccctcaaacactttagccctcaaagcaagcacatcagtggcggtacgggagataacaacaatgcgtgatattcaactggttcttgaacgttggggggcatgggcctctaacgaaggttctcgggttgactggtctccggttggcgctggattcaaaggactcattcctcaggcgggaaaatcccgcccgtcctgctgtgataacgacggcatcattgttgataccgcagtgggtatgttgggtaagaccgggcgccatgatgagcttaagcttattatgctccactacatgtatgacgtttcgaaatccacaatttcccgctgggagaaatgctctgagggtaaaatcaggcagaaactgatgattgcagaaacatttattgacgcctgcatcatcatgtcaggagcgacactagaaatggacgactggacgcagcgaaatagagttgtaaaagttgcataaaaagcttttcgttacgaattttacctattattgtgttaagagtggtcacttcgacacacagcttaatcatcgaaaccctgccaactggcggggtttttgcttttctggggggagctatgcagcagccatatttttttaacccgggcatgaccactcaacagcttgaagactggcttgggcagcagaaaacacatcttgcccactttaaccgtctggtggcagaaaaagccgctcttgaagaacggctaaaagagatcgacatgtctattgagttgctttcatcatcaggtttcgtaggaacgttgagttttccctatagttccagtcctcttctggaaagtcctcaaacagaaaagcagctaaaggcagattgaaggagcttaaggcctcctgagcatcttcgcttatgttctcaatccttagctcatcctggataacaaaaagagcatcttccagcttcagttccctgatttctgacggctgccattttgttttcataaagatgaggtgatgcaacgcagcttttccctcaagcggattgaaaatggtggcatatttttgtctgtgttgatggagaatcatttcgaggacataaatcagcgctgctctgtttctgatctgattgtcctgcatgctgcccggataatacgcggagtgagacatgctcctgttttcacacacgcgcgatttgatcacatgcaataggttgtggtagtcagacacgttaatctccttgtttgtatggttattggcaaattaacaatatcaaacagggaaataagccgccactcagcggcaactattcacaggctgcgcactcgcgtggccttttttcatttcaggctcacgggaaccatcttcgatacggctcgttgttaaatcagcccgatgggcctgacccttttcaaacacacagcaccccgttaacccggaggtgaacctatggcaaagcatatgcaagacaaagaaagcatggccggaattacctggctggctctgctgatcattgcttgctggggtggacttgttcgctacctgatagatgtgaagcagagcaaggcaacatggagcttgatcaatgctcttgcccaaatggtggtttcagggtttaccggcgttattgctggcctggtgagcattgaaagcggactgagcatttacatgatactggccacttccggaattagcggggcaatgggttctgttgctttgacctatttctgggagcgcattaccggagtcaaggcgccatgacagcagaccagattatcgaggggatcctcggcaaagagggtggttatgtcgatcacccctctgataaaggcgggccaacccgctggggcatcacgcaaaccaccgcccgtgcacatggctacaccggtgatatgcgaaacctgccaagggaaacagcaaagcaaatcctgctgagcgattactggaccggcccccggttcgaccaggtagcgagtttgtctacgttactggcggatgagctttgcgacactggcgtgaacatggggcccagcgtcgccagtaagtttttccagcgctggctcactgctctgaacatgcgcgggaagctataccccgatctgatcccggatggcgccattggcccccgaaccatcaccgcgcttaagggatacctttcagcccgcgggaaagagggtgaacaggttctgttgcgtgcgctgaactgcagccagggtgccagatacctcgaactggcggagggccgcgaagccaacgaggattttctctacggctgggttaaggagcgtgtcatgtgaagatgattattttcgctttgcttgtgctggtggctgtgctcgttctgttacttcttcgcaaatatacccggctggagttcgtagggcatgccagcttgctgctgaaaacgtggtctgtaaagctgggagctatcggcgcgctggttggtgtatgggcgcagtcgttcccggatgctgcgctgcacgcctgggcgatgctgccgccggatatcaaaaatatcctgccgccaaacatcgttgcactgattagcccggcgctggtggtgctggccgtgctatcgcaatacgtgcgccagccagcattgaaagagaaggccgacgaactgaaggatccgcagcaatgagctttgaaattattgctgggctggtggttgtcatcctgggtgctatcgctggtgcgttcggcattggtcattcacgcgggaccagtaaggcagaagccaaagccgatcagcagcgtaccgaagagaacgccgccgccaccgtcgccgcggcagaacgtaaggcggaagttgtgaaagaggcaagcgatgtacaggaagacgttaagcgtatgggcgatgacgatgttgatcgcgagctgcgcgaaagatttacccgccccggtagtcgttgatacggcctgcagctgggtgagggtcatctacctgaccgaccacgatatcgacgtgctggataagcagaccaagcgtgacatcctggcgcaaaacaaatcagtgcaggctaactgcccgcaactaaccggcagggttacgcgatgaccaaggcaaagaatattgaatttcgactgagcaaacttgagaaagggccagacgagaacgttctggccatcatggagataaggtcgagagctattgcaggtagcttgctgaagcagatttcctgccaggcgttgaaagatcgataatgtcagtgaagattgccttgtaggctttatttaacttctcaactgttttcggggtgatatcactcgtaggcggcgcgtcgataccatccattaattctatttcagcaaattttttcaaaacctgaaggacactctctttttgttcttcaggcatcgtttgcacaataaaagcaacaacgtttctcagcgccaggagttgagcatgagttacatagtaatgatcgatcatattttcattcctgttctgttgagctcggcgatttaacagtatagcggagaaatattgcccgctactctgtggcaactttcaatcgtgatgactggcaatagcgggactttttatgcccggaacggagtatctatgaaagaacgaaaactcgtaattgaaattgatgacaacgccattgattcagtcatcgaaaaggtgcgcctgctcaaggatgaactgagaagccttaacctgccgatcaacatctctgttgcagtgccggcagcattaaagccggaagaggaaaggaacacgcaggatgccagaagcgtattccttagcaaccttgatgccgaaattactcaggcttggtcatcattgacagagcttttgaatatacgtcgcgacgcgacctcctccgactagctgctgccgctgtttttagttcattcacggattttgtgaatttagccctcacgttactggcgctatctgttggcaactcgctgaagaggcaggatacagcgatagataagatctcggtctcacctttgagtgactccagctcctcgacgattttctgtaaaagtttctgattatcaacggacattaaaacgctccttactttttgtgtgaaaactcaaagataagcgagcgttactttttgcaacatcctgatattcgatcagtgccgccaccgtgcggcatttttattaccagaagtaggagaagaagcatgttgacagtaaaagtgatgtcgcctggcggcggcgaagaaatccatagcggcctgagcgttggtttcaaccccaatcagcagagtatctcagtgtctggaatggaccagaacgtgttcctgaagcagggggaggtggcctatgtgatgaacgcaaacggcaagaccatttcccgttacgaacacagggcccagcagtaggcattacagaagctcctgagctaaggggcttcgataatgctaaaccgaagcatctgccttaagtgttataaaaaaccccgtggaggaaatcccaaagctacggggtgctgtacagccagccaatgactgattgtagccacgaagttggtttattttctactggttgagaataaaactgagagccaggaaggcttgagagtggctcatccataagctcacgggtagaacggcagactttgtcatggcagagcaaagtcataagttagtttaggtaacatttcggatataacaagcgtagcggggcattcctaataatggagcaccgcagctaaagcattacaggagccattcgccgagtggcttcgataatgctccccacatcgcacagaggtaagacatgtcagagatcaccgcatccgagcaaatccgcctggatatcatcaagaaagttaactacgacaccgcagcggccaagctggccattgactgggttggtgatagcaatctgaaagctgagctattcgctgactcttttgatcgtgtcttcactgaaagtgagattgtctcgaagacccgcaaggccatccaggaagcgactgaggcgctggcgctgtttgataccatcgcagaacaggcgagctaaggcattacagcaggcattcactgagtgcctgtgataatgcagggctcaattgcggtgttgttgtttcccctgttaatctgtcccaaataaaccgatggggaatagggacgtgaaaaagttactttttgcagcattaattggtgtttcagctttaacaattaccgcatgtgcgccaacagtccagaaagtagattacaaccagagatcaatgcttttatctcttggaatgaacaaaaacgacgtcatgcagatcatggggtcaccacgcaggacggatgtgaaccaggaacgtgagcgctggatatactggaataaggctctctatggctacacaatcattgataacgaacaattggctaacgatcgactggttataactttcgttaatggtaaggtcaccaaatggggccagcaaacgctgactgatgacataatggagtcatcacaaaagagcgctcaggcttatgctgaggcactcaagaaatagccatttcagtcaaacgagaacctcgcttcggcggggtttttttatatgcaaaaagaggtaataaccgatgagctttaaacatgaacttggtcaggtggtaaccgtcagtatcagtgaagaagaagggcatatcaaagctcgtgatgaatatacgcatggccccaatcagtaccttattcattatcgtgcagcagacgggcgagctgtagacgcatggtttgaagaaggggagctgtctccatctgcacagtagacgtacgcattacagaagcccctcacattgcgagggtcttgataatgcgaatgagtatcacttttgatttcaaatggtgaaattggatgtttggacgtctaaatggccatgagtggtggatatgaattattaaagtgcaaatggtaatcattatcatttaatgggtcctcccggaggggtggactaccacggggcggcggactcgcggaaaacggctagttttcatttttcatagtcatcatcatcatgtgcacaggttattgattttccagatgtcggattttcaatgatgtcgaatcgtataaaaagtgttcaccatcatggaccaggaaatcgctactttaaaactcaatatcaaccagcttgccgggattactggcgtacaccgccagaccgtcgctaccaggctaaaaaatgtcagtcccgcccagggaagcaacagcaaacttaagttgtatcttgtcaccgatattctgacagaattaatgatcccgacggtttcctcatcgaatcttgaagagatgacaccccctgatcgcctcgctcactggaaagcagaaaatgagcggttgaaatttgaagtagataccaagcaacttatccccgccgaagacgtcgcacgtgaattttcaatgatggcgaaagccgtcgtcatggtacttgaaacacttccggacattcttgagcgcgactgtgcacttacgccggttgcggtatcacgcgtgcaaagcgtgattgatgacctgcgcgatcaggttgcccaaaaagtaatggacgctgaaccagaggaggatgagccagaggaggactgatgacaaaacgggcatctgccaaggggatacgccgcgatgtctccggtattcttcgtgccccacgtcgtatgcaggtggccgatgcggtcagctcatatatgcgtgtgccgatgggggcgggtaactccgtaccatgggaccccaatctggccccttatattattgagccgatgaattgtctggcatcccgtgaatatgatgcggtggtgtttgtcggaccggcccgaaccgggaaaacgattggcctgattgatggctggattgtctacaacatcgtttgtgatcccgctgacatgctggttattcaggtctccgaagagaaagcgcgtgaacattccaagaaacgcctcgatcgcacattccggtgtagtccggaagtaaaatcgcgactcagtccgcgtcgtaacgacaataacgttcacgaccgcaccttccgggccggtaactatctcaaactgggctggccgtcagtcaacattatgtcgtcgtcagactataaaagcgtggcgttgactgactatgaccgctttcctgaagatatcgacggagaaggtgatgcattttccctgggttcgaaacgtaccactacgtttatgtccagcggcatgactctggttgagagttcacctggccgagatattcgtgacacgaaatggcgaccaaacaccgcacatgaggcaccgccgactaccggcatattatcgttgtttaatcgtggtgaccgccgccgcctttactggccgtgtccgcattgcggagaatattttcagccggaggtagccaatatgacgggctaccgggattcccttgatcccgttgtggcaagtgagtctgcatatctccagtgcccggcttgcaaaggcaggatcaccgcagatatgaaacgtgaactgaatatccgccatgtctggttacgcgatggagaaaaaatagaccgtgatggcaacagatttggggagccgcggcgatcacgcatcgcttcattctggatggaggggcctgcggctgcatatcagacatggtcgcagatgatatacaaattcctgactgctgagcaggaatatgagtccacccagagtgaagagacgctgaaaacggtagttaataccgactttggtcggccttatctaccccgagccagtctcgaacaacgtaagagtgagctgctcgaacgacgcgctgaagacgtgccgaagcgatctgtaccagatggtgtgctctttatgactgcaaccgttgatgtgcagggcggtaaatcccgtcgtttcgtggttcaggtgactggctacggtgagcagggtgagagatggctggtcgatcgctacaacatacgccagtctcttcgggcaaatgagcacggtgaatgttactccatcgatccggcaagttacccggaagactgggatttacttttgtctgacgtgttcgaaaagtcatggcccttagcgagcaacccttcaaaacgcatgcggctcatggcgatggctgtcgattccggcggtgaggatggtgtcaccgataacgcctataagttctggcgtaagtgccgccgggatgggcttggtaaaaagattttcctcttcaagggcgacagtgtccgacgctcaaaactaattacccgaacatttcctgataacactgacagatcaactcgccgggcaaaagccgctggcgatgtgccgctttaccttcttcagactgatgcgctgaaagatcaggtgaataacgccctgtggcgagaatcacccggcccgaactatgtgcatttccctaaatggctcggcagctggttttacgatgagctgacctatgaggaacgttcacccgatggaaaatggagaaaaccgggccgaggtccgaatgaagctttcgatctactcgtttatgccgatgcgctggccatattgcacggatacgaaaagatcaaatggccggatgcgcctgaatgggcgaggcgggcaacgtggattgaagaaagcacgccggaaactggcgaagcgtcacccacgttatcagcaaaaacgacccatagcagaaaaaaacggaaggcaaataagacggatgtcgaaaacaacccgtggactacatcatcaggaggctgggtgtgaaacaaaccgatattgaatccattatccagcgttataccgatgcggaaatagctgtgctggatggaaagtctataacattcaacgggcagcagatgacgctggagaacctgtctgaaatccgcaaggggcgtcaggaatgggagcgtcgtcttgcttccctgctggctcagcgtaacgggcgacccggttataagctcgcgaggtttccatgagcctgttagatgatgcgattggtgtcttttcccctggttggaaagctgcgaggttacgttcgagagcaatgatacaggcatatgaagctgttaagcctactcgtacgcataaggcccgcagggaaaatcgttccgctaaccagcttagtcagatgggagctgtttcacttcgagaacaggctcgctggttggacaataaccacgatctggttattggtgtattcgataagctcgaggaaagggtagttggagctaaaggaattattgttgagccacacccggtactaaaaaacggaaatatcgcaaaaaaactggcagaacaaatcagaacgaagtgggccgaatggtcagtcagccctgaggttacgggacagtttacccgcccgatgcttgagcggttgatgctcaggagttggctcagggacggggaaattttcgctcagatggtgagtggctcagcgcagggacttgatccagtggctggtgtacctttctggcttgaagcgctagaggctgattttgtgccgatgaccaacaatgagtcacagcaactttgtcagggggtttatgtcgataattggggacgcccgaaaaagtacctggtttataaaagtctgcctgttaccggccgtcaattggatacgaaagatattgatgccgggaatatgcttcatctcaaatttacccgtcgccttcatcaaaccagagggacgtctctcctttctggtgttctcatgcgcctcagtgcgctgaaagaatacgaggatgcggagttaacggccgcacgcatagccgccgccctggggatgtacataaaaaaaggggacgggcaaagttttacggatgagaacagcaaagataatcgtgatgtaatgattgagccaggcattatctatgatgatctccttcccggtgaagacatcgggatgatcaaatctgacagaccaaaccctaaccttgaaacattcagaaatgggcaattgcgcgccgttgctgctggtgctcgtctcagcttctccagtacagccagaaactacgatggaacgtacagcgctcagcgccaggaattggttgaatcaacagacggttatctgatcctccaggactggttcatcggagcaattacccggccaatgtaccgaaactggttaaaaatggcggtggcttctggcgaaattcagctaccacgtgggctggatatggcgtcgctttacaccgcagtttattccggtccggtcatgccgtggatcgacccagttaaagaggctaatgcatggaaagcgcaaatccgaggaggtgctgcgacagaatctgactgggtgcgagctagcggacgcaatccggatgatgtgaaacgtcgtcgcaaggctgaagttgatgataaccgcgaactgggactggtgtatgacaccgatcctgcaaatgataaaggaggcaccagtgccgaagtcaaagaaccggacgccccggcgtccgaaagccagcgcaagaagtaattcgtggtttcgtatgcaggccagcgccgacaatcaggtagaaatttatatctacgacgagatcggctactggggcgtgaccgcccggcagtttgttaacgaccttaaagcgcttggtgatgtgacccatattaatcttcatatcaattcgcctggtggcgatgtctttgacggcatcgccatttttaatgctcttaaacatcatggtgcgtcaattaccgttcatatcgacggtctggccgcgtctatggcctcggtcattgctatggtaggtaatccggtcatcatgcctgaaaacaccatgatgatgatccataagccctggggctttgctggtggtgatgccaacgatatgcgtgactacgcagagcttctggacaaggttgagtctgttctgatccctgcttatgcagagaaaacgggtaagagcgccgatgaaatagcggcgatgctggaagatgaaacatggatggacggcaaagaatgcgtcgctatgggttttgccgaccaggtcaccccctctcttcaggctatggcctgtatccagtctaaacgtattgaggacttcgaaaagatgccaaaaaatattcgcaacatgttaacgccgccgcgagctaccacgcaacgcgatccccagcaaccacaaatgcagcagccggtggtgagccaacctcccgtaattgacgaaaacaccattcgtgctcaggtaatcgctgagcaaaaggatcgcgttaatggtattaacaacctctttgcgatgtttggtggtaaacacgccgaactgcaggcgcagtgtgtagcagatatggattgctctgtcgatcaggctaaagacaaactgctggcgctgctgggtaaagatgcttcaccatcggcgaaaaccacgccagcgcatattcatgcaggtaacggtaattttgtcgccgatggtattcgccaggcattgatggcgcgtgccggatttgaagatcaggaacgtgacaatgtctacaacggcatgaccctgcgtgaatatgcccgcatggccctgactgagcggggaattggcgtatccagctataacccgatgcagatggtagggctggcgctgacgcacagcacctctgattttggcaacatccttcttgatgtcgccaacaaatcgattttgcagggctgggacgaagctgcagaaacctttgaactgtggacaaagaaaggccagttgtcggactttaagacagcgcatcgtgtggggatgggcggattcccgtctctgcggcaggttcgcgaaggcgctgaatataagtatgtgactaccggcgataaaggtgaaaccatcgcgctagccacctacggagaaattttttccatcactcgccaggcaatcatcaacgatgatctgaaccagctcacagatgtaccgatgaaaatgggccgtgccgctaaggcgactatcggtgaccttgtttacgccattctgaccaaaaacccaaaactctcagatggtaaggcgttattccacgcagaccacaagaacctgtccaccggtgctatttccgtcagcagcctggacgatgcacgtaaactgatgcgcctgcagaaagagggagaacgatctctgaacatccgcccggcatttatgctggtgccggtcgcgctggagacactggctaaccagacgattaaatcagcgagcgtaaaaggggcggatattaacgccgggattattaacccgatccagaattttgcagatgtgattgcagaggcccgccttgacgaagctgacgcaaaagcctggtatctgatggcggcaaaagggacggacaccatcgaagttgcgtatctgaatggtgttgatactccttacattgatcaacaggaagggtttaccactgacggtatcgctacaaaagttcgtatcgatgctggtgtggcgccgcttgattaccgcggcctggtgaaatccagcggccagtaatcattacagttctgaaaacgacgcccggaagggctttttttatacctgaaatcagccctgcggggctgacaggagacgttatggctaaaaattatgtgcaagacggcaaaaccatccccgtgaaaaattctggtaccgaggaaattctcagtggtacacccgtttctttaggcggaatgattgcggttgcaattaccgatattcaggcaggtgatgtaggcgacggattcgctgaaggtgtctttcttttacctaagctgccagctgatgccgtgaccgccggggaaaaggtatatctcaaagctggaaatgttcaactggatgacaccgatgcggtgttagccgggactgcctgggaggatgctgcggcaggcgttaccgtcctggaagtcaaaatcaatggctaatgcctttgacaatatggctgacagaatggatgaactgacggcgaaaaggctgggcagaacggtgactattaatggcgatgagcatattgctgttgaaagtcacctgctgcctgagctggggccggtcgctggggatgggattaacctggttatcttcagcgcaggctatcagtcggcgcggggagatgaggttatttataaaagtcaggtttacaccgttacccgatggctcctctttaatggtaagccgcaaatctggattgaggaggtcacaggtgacgattaaagggctggaagagctcaggcagaacctgagcaatatcagtaaaaatgccattcctcgggcgacatcccagtccattaaccgggtggctggaagggcaatcagccgcagctctacgcgcgtggcgaaagagactaaggttaagcgaaaactggtcatgcagcgcgccaaacttaaacgggcaagccctaaaaaaccaatggctaccatccgggtaaatcgcggcaacctcccggcgataaagctggggccagtacgagttcaactttcacggcgaaagcgcgacaacggtagttctggaagcgttctgaagattgggaatttcagcttccctggtgcttttgtgcaacagcttaataatggtcgctggcatgttcttcgacgaaccagtaaatctcgttacccggtagaagtggtgaaagtacctctggccacccccctgactgctgcattcaaagaagaacttcccaaactgatggcatctgatatgccaaaagaaatgatggctgcgatcaaaaatcagataaggctggtaacaaaatgattcacccgcaagtacgaaaagctgttctggataaactgaagtcaatcaaccccggaaaaatattctggtatgacggtcggccagctttcctggctccagaagagttacctgcggtcgctgtatatcttactgatgcaaaggcgacgggcggcagtattgatgaggaagagtgggaggctgtccttcacattgaagtattccttaaagcaactgctaccgatagcgagctggataaatggatggaaacccgcatctatccggccatggctgacgttcctgagcttgccagtatcgttgaaaccatcagcgttgccgggtacgactaccaacgtgacgatgaagccactacatggggctccgccgatctccaatattccctgacttatattatgtgaggactatatgccaactccaacacctaccacgccgacgaaaggtgccgggacaactttttggatttataccggaactggtgatccctacgatgatccgttaagtgatgtcggctggacacgaacggcaaaggttaaggaattaacaccaggggaactgaccgcagagtcctatgatgattcctatattgatgatgatgcgcctgactgggatgcaacagctcagggtgttaagtcagccggtcaaaccagcgtaacacttgcctggaaacctggtgaatctggccagaaggatctggttgactggtttatgagtggtgatgaaaaatcttacaaaattaaatatccaaatggggcagttgatgttttcaccggctgggtaaatagtttgggtaagactatttcacgaaacgaagttattacccgtagtgcacaaatcaccaataaaggtaaaccttctctggctgaagataacgcatcgactaacccttaatatattcatcagcggtgctaaggcaccgcgaaaggtaatgaaatgacttatcttaaaaaagacacattaaatcccgatggtgagaatattttactgtttgagttatcggcttacagtagaatgcaatatattgaatttatggttgaagagaggaagtcattaccgtcagaggaaagcacacctgaagaaaactttaaattggccaccttgttgactatgcgtgatcaggccatgctcgttgcattgtccttgagcgaggctgatgaagagcaacgtgaagggaaagatattttccctgaaattatacgaaaatatccaccagggttattgggcagcgctgcattacttgtgcgtatgctttcagggatgatcccaccagttaataatgacactgagaaaactgaagaagaggaagagccagatttggaaaagtcctgacccgctcacgtcgctttgctatgcgattagccagggagtttggacggccagactggcgcgcaatgctttcggaaatgtcttcctctgaatggttcgaatggattgagtattaccaggataattgttttagcgacgacctcctggactctcattttgccaatcttagttatcttgctgtcagtctctttaccgatccggataaacacggaattacctcccttgattttagtttgttatcaaaacgtgagggagaaagtgagttggattcagacgagcaacttatgtcgatagccgaaagcattcctggaggagttcgctatgtcccagccagtgggtgatctggtcgttaaaattgacggcgatagcgcaaaatttgatgaggaagttgctcatctgaataagcagctgagcgggttaggtagagccgcgaacgacagtacagcgcaggtcaccgcagctttcacgcggcaggagcgtgctgcaaaacgtgctggtatttcaatcggccaatacaataatgcaatgcgtatgttgcctgcgcaacttactgatgtcgcaactcagttagctggtgggcagagcccatggctaattttgctccagcaaggcggtcaggttaaagactcatttggtggcctgatcccaacatttcgaggattacttggagctgtaagcccgttggccgttggggttgcagctttgaccgccgcaggtgccggaattggatatatcttctatcagggaacgtcaaccctttccgattttaataagacgttgacgctatcaggcaacacggctggtctgactaccgacagaatgctggcactggcaaaatcgggacagcaagcaggactcacctttgatcaaaccactgattctctgactgcattaattaatgctggcgtgggggcgggtgcgcgttttgatgaactaagccagtcagttgcaaaattttctacggcatctggtatccccattgaaaaggttgcggaagcgttcgggaaactgaccaatgacccgacatccggcctgattgcgatggcgcaacaatttcataatgtgacagccgagcagattgattacgttgctcagttacaacgttcaggagatgaagccgctgcacttcaggcggctaatgatgcggcgacgaagggatttaacacccagactcagagcctgatcgataacatgggaacgattgagcgctctgctgattcgttgaaacgcgcgtttaaatccatgtgggatgctgctctggatttggggcggcctgacaccgcaggggagatggtaagcaaggcgcaatcagcttttaagcaggctgatgacatctggaatctcaggaaaaatgatcgctatgtaaacgatgaagccagagcccgtttctggaatgacagggagtcggcccgactggctcttgatatggcgcagcagcaagcaggtattgccaaagccagcgcagcagcggccgaaaaggaagcggaggcagaatctgaaaaacagaaatatgccgctcaagcacaagccaattatgctaaatcgcagactgcgcttgaaaagtatactgccaggcagaatgaattaaataaagctctgaaagaaggacatatcctacaggctgattacgccatcaatatggccgcagccaagaaagaatatgaggccaccttaaaaaaaacgccgaaaccaaaaggcgttaaagtttctgctggtgatcgttcttctgatcagactgatgccgaaaccctgcagttgatgacgcagttaaagttgctgcaacagcatacggggcttaacgataccatcagtcagcaacgcaaaaatttgtggtctttacagtcaaaattcgcggttatagaagaggcgtcgaaaacacgcgcgctgagtaaagaggaacaatctttactcgccagcaaggataaggttctggcgcaggctgaggttaatgcgaaacttggcgatcagatcgttgctcaggaacgtcttaataagcttcaggataactcgttaaaatatgttactcagatgcaggaaaagactgctgcactgacagatagtgctgggttaagtgacaaggacgcacaacgtaatagagagagggcgcaattaaggcagggatggaaaaatcaggggggaagcctggaagatgaagggtatcagaaagagctttccgcacttgagggttattacgctgcacaggatgaaatgcgtaataactggttggccggcgttcagtcgtcatgggaaaactatgctgacatggccaccaattacaatcagatcgctgcggatacaaccaatactgcgctcggaggagtaacaagcaatctccagcaggggttatatgatcttgcaactcagtctgaagatgctggcgatgccctgagtaacatggttgaaggttttggtaaaacagtcatccagaccctggcccagcttgctgcacaatggctggtatatcagggggtgcagctgcttgtcgggaaaacaacacaagctgcagctgcagcccctatgatcactaatgcacaggctacagcattacaggctcaactggctgcatatgcttccactgcagctattccaatcgtgggcccggctatggctcccgcagctttgactgccgctattggtgtcacagagcctctagttgctgccatctcaggattagcccttgctggcatggcgcacgacggcattgataaaattccggaaacgggcacctggctgctgaaaaaaggggagcgggttacgacggcaggcacatcagcaaaactggatgccactctggaacaggtgcggaaacagcgttcccttgccggaaacccgctgcatgttgagttcaataacacctacaccgggaaaccggacgatgcaatggtccaaatgttggatcagcggcagcgtgcatctgaaaaaaggcttaagcaatattttacttcccaggttattaatccaactgagaattatggtcgatcacttaaatcagtttatccggggaggcgtaagaaataatgaccgatatttattatcctcatgattgtatccccggccccacgtacgataattatggatttgaaccgactgatcctatgattcgaaccgatagggtgggggggcttgccaggcagcgtagaaaatatacatcagtgccgactgataatacggttgtctggcagtttaaaactgacgcgcaagcacaggcatttgaagcatggtacagggatgtattaactgatggtgttgcatggttttacatgaaatgcaaaacacctgtcggccttaaattttttaaatgccgatttgtaggtatttataaggggcctacctttattaaacccggtctttggcgttattctgcaactgttgagttaagagagcgtccacttgctccagttggctgggggaaatatcctgagtggattgtcgggagttctttactcgatatagctctgaacagggagtggcctaaacatgacagcgattaaccgcctttatgcgtcctccgggtctgaggtcatcattggtacattgcagatcgatattggcggccagacgcattatttgtgtgagggttatgaggacattacggcggttaccgaggggggcgaaaccgtaacgtttattgcctgtgccattgtcctttcccttccagccagaaacgaagatgggacgcaggacctgaagtttatgctgtgcaacatcgacggcgttgtatccacggctattcgcaaggtcattgatgccatttccactgccagcatcacattcaggaaatatatttccactgaccttaccgcgccagcggagccgccttacgtcatgccggttaaaggaggctcctggactccgcttactgtaaacgtcaccgccggatttaaaaatatgctcgattatgcctggccacgtgacagatacacgttgacgtacttccaggggctccgttactcccgataggttccttatgctcaacattgacaaatacctggctgtccgctggcagatgggcggccgcacttttcctgttctcgactgctacggcattgtacatgaggtccgccgggacctggggctgcctgaatggcccgcgtttgaggcggtgattaaagagcgtggaagctccgaaatgggggaagtctgcgagagtttttcgcgtgacctgactccctgcaagccgtgcaacggtgcggttgccgcctgctatatgggaaatatgatcggccaccttggtgttgtcgtcgaaatggagggagcgctttacgttattgaatgcaatccccggcgcaacgtaaccattcttcccctggcgcgttttgagcgtcagtttctgaaagtggagtattaccagtgacaatccgcctttacccgtcgcgtttgcctggcgaaccgctggagacgcatgaacacagggatacgaccatacatgactggatgctccagcatgtcgataactaccgtaacgatatggtgcagcgtgttgccttcgaagttaacggtaaaccggtcccaccggcagaatggccgttatgttttatcagcgctgagagcgatgtaaaagtttatccgatcccgggtgagggggtttctgcggcgactattgcggcatgggcggcagcggctattgctgcagcatcggctgtttatgtgctgatcaccatgtctaacatggataaaggcggctactcatcatcaaatgggctggggctggatttaaacccggctaaagcgaaccaggcgaagcttggcgaccccatacgtgaggtgtttggccgctgccgtatttatcccgattatgttgtgcaacccgtgacccggtttaaccctgatgatccgacgcgaatgactgtcgaaatgatggtttgccttggaaaggggaatttcgcgtttacgaatggtgatatccgtgtaggttcaacacctatttcagcattaggggactcgttcagttacaacgtttattcacctggagcagatgtttcaggagatcggcgaagtgaaaactggttcaactcgacagaggtaggtggtacttccagcgggagtgggcttgatatggcgcagacctcgccagattcgacagatatcaacgctgatagtatgaccgtttctggcgcatccgtgacgtttaacgggctggatgatggcaacgatgatgacgatgaaggcaatgcgttgcctgagtcgtgggttgagggggccattgttacgatcgtcgcaccgatgaattttctggtttcaacctcgtcgggatatagcgttctcgccagtaactctctgggtgaaattaatccctatccggggatgccggttaccctggaaatcaacggcactgaatatgaactggttattgcaacttatacggcaaaacaggacgcgataccgggagcgggtggaaacgcggccagcctgaaagcaaatgcctccccatcaacatatgattactccggtactggccagacttttacgatcacctggcagggacatgaatacaccatttccctcattgcggactatgtgaatatgtccggcctgctgatggcgataaacgagggcctgaccggatcaggattactggcgcaggatagtggcggtgttgtgctgattgctgaggcatcaagcccctggctcggcggaaacattacctcatcatcgctcccggtagccgtttttggcgacagtcctgtatttacctccggcaccgcgtccagcggaggcagtccggcaataactgctaacgttacgctggcgtatgggagtgcaaccggagtggcattttccgggataccggagggaacacaacgcctggcgctggctcaccgtggcaacgagtaccgcattgcggatgcggacggtacgaccgcaacggttcagcggctgattgagggagtggttgatccttcctggtctggcttctcaccccgcacgatgattgactatcaggctacagggatcagcgacaacaatacctggatggggccgttccttgcctgcccggaatctgaagtggtggacgctttcgaggtgaatttctcctttccgtctggcatttgcggattcgacagcaaaggcaaaaaacgcatcaggcattgtgagtgggaaatacagtaccgtgtttatggatctggctctggctggacgagcaggcagggggtttacgcgcttaaaaatatcaacgggttgggttttacagagcgttttgatctctcttctcctgggctggttgaggtgcgctgtcgccgccgcaatgagcagggtagcaataacgcgcgtgactcgatgtactggcaagcgttgcgtggtcgcttgttggctcggcctacatcctatgctggcgtcaccctgatgggggttacggttgagacggggggcaaattggcggctcagtctgaccggcgcgtaaacgttgtggccacgcgcatttatgactctggcgtagcccgtagtatctctggtgcgctttatcacgtcggccgttctcttggtatggaaatggatactgaggcaatagatgccctggagcagacttactggaccccgaacggcgagtatttcgattttgccacgggtgacagtatttctgcgctggaaatgcttcagaaaatcgctgcagccggaaagagttattttctgctaaatacccagtctgttgcatcagtgggtcgtgaaggtgttaaaccctggaccggggctatcacccctcacgagatggtatccgagatgcagaccgatttcgttacggtgactgacgatgattacgatggtgttgacgtaacctatatcaacggatcgacctgggcagaagagacggtgcaatgccgtctgcctggcaacccaacgccgctgaaaatagaggcataccgggctgatggggtaggcaatcctgatcacgcataccagattggtatgcgccgactgagaaaataccagctgcagcgtatgacgcataaaacgacgacggaactggacgcgctctgttacaacgtcggggatcgtattgtgctgaccgatgatatccctggcagcaacaccatttcgtgtttgattgagtcgatgactactgctggtggggtgaccacattcgatgtgtcggagccgctggactggacttttacaaatccacgcgtctatctgcgttatcaggatggaaaagcatcacggctgtttgaagcatcacccacaggcgacaactatcaggtatccgtcccgtatcaatctgaattcgcagatatcctgctggatgatccgataattgagcctccccggttaattttctgtagttctgagagcgacctgtatcacgccattgtgtccgagatagtgccgcaggacgatggaacctgcgagataacggcccggcaataccgtgctgaattttatgactacgacgacgccacataccccggcgacgctgcttaataccaaaaaaaccctttcaactttatctttcgctcaaaccctcgtttgcgcgaagcctctttttggagcaaaaaacatggccgaacttaacccgcctttgggaacgacgacgcctgaaatattcctggataacgtcaagcgcgctgacgagctggttaacggtccggccggaacggttaacgaccgcgcaggcgaaccgctcgatacctggcgccagatgatggctaagaatgacgaagttcgg

SEQ ID NO: 55 - DNA, 384542 bp, Unknown
  source: /note="Description of Unknown: KP2-Mcoc1 Bacteria Sequence"
tgtgctcacgagtctgcggcatcgggccgtcagtcgcagcaacaaccaggatcgcgccgtccatctgcgcagcaccggtgatcatgtttttaacatagtcggcgtggcccgggcagtctacgtgcgcgtagtggcgagtcggggtgtcatattcaacgtgagaggtgttgatggtgataccacgagctttttcttccggcgcgttatcgatctggtcgaatgcgcgagcggaaccaccgtaggttttagccagaacggtagtgatggcagcagtcagggtagttttaccatggtcaacgtggccgatagtaccaacgttgacgtgcggttttgtacgttcaaatttttctttagacacggctatattccttactatagtgctctccccttcggagagagcacgggacttaggttttaatcctgtggattatttaccacgggcttcaataacggcctgagcaacgttgttcggcgcatcatcatacttcaggaattccatagtgtatgatgcacgacctttggtcagagaacgcagctgagttgcataaccgaacatttcggacagcggtacttcagcgtggatcttaacgccggttacttcggattcctgaccgcgcagcataccgcgacgacggctcaagtcaccgataacgtcaccagtgttctcttccggagtttctacttcaaccttcatgatcggctcaagcagaactggttttgctttcttaaagccttctttaaaggcaatagacgcagccagtttaaacgccagctcagaggagtcaacgtcgtggtaagaaccgaagtgcagacggatacccatatcaactaccgggtaacctgccagcggaccagctttcagctgttcctggatgcctttatcaacggccgggatgtattcgccaggaattacaccacctttgatgtcgttgatgaactcgtaacctttcgggttagagcccggctccagcgggtacatgtcgatcacaacgtgaccgtactgaccacgaccaccagactgcttggcgtgtttaccttcgatatcggtaactttcgcgcgaatcgcttcacggtaagcaacctgaggtttaccgacgttcgcttcaacgttgaattcacgcttcatacggtcaacgatgatgtcgaggtgcagctcacccataccggcgataatggtctggttagactcttcgtcagtccatacgcggaaagacgggtcttctttagccagacgacccagagccagacccattttttcctggtcagctttggttttcggctcaacggcgatggagattaccggctcagggaattccatacgctccagaatgatcggcgcatccgggtcacacagggtgtcaccagtagttacgtctttcagaccgatagcagcagcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtacacgcggaagaaggtcaggttacccacgaacgggtcggtagcgattttgaacgccagtgcagagaacggctcgtcgtcgcttgcgtgacgctcagccggggtatctttaccgtcgtccaggataccgttgatcgcaggtacgtcaaccggggatggcaggtaatcaattaccgcatccagcatcgcctgaacgcctttgttcttgaacgcagaaccacaggttaccaggatgatttcgttgttcagaacgcgctgacgcagagcttttttgatctcttcttcagtcagttcttcaccacccaggtatttttccatcagctcttcagaagcttcagctgcggattcgatcaggttctggtgccattcatcagccaggtcctgcatgtcagccgggatatcttcgtattcgaaggttacgccctggtctgcatcgttccagttgatggctttcattttcaccaggtcaacaacgccggtgaaaccttcttcagcaccaattgccagctgcagcggaaccgggttcgcgcccagacgggttttgatctgaccaacaactttcaggaagttagcgcccatgcggtccattttgttaacgaacgcgatgcgcggaactttatatttgtttgcctgacgccatacggtttcagactgcggctgaacaccaccaactgcgcagtaaaccattaccgcaccatcaagaacacgcatggaacgttctacttcgatagtgaagtcaacgtgccccggggtgtcgatgatgtttacgcggtgcggttcatactgtttggccataccagaccagaatgcagtagtcgcagcggaagtgatggtgataccacgttcctgctcctgctccatccagtccatggtagcggcgccgtcatgaacttcaccgattttgtggtttacaccggtgtagaacagaatacgttcggtagtagtggttttaccggcgtcgatgtgcgcactgataccgatgttacggtagcgtgcgatgggtgttgtacgagccatttgattcctcgtttatttctttaggcgttcagttaagttatccagagcgggcgactcatctgaagcgcccgcctggtgactatgactccgaagggattaccaacggtagtgagcgaacgccttgttggcttcggccatacggtgaacgtcttcacgtttcttaactgcagtacctttgttgtctgcagcatcagtgagttcgttcgccaggcgcagagccatggatttatcaccgcgtttacgagcagcttcaacgatccaacgcattgccagggcattacgacggaccggacgaacttcaactggaacctgataagtagaaccacctacgcggcgggacttaacttcgacagtcgggcgcacgttttcgagcgcaacttcgaaggcttccagttcagatttaccagaacgctgagccagggtctccagcgcgctgtatacgatagtttctgcagtagattttttaccatctaccatcaggatattgacaaatttagccagcagttctgatccgaacttcggatccggcagaattttacgctgaccaatgacgcgacgacgtggcatggaaatactccgttgttaattcaggattgtccaaaactctaagagtttagtatgacattaagataaatcagtttggccttacttaacggagaaccattaagccttaggacgcttcacgccgtacttggagcgagcctgcttacggtctttaacgccggagcagtcaagcgcaccacgaacggtgtggtaacgaacacccggaaggtctttaacacgaccgccacggatcaggatcacggagtgctcctgcaggttgtgaccttcaccaccgatgtaggaggtgacttcgaaaccgttagtcagacgcacacggcaaactttacgcagtgcggagttcggtttcttaggagtggtggtatatacgcgagtacatacgccacgtttctgcgggcaggcttccagcgctggcacgttgctctttgcaactttgcgcgcgcgtggtttgcgtaccagctggttaattgttgccattaaatagctcctggttttagcttttgcttcgtaaacacgtaataaatcgcctcatatattatgaggacgcagaattttagggcggtgccgaaaaggtgtcaagaaatatacaacgatcccgccatcaccaggccaactgaccggcatgtttgactgtgagtctgacgaaatcagtatagctaaccctgccgacactgtccgcaatttgaccagccagcccgcgggcgtcaacgtcgtcttgcagcacgtatagggttatgggggcggattgcaggatctcaaggaagcgaccatcggcgatggccgcggtgacgccgtcagacagtagtaccagatcgtcgccgtgctccatcaaacgaagcatcgctgcgatgtcggcatgccagggggaaacactgagcgtatggagcatgggggcctcagaaacgcaaaatcacatcatattcatgcagacgggcgcgcagggcatccggcgccaggcattcgacatccaccacccacggggtcgcgggatccaggccgcgctctcgcgctgagtcggcgcacagccagcactggtcgatatcatatagcgacagcaatttaaaggtagcgatgtagtcgcgggccagcacagcgccaggccgctgttcgggtaacagctgaaacacgccgtcgcccacaaaaaacacgccaatatcgtcggtgagcgcggaggttgctaataaggcatcgaggccttccctgccggcggcgctgccgtgcggcgcagaggaaaatacaaaagccacacgtttcatcagaactgcaccatccgatcgcaagtaagcgccgcttccgctagcgcgccgagcccgctcaaggtaaaacccggctgcaaattgtggccaggcagagcgagctgttgcgcttcgcgttcgtccgttacgccacgacgcagggcggccgccacgcagatatgcagcgcgacgccgtgctcatcgtggagggattgccacccgcgcaccagatcgaactcatcgctggcgggcgccgtcaactggttagcgttaagcacgccttcgcgatagaaaaaaacgcacgccagctcatggccttcctgcagcacggcctgggcaaattgccaggcgctgctcgcctgctgcgtgccataggctgggccggtcaccgtgagggcaaaacgcattacttatccagcccctggaaatcgccgcttttgaactggcgaatatagaggtagacggtgtgcttggagatgttcagacgatcggctacctggttaatagcgtctttaatatcgaagatccctttctcgtagagattcagcacgatttgacggtttttcgcattgttagacacgctgcgatcggcattcacctcttcaatggtgaactccagcgtctgggcgaccagatcgtctaccgaagaagcaaagttcaccggcgagttcacttcaggcgtttctggcggaataaaggtgctcatgatctgggaaaacggcacatccagattcatgttgatacacagcagaccaatcacccggtgatcgcggttgcgaatggcaatcgtcaccgacttcatcagtacgccgcttttagcacgggtaaagtagcatttggaaacgctgctatcggcgcccgtcatatcgtgcagcatgcgcagcgcaagatcggtaatcggtgaaccgatttggcggccggtatgttcaccattggcgatacggatggcagagcatttcagatcctgcaaagaatgcagcacgatttcacagtgcgaaccgatgagcatcgccaacccgtccactaccgcttcataagatttgagaatatcgaaatcggtctggtcaaagggacgttgatccagcaggtcaagctcgctggtttcattggttaaaagcgacctggacatgaaaaaaagcactccttttcaggagcctgtcgttattgtcagggcaggctcatcatcattattaagctatctaaagtaatacagcgcctgaggatctttccagttttaattatatctgcgctcaataaaaaagccgccgcctctgacgagacggcggcctgaacctgattacttcttagcgtcagctttcgcgtccgcggctttcgcatcgcctgcggcttccggctgtgcatctgccttcggcgccggtttgatatccagcagttctacatcaaagaccagcgtagagttggccgggatgcccgggacgccagttttaccgtaggccaggtccggcggaataaccagcttgattttgccgcctttcttgatgttcttcaggccttcagtccagcccgggatcacgccgtcgagacggaaagagagcggctcgccgcgagtataagagttatcaaactctttaccgtcgatcagggtacctttgtagtttaccaccacggtatcgctgtctttcggcgcatcgccagcgccttctttctcgactttatacagcaggccagtttttgaggttttcacgcccttctctttggcaaagttgtcacggaaagctttgcctttagcttcgttctcagtggcgtctttttccattttctgctgagccgcggtcttcacgcgcgtttcaaaggcctgcagagtctgttcgatctcctggtcggacagtttgctcttatcggcaaacgcgtcctgtacgccggcgatcagctgggctttatccagcttaatgcccagcttctcttgttctttcagggagttttccatgtaacgccccagggacgcgcccagcgcataggccgatttctgatcgtcatttttaaatgccgatttactctcagccgccggggctgccttcgttgccgtatctgcagcgaaggtcagcggtgcattcagggcgacggccattgtggccgccagcagcgttactttaaacagtgatttcatccatttctccagggccggggcctctcgccccagggttatcgtaaaaagcaaaaaacgtactatagaacgttgccgttaaaatctacatacggacgttcctgaatatcgcctcttttaggactatttttgtatgaataagtttcctgtacggcgcagcgatgctgcgcgccaggggaaacttaagtagaatccgcccgcaggatcagactaaagaggttacccatgcacgatagcacattagaaacgcgccttgcggagctggaaagccggctggcgtttcaggaaatcaccatcgaagacctcaacaaaaccgtgaccgcccacgagatcgagatggcgaagatgcgggagcatatgcgtctgatgatcgagaagctgaaggcgacccaaccctcccatatcgcctcccaggcggaagaaacgccaccgccgcactattgaggcgtaaaaaaagcgggtttccccgcttttttgtcgtcttcgtgccgaagcgcaaagattagtggcagccgcagccaccgtggccgccgcagccgcctttaccatggtcgtgaccatgatcgtggccgtggccgccgcagcaaccgtcatgaccatggtcatgatcgtgatcgtggccatgcgcgccgtgcacgtgaccgtgctccagctcttccgcagtcgcttcgcggatggcgacgacttccacattaaacttcaggttctggccagccagcatgtggttgccatcaaccacaacgtggtcgtcttcaacttcagtgatttctactggtaccggaccctgatcggtttccgccaggaagcgcatgccaacctgcagttcatcaacgcccatgaagacgtctttcggtacacgctgcaccaggttttcgtcatactgaccgtaagcgtcgttagcgccgacggcaacgtcaaatttgtcgcccacttcgtggccatccagcgcgttttccaggccggaaatcagggagccgtgaccgtgcaggtaatccagcggcgcgcttaccggagactcatcaaccaacacaccgtcttctgtacgtacctgataggccaggctgaccaccaggtcttttgctactttcatgatatctcctgagatgggaagaatagtggcgcagattgtagcggaattctgctgccgtgtaccctttagcttaaaaaaagccgacggataacgctagtcgggatgaaaaatgccaatcacctgctcctctttgcgtacatgctcacgggcctctttatctgcctcacgcatctgatgaccgcacttaacgcactcaacaacatcgacattattctcacgccacattgccagcgaatcctgcgcctggcacgccggacatttcgccccggcaataaaacgtttacgcactgccataagatttacctttattcaaactcgtcccagccgtccagctgccggctctctttctgcatttcgcgctggaaaatctcttccagttcgcgccgggcctcccgcacgcgtgatatctgtaccgtatcagtatgcactggcattagctcgcgcagcattcgcatatcgaggcgtcggaagtgcagctgcgcgcgctgggcctggtgaggatgcatcccgagggtgatgagcgctttgcgccccagctccaacgcactggagaaagtttcacgagaaaactgcgtcacgccggcctgcagcagctcatgcgcctcaacgcgtccgcgagcgcgggccagaatatgcagatgtggaaagtgttgttgacacatttccaccagccgcatggtatcttctggctcattacaggtgatgacgatcgactgcgcctcttccgctcccgccgagcgcagcagctccagctgggtggcatcgccaaaatagactttatagccatagttgcgcatcagatttaccgcgctgatgtcccgctccagtaccgtaatacgcatcttattggccatcagcaggcgaccaatgacctgaccaaagcgaccaaacccgacaataatcacctgcggcttgtcatcctccacccacggcgcctcaccggtatcgtccgccggattcagccgtcgcgacaatagcttatctatccccttcatcagcagcggcgtcgtcatcatcgacaacgttaccgccaccagcagcagcgccatctggtcgtgctgaaacaatcgctgagaggcgggcagcgaaaagaggacaaacgcgaactcgccgccctggcttaatacgcccgcgaactgcatccgctcggaacttcgcaggccatagagacgggccagcagatagagcaccagcatttttaccgccaccagcaccgccacgctcaccgccacccacagcagatgggtatacagtacgccaaggttcagcgccatgccgacggaaataaagaacaacccgagcagcagccccttgaacggatcgatagcgatctccagttcgtggcgatactcactttccgccagcagcacgccggcaataaaggtgcccagcgccatcgacagccccagcgcctccataaacagggcagatccgaggaccaacagcagcgtggcggcagtgaacacctccctgacccccgagctggcgataaaacggaacaccggccgcaacagatagcgtccgccaatcagcatcccggcaaaggccaggaccttcatgccgaccgtcaaccagttcacatgctcatccgctgaaccggccagcaggggcaccagcgccagcgccgggatcaccgccagatcctgaaacagcagcaccgaaaagcctagctgtcccgcttcgctgcggctcattcccttctcacgcatcagctgcagcgccatggcggtggaagacatcgccaggccgatcccgccgaccaccgccgcctgccatgaaaacccggtcgtcatcagcaacccaccgaggatcgccgcgctgagcatcacctgcgccgcgccaacgccgaagatggagctccgcagtcgccatagcttggcgggattgagctccaggccgatgataaacatcagaaacactacgccgagctccgagaaatggagaatttcatccacatcgctgataaacccgagcccccacggaccaatggcgatcccggccagcagatagcccagcaccgcgccaatccccagtcttgcagccagagggacggcgatgacggccgcgaacaaaaacagcacccccgccagcagcaaatcagatcccgccatggacacctccggcggcgatggggttggccaaccagtcccggtaggccagggcgcggctgcgcagctcctctggctgctgcctccgggcccagtagacgataatggggctcatccagtgcatacggcacatgccggcggtcagttcaaaaggacgtaaaatatcgttcatcggatagcgattagcatcgcgacggtaggcgctctcaggctcgccggtagtgatcacgctgcgccagtactttcccgccagttcgttccctccggcgccgctggcgaagccgcggcttaacacacgatccagccactccttaagcagcgccggacagctccaggtatataaagggtgctggaaaacaatcacctcatgccggcgcagcaggtcctgttcgtaagcaatatcgataaaaaaatccggatagtgcgcgtagagatcgtgcacggtgacgttcggcaactgtaaggccggctctaataaaacccggttggccacggaatcctgagattctgggtgggcatacagcagcaacactttcgctgtctgagacatcattcccctcccgtaggtcttctggcggcctgcacagccccggcgttttgacacagccagaatgactttgtgtatcgtcttcgttttgggctaccatggcggcccggtgaagcgattcgcttccacactacattatcataatgacaaattaacatagtctgaacatacggcgccttatgattgttttctcctcgttacaaattcgtcgcggcgtacgcgtcctgctggacaacgccaccgctaccatcaatcctggccaaaaggtcggtctggtggggaaaaacggctgcgggaaatcgacgctgctatcgcttttgaaaaacgagataagcgctgacggcggcagtatgacctttcccggcaactggcagctggcctgggtgaatcaggaaaccccggcgctaccgcagccggcaatcgattatgtcattgacggcgatcgagagtatcgccagctggaggccgcgctccagcaggctaacgaacgcaatgacggtcatgctatcgccaccgtccacggtaagctggacgccatcgacgcctggactatccgttcgcgcgccgccagcctgctgcacggtctggggttcagcaatgaacagcttgagcggccggtcagcgatttttccggcggctggcgtatgcgccttaacctcgcccaggcgctgatctgccgctccgatctgctgctgctcgatgaaccgactaaccacctcgatctcgatgcggtgatttggctggagaagtggctgaagggctatacgggaacgctgatcctcatctcccacgatcgcgattttctcgatcctatcgtcgacaaaattatccatatcgaacagcagacaatgtttgagtacaccggcaactacagttcgtttgaagtgcagcgcgccacccgcctcgctcagcagcaggcgatgtacgaaagccagcagcagcgcgtcgcgcacctgcaaagctatatcgatcgcttccgtgccaaagccaccaaggctaagcaggcgcaaagccggatcaaaatgctggagcggatggagcttatcgctccggcgcacgtggataacccgttccacttcagcttccgccagccggagagcttgcctaacccgctgctgaagatggagaaagtcagcgccggctacggcgagcgtattattctcgactccatcaagcttaacctggtgccgggctcgcgtatcggcctgctgggccgcaacggcgccgggaagtcgacgctgattaagctcctggcaggcgagctccagcccgtaagcggcgagatcggcctcgcgaaaggcatcaagctcggctacttcgcccagcatcagctggaattcctgcgcgccgatgagtcgccgctgcagcacctggcgcgtctggcgccgcaggagctggagcagaagctgcgtgattatctcggcggctttggtttccagggcgataaggtgagcgaagaaacccgccgcttctccggtggagaaaaggcgcgcctggtactggccctgatcgtctggcagcgccctaacctgctgctgctcgatgaaccgaccaaccaccttgacctcgatatgcgtcaggccttaaccgaagcgctgatcgactttgaaggggcgctggtggtcgtatcgcacgatcgtcacctgatccgttccaccactgacgatctgtacctcgtccacgatggtaaagtcgagccgttcgacggcgatctggaagattatcagcagtggctcagcgactcgcaaaaacaggagtcccagagcggcgaggcgccaaaagagagcggcaatagcgcccaggcgcgcaaagatcagaagcgtcgggaagcggagctgcgcagccagacccaaccgctgcgcaaagagatcgcccgtctggaaaaagagatggacaagctcaacgcgcagttggccagtgcggaagaaaaacttggcgacagtgagctttatgacgcctcacgtaaagccgagctgaccgaatgcctgcagcagcaggccagcgcgaagtccgggctggaggagtgcgagatggcctggctggaggcccaggagcagctggagcgcatgcttcaggaaggctaaactcttcctcttcatcctgcctgcgcgtacgctgccgctggcagggtgggtttctgccctcttcatggcctggccatcagcgacatcaatgatttgtttttgctgtaagctggcgtcactggccgcaagaccacatattggctaaccccctgcatgccctgcgcggtatagtcatcatcacgtttattaattgttctggtgctatggttgaaatcatccccacagacatgacgccccccgaaaacgattcgcgtgagttccatccgatgcgcggcgtgggcaatcgtcatctgcaaaccatgctgccgcggctgattcgccgtaaattgcgctttaccccgcactggcagcgccttgagctgccggacggcgattttgtcgatctggcctggagcgaagacccgcaccaggcgcgccataagccgcgcctcgtcgtttttcacggcctggaaggcagtctgcacagcccgtacgcccatggtctgatccacgcggcgatgcagcgcggctggctgggcgtggtgatgcatttccgcggctgcagcggcgaacctaaccgcaatcaccgcatctatcactccggcgaaacggaagatggcacctggtttttgcactggctgaagcgcgagtttggtcccgcgccgaccgcggccgtcggctattcgctgggcggcaatatgctgggctgcctgctggcagaagaaggcgaccgctgcccgctggatgcggcggtgatcgtctccgcgcctttcatgctcgaagcctgcagctatcatatggataagggcttctcgcgggtttatcagcgctatctgctcaatctgttaaaagccaacgcttcacgcaagctgaaagcgtacccgggctcgctgcccgtcgatttacgccagctcaaagggatgcgccgcatccgggaatttgacgatatgatcaccgccaaaatccatggctttgccgatgcgctggattattaccggcaatgcagcgccatgccgcggctcagcgatatcactaagccgacgctcatcattcacgcgaaagacgatccgtttatggatcaccactctattccgccgcaggagcaactgccagcgaacgtagagtatcaattgaccgagcaaggcggccacgttggctttgtcagcggcactctgcgtaaaccggagatgtggctggaaagacgcattcccgactggttaaaccgctggctggaggttcccgtatgattattccctggcaggatctggatcccgaaacgctggataacctgattgaaagctttgtgttacgtgaaggcaccgattatggtgaacatgaacgttcacttgccgataaagtcgccgatgtaaaacagcagctgaaacgcggagaggcggtccttgtgtggtcggaagtgcatgagacggtcaatattatgccgcgcgcgctgtttaacggctaaggcgacgccactacatcgtttaaccagggagttgttatgtctgccaaacatccggtgatcgccgtcacgggctccagcggcgcgggcactaccaccaccagccttgcctttcgcaaaatcttcgcgcagctaaacctgcacgccgcggaggtggaaggcgatagctttcatcgctacacccgcccggaaatggacatggcgatccgtaaggcgcgggatcagggtaaacatatcagctactttggcccggaggcgaacgacttcggcctgctggagcagacctttgtcgactatggtcgccacggcaaaggtcagtcgcggaaatacctccacacctatgacgaagccgtgccgtggaatcaggtgccggggacctttaccccctggcagccgctgccggagccgacagacgtgctgttctatgaggggctgcacggcggggttgtcacgccgcagcatgatgtcgccagccatgtcgacctgctggtcggggtggtgcctatcgttaacctcgagtggatccaaaagcttattcgcgacaccagcgaacgcggccactcccgggaggcggtgatggactcggtcgtccgctcgatggaagattacatcaacttcattaccccgcaattttctcgcacccatatcaactttcagcgcgtgccgacggtggacacctccaacccgtttgccgccaaagcgatcccctcgctggacgagagctttgtggtgatccatttccgcaatctgcagaatatcgatttcccctggctgttggcgatgctgcagggctcgtttatctcgcacatgaacaccctggtggtgccgggcggtaaaatggggctggcgatggagcttatcatgacgccgctggtcgagcgcctgatggaaggccgtaagataggctaaccaaaaaaccccggcctggccggggttgagattcgatacaacggcaggcgaagactacgcctcgatcacttcataggagtgagtgatgttcaccgctttttccagcatcagcgccaccgagcagtatttctctgccgacaggtccaccgcccgggagaccgcggcatctttcagcgccttgccggtgacaataaaatgcagattaatatgcgtgaacagacgcggagcctcttcgcgacgctcggaggtcagcttcacttcgcaattggtcacgtcgtgacgacctttttgcagaatggagaccacatcgatcgcactgcaaccgcccgccgccatcagcaccatctccatcgggctgggagccttatccccggagttgccatccatcagaatctggtgtcccgatgcggactccccgataaaggttaacccttctacccatttcacacgcgcttgcataaaatttaactccagtatcgcaatattcctgtcagattacgcgcacataacaattctcgcaacggaaggcgacctgcgtcatgctgaagcgagacaccaggagacatgcggcgaaagctatgctaaaacagtctggatgctacagtaatacattgatgtactgcatgtatgcagaggagttcacattacgggctgtcgaaaaatcatcagccagcttcccaggtatagggaaacaatacgattgcatgcccggacgccgtgtagtgtcggcgcccggagatagcttataacagaggataaccgcgcatggtgcttggcaaaccgcaaacagaccctacccttgaatggttcttgtctcattgccacattcataagtacccatcaaagagcacgctgatccaccagggtgaaaaagcagaaacgctgtactacatcgttaaaggctccgtggctgtactcatcaaggatgaagaaggtaaagagatgatcctctcctacctcaaccagggcgatttcatcggtgaattaggcctgtttgaagagggtcaggagcgtagcgcctgggtacgggcgaaaaccgcatgtgaagtggccgaaatctcttataagaaattccgtcagctgatccaggtgaacccggacattctgatgcgtctctcttcgcaaatggctcgccgtctgcaggtcacgtctgagaaagtgggcaacctggccttcctcgacgtgacgggccgtatcgcccagacgctgctgaacctggcgaagcaaccggatgccatgacccacccggacggtatgcaaattaaaattacccgccaggaaattggtcagatcgtcggctgctctcgtgaaaccgttggtcgtattttgaaaatgctggaagatcagaacctgatttccgcgcacggtaaaaccatcgtcgtctacggcacccgttaagttgctaagcggcgtattgctcccgcagtacgccgtttttgtttttccctcatgtggcgcaggctgatttaccacccggaagtcaactatgcactgcggcaaacgctggtgctgtgtctgcccgtggccatcggtcttctgctcggccatctccagcaggggctgttattttccttagtccccgcctgctgcaacattgccggtcttgataccccgcataagcgctttttcaaacgcctgattatcggcggctgcctgtttgccggatgcagtctggtggtgcagttgctgcttgcccaggcgatacccctgccgtttattctcagcggcctggcgctcttgctcggcgttaccgcggagatcagttcgctgcacgcgcggctgctgcccgcgtcgctgatcgccgccatctttaccctgagcctggcgggcaatatgcccatctgggagccgctgctgatctacgccttcggcacgctgtggtacggcgtgtttaactggttctggttctggctgtggcgcgaacagccgctacgggagtcgcttagcctgctttaccgggagctggcggactactgtgaagccaaatacagcctgctgacccagcataccgatccctcgaccgccctgccgccgctgctcacccgccagcagaaagtggtcgatctgattactcagtgctatcagcagatgcatatgctggccgctaaccaacgcaacgatcataagcgcctgctgcgggcgtttcagatggggctggatctgcaggagcatatttcggtcagcctgcatcagccggaagaggtgcaaaagctggtggaacgcagccatgccgaagcggtgatccgctggaacgcgcagaccgtcgccgctcgcctgcgcgtgctggcggatgacatgctctatcatcgctttccaaagcgctttcagatggataaacagatcgaggctctggaaaagatcgccagacaacatccggataacccggtcggccacttctgcgcctggcacttcagccgcatcgcccgggtgctgcatacccagcgcccgctgtatgcccgggacctgatggccgacaaagagcgtcgtttaccgctattgcctgcgctaaagaactacctgtcgctaaaatcgcccgcgctgcgcaatgccgcccgcatcagcgtgatgctgagcgtcgccagcctgatgggcaacgccctgcacttgcctaagccctactggatcctgatgacggtgcttttcgtcacccagaacggctatggcgccacccgggtgcgtattgttcaccgggcggcggggacgctcgccggcctgacgatcgccgggctgaccttgcattttcacgttccggagagctacaccctgagcgggatgctgctgattaccctgctcagctatctgatcattcgcaaacactatggctgggcgatggttgggtttacggtgacggcggtatataccctgcagctgctgacgcttaacggcgaacagtttattatcgcccggctgatcgacacccttatcggctgcctgatcgccttcggcgggatggtctggctgtggccgcagtggcagagcggcctgctgaaaaaaaatgcccacgatgcgctggaggccgaccagcaggcgattcgcctgatcctcagcgccgatccaaaagcccccgcgctggcctatcaacgcatgcgcgtcaaccaggcgcacaacgcgctctacaactccctgaatcaggcgatgcaggaacccgggtttaatacccactatctggaagatatgaagctgtgggtgacgcacagccagtttatcgtcgaacacatcaacgctatgaccaccctggcccgggagcatacgatgctgaccccggatcttgcccagcgctatctcgaatcctgtgagattgcgctgcagcgctgccagcagcggctggacagcgatggtcccggcagcgcaggggatgccaatattatggagtcgccggaaagcgaggcgccgatcggtccgttaagcaccctggagcagcatctgcaacgcattctgggccatctgaacaccatgcacaccatttcgtcagtggcatggcgtcagcggccgcaccatggcatctggctgcggaagatcaaccgttaatcacctttgccaccgcctgggcaaagcgcgccatcccttcagtaatatcctgctcgtcgatgatcagcgagggaacaaaacgcatcacgtccggcccggcgttgagcaccatgacgccggcgtcggccgcggcatagaggaaatcacgcgcgcggcctttgtgctgcggcttgagttccgcgccgatcagcaggcccatcccgcgtatatcactgaacagatcaaactcggcatccagccgctgcaggtgtttgacgaacagttcgcgcttcgcgctcacgccatccagcaccgccggggtattgatcagatcgaaggcggcgttggcgaccgcgcaggccagcgggttgccgccgtaggttgagccatgggagcccgcatggaaggcgctggcgatctcgtgggtggtcagcatggcgctgaccgggaagccgccgcccagcgctttggcgctggtcagaatatccggggtcacgccgtagtgcatataggcgaacagcgatccggtacgccccataccacactgtacttcatcaaagacgagcagcgcctggtgctgatcgcacagctcgcgcagtccctgcaggaaagccggcgtggccgccgtcacgccgccttcgccctgaatcggctccaccaccaccgcgcaggtgtggtcatccatcaccgcttttaccgcctgcagatcgttgaagggaacatggacaatatccgccggttttgggccgaaaccatcggaatacttcggctgaccaccgacggaaacggtaaacagggagcggccatgaaaggcattatggaaggcgatgattttggttttatacgggctatggcgggtcaccgcatagtgacgcgccagcttaaaggccgtttcattggcttcggtgccggagttcataaacaccacgcgctcggcgaaggtagcctcgacaagtttacgtcccagacgcagcgccggctcattggtaaagacgttgctggtgtgccacagcgtttcgccctgctgatgcagcgccgccaccagcgccggatggcaatggccaagcgccgtcaccgcgataccgccggcgaaatcgatatactctttcccctgctgatcccagacgcggctgcctttccccttcaccgggatgaattctgccggtgcataaattggcaaaataacttcatcgaatgtggcgcgggtgattgccggttgttcagttgccatgtcttgcccatccctcttcgttacgcagatgcgattatgataatctaatcacaaaatatgcataaaaaatcagtcaatagcaactgaaaatcaccgtttcaaaaagttggccagcaattgatggccctgctcgctgaggatgctttccggatgaaactgcacgccctcgagatcccattcgcggtgacggatccccataatctcaccgctggcgctgcgggcagtgacgttaaactcggacgggagcgtcggcgggtcaatcaccagcgagtgatagcgggtcaccgtcaggggaatattcagcccctgaaacaccccttcgccgttatgctcgataagcgaggttttgccatgcatcacctgggccgcccgcacgatagtcgcgccaaacgcctgggcgatcgcctggtgcccgagacagacgcccagcagcggcgttttccccgcatagtggcggataaccgcgagggaaatccccgcctcatccggcgtgcaggggcctggcgagatcacgattttctccggcgccagcgccgctatctcctccagcgtcaacgcatcgttgcgcctgaccagcacttccgcccccagttcgcagaagtactgatacagattccaggtgaaagagtcatagttatcgataagcaggatcatagcggctccggaacaatcaaaaccgggctattctactcagattcccgcgcttcgcttaccactttgcgaaagatcgccaccagcggggccagatcgcccatcgcgctctgctggcaggccgcactccagccggcggggtcaacgtcacgccagttaagaaggtagccggcatgtatcgccagctgttcaaagaaaatacgctgggtcaggccattgccaagacgaaaagggtgcagcacattaatttcaccatagaaccagctcaggcgttcgatgaaggtatcgcgcggcaggccattgagataatcctcctgctcaagggcctgcatcagggcattcccctcctcctcgatccgggcaaagtggcagaacggcgtatcgcccaggtagaggttcacttcacgcaagcggcccgcccagtcaaacagatcctgatacaactgatgatgaatagcgcacagatagggtaagccgcgcacccgcgggcccagcggcagagtggccgcccgcagcgctgtcatctcaaaggcggcctgctgcagatttttagcctggcggatgccgagacggttgcgcagcacgttcagcgccggataaaggtaaggatcgcgttcatcgccgaatttatcgctcatactccctccgcaacgtcgccagacgcgccagcgcctcttcggcagtcagcgtaaccagcggcaccgtcacgccttcaaggcgacggctggcctgaaaattggtattgcgtgtctgttcccagagtcgggatttttgcttatcggtgagtggacgcatcgtcgccccccttatcgtcccctgtgtgccacaagtataagcagcaatttcaggttatgccgggaggcgaccgggcgcggcgatagaccaccgcgccgcgggaggattagggcagcactttcgcagagaggataacgaccggtttggtcggcacattctggtacggaccaacgttatgggtctggacctgggagatcttatccgcaacatccatccccttcaccactttgccgaataccgcatagccaaagtcgcgctggccatggtcgaggaaggcgttatccgccacgttgatgaagaactgactggtggcgctatcctgatcggcggtacgcgccatcgcgatggtaccgcgggtgttgcgcaggccgttgtctgcttcattcttgatcggcgggttaggctgcttctgctgcatctgttcgttaaagccgccgccctgcaccatgaatcccgggatcacgcggtgaaaggtggtgttgttgtagaagccgctgttgacgtacttcaggaagttatccacggaaatcggggctttctggctgtttaactcaagctcaatgttacctgccgaagtggtcagcagcacatgcggatcgccctttgccgccatggccggggagaacgctgaaatagcgaaaacggcagccatcgccgccagtgttgatttgagcatggaaattccttaacggagcagaataaaagcgagtgccttgattctaaagagcctttgcatcctgggccagccttttaccaaattttacttagctgtaataattgtaaccgcgcaaacgatctcctttgcagcgaacaagcgtgatacagatcacattaaaacatgcaaaagataacccatttcacaataaacatttaattacatcacctgaacgaataaaatctgtccgcccggcgcagcgtcaacgcgctttacctttctattcacaggccagtcatgactaacagcaaccgtattaagctcacatggatcagcttcttctcctacgccctgaccggcgcgttggtgatcgtcaccgggatggtgatgggtaacattgcggattatttccatctgcccgtttccagtatgagcaacacctttacctttctgaacgccggtattcttatctccatcttcctcaatgcctggctgatggaaatcgtgccgctgaaaactcaactgcgctttggctttattttgatggtgctggcggtggccggcctgatgctcagccacagcctggcgctgttctccgcgtcaatgttcgttcttggcctggtgagcgggatcaccatgtcgatcgggaccttcctgatcacccatatgtatgaaggccgtcagcgcggggcgcgtctgctgtttaccgactccttctttagcatggcgggcatgattttcccgatggtcgccgccgtcctgctggcgcgcagcatcgagtggtactgggtctacgcctgtattggtctggtatatgtcgctattttcgtcctgactttcggctgtgattttccggtgctgggcaaaaaagcccagagcgaaaacagccagccggtggtgaaagagaagtggggcatcggcgtactgttcctctccgttgcggcgctgtgctacatcctcggtcagctgggctttatctcctgggtaccggaatatgcgaagagcctgggcatgagcctcggcgacgccggtaaactggtgagcgatttctggatgtcctacatgatcggcatgtggtcattcagcttcatcctgcgcttcttcgacctgcagcgtatcttaaccgtcctcgccgggctcgcgacggtgctgatgtacctgtttatcaatggttcgccggagcatatgccgtggtttattctgaccctgggcttcttctccagcgccatttacacctcgatcattacgctcggttcgcagcagacgcgggtcgcttcgccgaagctggtgaactttatcctcacctgcggcaccatcggcaccatgctcactttcgtggtcaccggcccgattgtggcggccagcggtcccctggccgcgctgcacaccgctaacggcctctatgccgtggtattcgtaatgtgctttatcctcggcttcgtctcccgtcatcgccagaacaacgctcaggcggcgtctcactaagccttcggcccctttgcatccgcaagggggctgttcctcataaaagaaagctcctcgccaccgcggtcagtttggatccagctttgcgccggctgggtggtcgcgatcacccttccctggcgaattgaccagcgcaccggcacttggcagcggacggcctcaaagccattctccgccgggagaatgatcaggttagccgggttgccgctgacaatgccgtaatcctcgaggccaaacgtacgggcgctgttgtcggtgataagctgcaggccgtcgttgatctgctggtagcccatcagctggcaaacatggagccccatatgcaggacctgcagcatattgccggtccccagcgggtaccacgggtcaaagacgtcatcatgaccaaagcaaacgttgatccccgccgccaacagctccttcacccgggtaatgccccgtcgcttcgggtagtcgtcaaaccggccctgcagatgaatattcaccagcggattggcgacaaagttgatgccggagagcttaagcaagcggaacagacgcgaggtataagcgccattataggagtgcatagcggtggtatggctggccgttacccgcggccctatccccgctttcagcgccagcgcggcaacggtttcaacaaagcgcgactgctcatcgtcaatttcatcgcagtgaatatccagtgggcggtcatattgctgcgccagacggaaggcgatatgcagcgattccacaccatattcacgggtgaactcaaaatgcgggatcgccccgacgacgtccgcccccagcttgagggcctcctccagcagcgcctcgccgttggggtaagagaggatcccctcctgtggaaaagcgacaatctgtaactcgacccatggcgccacctcctgtttgacctccagcatcgccttcagcgccgttaacgtgggatcggaaacatcgacatgagtgcggacaaactgcacgccattggcgatctgccacttcagggttttccacgcccgggctttgacgtcctcatggctgagcagcgctttccgctccgcccagcgctcaatcccctcgaacagagtaccggactgattccagttcggctcgccggccgtctgggtggtatccagatggatatgcggctcgataaaaggcgggatcgctagcccgccgcgagcgttcaatacctcgtagctttcatcgtgcgcctcccccatcggcgtgatctcgccaaagcggcccttatcaatggctatttgccacaggccgtcgcggtctgccaggcgtacgttctgaatcaaccaaagcggcgctgctgtcatatcaccctctctattcaatacggcttgttttctgtctaaccccaatcgcggcttacccaattcttgtacacaaaatcagcaaaaaggaaaagtcagcgttttccatgacttataaaaatactgacaaatcaaacgcatacccattaagtggtaggtgaagttgtcattgatttgcatcaataagcctgatggctgaatcgttaaggtaggcggtaatagaaaagaaatcgaggcaaaaatgagcaaagtcagaatcgctattatcggtaacggcatggttggccatcgctttatcgaagagcttctcgataaggcgcctgccggacagttcgacattaccgtgttctgtgaagaaccgcgtatcgcctacgaccgcgtccacctgtcgtcttatttctcccatcacactgcggaagaactgtcgctggtacgcgaaggtttctatgagaaacacggcgtcaaggtgctggtcggcgaacgggcgatcaccatcaaccgccaggagaaagtgatccactccagcgccgggcgtaccgtgttctacgacaagctgattatggcgaccggctcatacccgtggatcccgccgattaaaggcgcggaaacccaggattgcttcgtctatcgcactattgaagatcttaacgccatcgaatcctgcgcccgccgcagcaaacgcggcgcggtagtcggcggcggcctgctcggcctggaagcggccggcgcgttgaaaaacctcggcgtggaaacccatgttatcgaattcgcgccgatgctgatggccgaacagctcgaccagatgggcggcgagcagttgcggcgcaaaatcgaaagcatgggcgtgaaagttcacaccagcaaaaacaccaaagagattgttcagcagggcaccgaggcgcgcaaaaccatgcacttcgccgacggtagcgagctgcaggtcgatttcatcgtcttctcaaccgggatccgcccgcgcgataagctggccacccagtgcgggctggcggtcgcccagcgcggcggcatcatggtcaacgatagctgccagacctccgatccggatatctatgccatcggggaatgcgccagctggaacaaccgcgtctacggtctggtcgcccccggctataaaatggcccaggtggccgtcgaccatctcctcggcagtgaaaatagcttcaccggcgccgacctcagcgccaagctgaagctgttgggtgtggacgtgggcgggatcggcgatgcccacggccgcacgccgggcgcccgtagctacgtctatctcgacgaaagcaaagaagtttataagcgcctgatcgtcagcgccgacaacaaaacgctgctcggcgcggtgctggtcggcgacaccagcgactacggcaatctgctgcagctggtgctcaacgccatcgagctgccggaaaacccggattcgctgatcctcccggcccacgccggcagcggcaagccatcgatcggcgtggataaactgccggacagcgcgcagatctgctcctgctttgacgtcagcaaaggcgacctgatcgccgctatcaacaaaggctgccacaccgtggcggcgctgaaagcggaaaccaaagccgggaccggctgcgggggctgtattccgctggtcactcaggtgctcaacgccgagctggcgaaacagggcatcgaggtcaacaacaatctgtgcgaacacttcgcctactcccgtcaggagctgttccacctgatccgcgtggaaggcattaaaaccttcgacgagctgctggaaaaacacggtcagggctacggctgtgaagtctgtaagccgaccgtcggttccctgctggcctcctgctggaatgagtacatcctcaagccgcagcacacgccgctgcaggacagcaacgacaacttcctcgccaacattcagaaagatggtacctattcggtgatcccgcgctcagctggcggcgaaatcacgccggaagggctggtcgccgtgggccgcatcgcgcgtgaattcaatctgtacaccaaaatcaccggctctcagcgcatcggcctgtttggcgcgcagaaagacgacctgccggagatctggcggcagctgattgaagcgggattcgaaaccggccacgcctacgccaaagcgctgcgaatggcgaaaacctgcgtcggcagcacctggtgccgctacggcgttggcgacagcgtcggcttcggcgtagaactggaaaaccgctataaaggcatccgcaccccgcacaaaatgaagttcggcgtctccggctgcacccgtgaatgcgcggaagcgcagggtaaagacgttgggatcatcgccaccgagaaaggctggaacctgtacgtgtgcggtaacggcgggatgaaaccgcgtcacgccgatctactggccgcggacctcgatcgcgatacgctcatcaaatatctcgaccgctttatgatgttctacatccgcaccgccgataagctgacccgcactgccccgtggctggacaatatggaaggcggtatcgactatctgcgcagcgtcatcatcgatgacaagctcggtctgaacgaccatctggaagaagagctggctcgcctgcgcgccgccttcgcctgcgagtggaccgagaccgtcaacaacccggcggcgcagacccgcttcaaacactttatcaacagcgaccagcgcgacccgaacgttcaggtggtgcccgaacgtgaccagcaccgcccggccacgccgtatgagcgtatcccggttactctggtggaggaaaaagcatgagccagtgggtaaatatctgcagcatcgacgacatcctgccggccaccggcgtctgcgccctgctcggtcagcagcaggtggcgatcttccgtccctaccatgacgacagggtattcgccatcagcaacattgatccgttcttcaacgccagcgtactgtctcgcgggattatcgccgagcatgacggcgcgctatgggtcgccagcccgctgaaaaaacagcgcttccgcctgagcgacggcctgtgcatggaagatgccagccactctatcgcccgcttcgacgcccgcgtgaaagacggacacgttcagcttaaagcgtaagtccttctccctccccccggccacggggggagatataagtaacagttctgaccgacagcgcatgagtgcgggatatgtcgcatgttttgtattacctttgctgctattctacgaccactcgttttctaccccttatttttatgaggttattctgtggatcacttacccatattctgccagttgcgccagcgcgattgtttactggttggcggcggggatgtcgccgaacgcaaagcccgtctgctgctggatgctggcgctaacgtcacggtcaatgcgctcgacttcacgccccagtttcaggtgtgggctgattcacagatgctaactctggtgcagggggagtttatcccctcgctgctggataactgctggctggccatcgccgctactgatgatgagacggtcaaccagcaggttagcgaggcggccgaagcgcggcgtatcttctgtaacgtggtggatgccccgcgccaggccagctttatcatgccgtcgataatcgatcgctcgccgctgatggtcgccgtctcctcgggcgggacatcaccggttctggcgcgcctgctgcgcgagaaactggagtcaattctgcccctgcatctcggccagctggcccgctatgccggccatctgcgcgcgcgggttaagcagcagtttgccaccgtaggcgagcgtcgccgcttctgggagaagctgtttgttaacgaccgtctggcgcagtcgctggctaatgacgatcggcaggcagtcgcggataccactgagcagttgctgacggagccgttggagcatcgcggcgaggtggtgctggttggcgccggccccggtgacgccgggctgctcacgctcaaaggcctgcagcagatccagcaggctgacgtggtggtctatgatcggctggtctccgatgacatcatgaatctggtgcgccgcgatgccgatcgggtgttcgtcggcaagcgctcaggctaccactgcgtcccgcaggaggagatcaaccagatcctgctgcgcgaagcgcaaaaaggaagacgcgtggtccggctgaaaggcggcgatccctttatctttggccgcggaggggaagagctggagacgctttgcgaggcgggcatccccttctccgttgtgcctggcattaccgccgcctccggctgctccgcttattcggggatccctttgacccaccgcgatttcgcccagggcgtccgcctggtcactggccacctgaaaaccggcggcgagctggactgggcgaacctggcggtggagaagcaaaccctggtgttctacatgggtctgaaccaggcgccggcgatccgcgagaagcttatcgctcacggcatggctgaagatatgcccgccgccatcgtcgagaacggcaccgctgtgacgcaaaaagtggtcagcggcaccttaggacaactggatattctggcgcagcagatggccagcccggcgctgatcatcgtcggccgcgtggtcggtctgcgggataaactgaactggttttcgaaccattaaccttgcctcccataaagtgacaggcataaaaaagggcgggatagcatcccgcccttttagctgttgcgtcgcttacggcttggcgacaaagccaatcgcttcgtataccgctttcagggtttgagaagcccgcgcgctggccttttccgcaccgtctttcatcacctgattgagaaacgcttcgtcgttacggaaacggtgatagcgctcctgcaggtcaatcagcatgcccgataccgcttcggcgacttcgcctttcaggtggccatacattttgccttcaaaatgctgttccagctcaggaatagttttcccggtaaccgcggagaggatatccagcaggttggagacgcccgctttctctttcagatcgtaacgcactaccggcggctcgtcggagtcggtgaccgcacgtttaatcttcttgaccaccgatttcggatcttccagcaggccgatgacgttgttgcggttgtcgtcggacttggacatctttttcgtcggctccagcagcgacatcacgcgcgcgccggatttagggataaacggctcaggcactttaaaaatatcgccgtagatggcgttaaaacgctgggcgatatcgcggcttagctcaaggtgctgtttctgatcttcgcccaccggaacctggttggtctggtacagcagaatgtcagcggccatcagtaccggataatcaaacagaccggcgttgatgttctccgcgtagcgcgctgacttgtctttaaactgagtcatgcggctcagttcgccgaaataggtgtagcagttcagcgcccagcctagctgggcatgttccggcacgtgcgactgcacgaagatagtgcttttctgcgggtcgatgccgcaggccagatacagcgccagggtgtccagcgtcgccttgcgcagctgctgcggatcctggcgcacggtgatggcgtgctggtccacgatgcaatagatgcagtggtaatcgtcctgcatgtttacccactgacgcagcgcacccatatagttgccaatggtcagttcacctgagggctgtgcgccactaaaaacgatgggcttagtcatgtttcaattcctgagtttcactgtgcggtaacccgagagcgggtaagagttcgttaaactggtcgaagagatagtccggctcgctcagcgcaagcggttcaccatagttataaccgtaggtcagaccaacagagcagcagcctgccgctttggccgcctgaatatcattgcgcgaatcgccgacaaacagcagctcggctggagccagagagagcttttccgccaccagcagcagcggttccggatgcggctttttattctgcacgtcatcgccgccaatcaccacggtaaaatatttcgcaatatcgagcgcgtccaacagcggggcgacaaacggcgtcggcttattggtaaccagcgccagcggcaggcctttggcatgcagcgcgccgagcgtatcggccaccgccgggaacaggaaactgccctcttccgccgcttcggcgtaatagcggtcaaacagtttacgcaaaatgcgcagctgctcgtcttgcggaatatcatgatcgtcgacagaaggcttacccatcgccgcacgtaacgttgctcgctcctgacgagcccaggtaagcgcccgctccatcaggacatcggcgccgttaccgatccaggtgataacgcgttcttctcccgccaccggcagctccagggcgtacagggcgttatcaaccgccgaggttagacccggcgcgctgtccaccagcgtgccgtcgagatcaaatgcgatgccgcggatcgcctgtaatttatccatgactcaccttcgctaattctatacgcatttgatcaatgacttgcttgtagtccggctgaccgaagatcgccgaaccggcaacaaacatatccgcacccgccgcggcgatttcgccgatattgctggctttcacgccgccatccacttcgaggcggatgtcgtagccggacgcatcgatgcgctggcgcacttcacgcagtttatccagcgtctggggaataaaggactggccgccaaagcccgggttaaccgacatcagcaggatcacgtccagcttatccatcacgtaatcgaggtagctcagcggcgtcgccgggttaaacaccaggcccgctttacagccgtgctctttgataagctgcaggctgcgatcgacgtgttcggaggcttccggatggaaggtgataatgctggcgccggcttcggcaaaatcaggaatgatgcggtcgaccggcttcaccatcaggtgaacgtcgattggcgcggtaataccgtaattacgcagtgacttcagcaccatcgggccaatcgtcaggtttggcacgtagtggttgtccataacgtcgaagtgcacgacatccgcacccgccgccagcgccttcgcggtatcctcacccagacgggcaaaatcagccgacagaatcgaaggggcaatcaaatactgcttcatccgcatctccttgaaatttatttggtcttaggcggacggtagagcgctaatagctcgtccacctttttacgcgtaccaccgttgctgctgatgctgcgccgcaccttcacaatatgcgtttctgccgcgtttttataccattcctgcgtcagcggcgtgcggtggttggaaatcagcaccgggatgcgctttttcatcagcgattccgccttttgcgccagcagtacctgttgttccaggttgaaactgttggtgtggtaggcggtaaagttcgccgtcgccgttagcggcgcatagggcggatcgcaatacaccactgtgcggctatccgcacgttgcatgcactcttcgtaagattcgcagtaaaactcggcgttttgcgccttctcggcgaaatgatagagctcagcttcggggaaatagggctttttataacggccaaacggcacattgaactcgccgcgcagattgtagcggcacaggccgttgtagccgtgacggttcaaatacaggaacagcaccgcgcgacgcagcggatcctggctttggttaaattcatcacgatacaggtagtagcgctcagcgacgttattttccggggtaaacatctcacgggcggcggcgacgtattcgtcggtgcgcagtttgacgatgttgtacaggccgattaagtcactgttgatatccgcgaggatataacgagaaaagtcggtattaagaaataccgacccggcgcccacaaagggctcgatcaagcactcgccttccggcaaatgctttttaatatcgtcaagcagggggaactttccccctgcccacttcagaaaagcgcgattctttttcatgctgcctaactaattacacgttctccggctgtggagaaagctccgacagcatcctgcgcttaagactaccccacggcattatttcaggtcagcctgaacctgatgcagcggttttgcccatggatttttcgcctgcacgtccgccggcagcgaggtgacagcacgtttcgcttcatctttcgatgcatagataccgctcaccagcacgtaccatggttggccgttacgcgacgtttcatagacaacatatttatccagcttctctttcttcgcccagttgttgaggttgtcgtagttagaggagctgctgagctgcagagtatagtgacccgacggcgcagttttcattgagctgacgtcacctgccgtcttcccggtcttcgctgccggcgctgccgcagctgccgttgccgctggcgctgcggtcgtcgtggtcggtttgctctgagcggtggccaccggtttgctttcgctgacggacgttttcgccggagcggtggtcgccgtgctttcaacatgcttcggctggaccggcttcgattctaccggcgttttcgccacggcctgtggcttcgactgcggcttcgcttcgataacggtatgcttacgttcagccggacgcggggtcgctgctgtctgacgctcggtcgcctggcgcggcgccgcggtgccattggcgccattccggattggcgcgacggtagccggttcagtcggcagcgtcgagttagccacggcgccgtccagttggccctgctgctgggtcaaggcattgttcagatcgccctgaacttcgatacgctgctggccctgcggcgcaaccgctgcctggccctgcgtcgggttcgcggcaataggcggtaccgttacgtcctgctgtgaggtgctgttagcggcggcagtctggtcctggccggcagcaggcatgctggcggactggtcgtcagacagattaatgctcttctcgccggaagcggtctgctggctggaagatgatggcgatttcagtgcggaaccgatacccacgatcaacagcagcagcaccagaatccccacacccatcatgatgtactggcgggaggccggtttggccggcgcttttttacgcttgcgcggacgacgctctacaggctgctcttcgagcatctcctcgtcttgcgcatccagttcttcttcgaactcttcctcttcacgctcgcgacgggccttaccagcgcgcgtcggacggccttcatcggcatcaagatcaacatcgtcaaaattgatctgcggatcggcatcacgctcggaagactgacgggaacgaccagcacgacgatcgttgcgatcggctttcatatcgtcttctggtttgaaatcatccatttaacaccccactaaaaggcttatgctcacgattattgcacatcacccgaaatgataacgccgcgcgaacgcggccagaccttcttattgttgcgcctgctgagtatcagcaatcgcgccaagaaccacatcgtgcggcactccgccgcgcagctcgctgcttcctattgcgagcgggagcaccagccgcatttcgccagccagtacctttttatcgcgcatcatatggggcaaatacgcctgcgcactcatttcctgcgggccgcgtaccggtaagcctgcacgcttgagcagatcgataatgcgctgagtatcctgcgcgcggaactgccccagccgttcggacgtgcgtgccgccatcaccatacctgccgccaccgcttcgccatgcagccagttaccgtagcccatttccgcttcgatagcatggccgaaggtatgtccaagattgagtaaagcacgtaacccggtttcacgctcgtcggctgccacaacctccgctttcagttcacagcagcggcgaatgcagtacgccatggcggtatcgtccagcgccagcagcgcatcaatgttgttttccagccagctgaagaattcaccatccaggatcaccccgtacttgatgacctcagccagtccggaagcgagctcgcgcttcggcagagttttcagacagttaagatcaactaccacggaaaccggctgccagaaggcgccaatcatgtttttgccgagagggtggttcactgcggttttgccgccgaccgacgagtcgacctgcgacaacagggtggtagggacctggatgaaacgcacgccgcgctgatagcttgccgcggcgaaaccggttaaatcaccgatcacccccccgccaagcgccaccagagtggtgtcgcggccatgtggtttttgcaacagcgcagtaaacacggtatccatcaccgccaggcttttgtattgctcgccgtctggcagaatgacgctgtcaacgttgacccctgactgctccagcgcagagcggacggtatccagataaagcggcgccagcgtttcgttggtgaccagcatagcctggtcgcccgacttgagtggcaggaaggaagctggatcgttaaacaaaccagccgcgatggtaatcgggtaactacgttccccgagggtaacagtaagcctctccataacgcgacatccacctcaatgactattactctgacgcacttttattaagccagaatcagttgctttccagcatatgaataatctggttcgcgacgactttcgcactctgatcgtctgtgcggatagtcacatcggcgatctcttcatacagcgggttacgctcgtcagccagcgcttccagcacttcacgaggcggcgcatcgacttgtagcaaaggacgctttttatcgcgctgcgtacgggccaactgcttctcgatcgtagtttccaggtagaccaccacgccgcgggcggagagacggttacgcgtttcacgggattttacagagccgccgccagtcgccagcacaatcccctgtttttccgtcaactcattgataattttctcttcacggtcacggaagccttcttcgccttcaacatcgaagacccagcccacatcagcgccagtgcgtttctcaatctcttgatcagaatcgtaaaattccatgttgagctgttgggctaactggcgcccaatagtgcttttgccggcacccataggcccaaccagaaagatattgcgtttctctgccattttttcggtactactaagactattcgttaatgataaacccgcttcgcagacacccagcgccgcagggcatgaactgaaacctcatatgcaatagagcgagagtcagactaaaaattatctcaatactccggctggtttggcaactgaataaaatcgccggacaataaagggaggattgatgtcgtacccgactctcaaatcggtaccccttgtatgctaaatccgtcctcacgtcaaacacctgaaacgtgtttagcatgaaaaacctgcttaacgtactgccagaatccgtggcgtaataaagacaaccagttcgcgacgttcattatctttcccgtcacgacgaaacagacgtcccagtaccgggatatcgccaagcagcgggacgctgtcgcgggcggttttgtttttctgcgaaaagatgccgcccaacgctaaagtctcgccgctgcgaacttccaccagggtctctatctcctgcttatcgatggccagcgcttcgccgttttcctgcttcagcacctggcctggcgtattctcgcttattcgcagcttaagccgcactcttccctgctgcagcaccgtcggcgtgacctccatgcccagcaccgcctctttgaactccaccgaagtggcgccgctttcgccactggaaacctgataggggatctcgcttccctgcttgatgctggcaggctgcatgtgggaggccaataaacgcgggctggcaataatttcgacctgctgcttgcgctccagcgcggatagctccagctcaagcaagcgaccgttgatcttgccgatgttaaaccctgcgcgggtgctggcatcgtttaccgatacatcgctgcttagggtggtgatttgcccggagcctggcgggcttccggcttccgcaagccgccacttcacccccagctcacgaaggctggtttcgctcatcgacacgatatgggcggccagctccacctggccgaccggcagatccatctcctgcgcccaggccttcaacgccggcaggtgccgggcatcatcgcggatcagcagccgattagtccgtttgtccgccatcaggtgtcccctggcgctgagcagctttccgccgcttttagccagctcctcagcgtcggcaaagtgcagggtcacgctctccgcctgcaggggcaggttctgcaggcgtttctcctgttcggcttcacgctgcgcctgatttgccttttgccaggcctgagtgtgcgcgtagatgaccgtcccctgctgttgcaaagagagacccgcgctatccgctaccgcccgcagcgcctggctccagggaaccttctgcagacgcagggagagcgtgccgctgacgtccggcgcgacgacgaggttcttatggttcatttcggccagggcttgcagcacctgggccactggcgcatcgtcaatcaccagcgaaaccggtttatcattgcgggcggcgggggccaccgccagcggcagcagcagaagcagcaggcttatccatcgcatcatgttgtttcccttcacgttgccagcgccacgctggcggttcacatcccgaagacgtgacgatgtccagctcaccggccgtcagccggctcacccgccagcccgtgggcaattgctcatccatgcgtacccgtcgccactttccgttcccatcctgcagaaaccccgtccagccagcctcatccccaaccgccccgccatagcgccattgcgaaagctgcgccgtgcggcagggatcctccaccggctggaaagggtcacgctcggccgccagcagcgacagcggtagccacaggaagatccagcgtttaccgctcatcttccgcctccagcagcagtcgcaggcggagcgtctgcgcctcacggcccagcgaaaacgaacgcggattcatcccgcagcgcgccagccaggaaaaaagcgcgggtaccgttgaccaggacagggtcagctccatctcgccgccgcttccctgcggacgccaggcgataagcttcgctccggagagcggaatggctatgggcgaaaatgactgcgtgtcgatgcgcgccccgggattttcctcgccggggatgcgcagcgccatgatccgccgccactgcgtttgcaacgccgcatcacgggttaccgccgcctgcggcgggcgcagatcgcgccagagcgccacgccgcctcccgacagccccattgcgagcaggatcggcagccccgtccaggcgccccgaaggttaatccgcatcagcgcgcgctcccgtcagggtaaaactgaactgccaacgcccctcggcgtcgcgctgggtcccgccggcttttgccggcgcgaatcccgcgacgcgagtcagcgcagcctccacgctggttagcgcctgcaggttaagggccaggccgtccagcgtgaggagtacgccctggtactccagccgcgtcagccacgcctgcgcgggcagatctgccgccagcgcctgcagcctgggttgccaggcggcgatcgccgatctgcgctggtactgctggcgctgccgttgatgctgctgccacgcctcacgcatcgcctgctcgcgctgcttaagcgaagcgagcagctgcgcgtcggccgtcgtgtgaagcgtcgccaggaagtcgcgctgcagacgcgccgttcggctcaccagcaggcccatcccgcccagcagcacaatgccgatggttaacaacaggacgtagcgcaggcgctggcggcgacgcaggtcgcgccagggaagaagattaacgacatgcgtcatgccgcccgcctcccagcgccagcccaagggcaatggcgtaacgatcgccatcggctggcagcgggggctgccgacggtgaatcacttgccagacatcaaagcgactggcctcatcgcccgcgtcaatacacaggcgcagcggaatctgaagctgccccgccagctggcttaaggacccgacatcagcgcaggcgtcgctgccccaggcctcacgggtcgcccacagccagcgcttttcatcccgccacgccaggccctggtctgccgcagtcatccaggggaaaaaggcgccgagcgcactggcatccggtacgatggccgccacccgcagccgcagccgccctgccagctcccgcagaacattgatatccagccgctgcgccgccgtaacctgccagccgtcatcccgcgaggtgggcgcataatcaatacatagcgcggaggcaggcattgccagctgctggctcatggcgctggctacccacgtcgcctgttcccgctcccgcagggcgaactggggatacggaagacgcttttgcagtgtgcgcaccgcgggaaaggcgatactaacctgatgctgcgccggtagctcccgccgccaggcggccagccgcgaaccgagtgcgctgacgtccgccaccattccctgacgcaccagccccggcggcaatgggatacgccaccagcggcgcagcgcccagtgtgaacgttcatgcaatagcgcgacaatggcaatgctatcctgttggatatgcattccaagccgccagtttctgaaagccatgcttacgatctccttatccggcaaaactgcccggctatatcaatgcacctggcttgcctttatactaccgcgcgtttgtttataaactgcccaaataaaactaaatgggaaaacaccggtgaagttcgtaaagtatctattgatccttgcagtctgttgcgtactgctgggagcaggctcgatttttggcctctacaaatacatagagccgcaactccccgacgtcgcaaccctgaaggatgtgcgtttgcagatcccgatgcaggtctatagcgccgacggtgagcttattgcgcagtacggcgaaaagcgccgtatccctgtgacgttgcagcaaattccccccgagctggtgaaagcgtttatcgccaccgaagacagccgcttctatgagcaccatggcgtcgatccggtaggtattttccgcgccgccagcgtggcgatgttttcaggccacgcctcccagggcgccagcaccatcacccagcagttagcgcgtaacttctttctcagccccgagaagacgttgatgcgtaagattaaagaggcctttctggccatccgcatcgagcagttgctgaataaagatgaaatccttgagctgtatctgaacaagatctacctcggctaccgcgcctatggcgtcggcgccgcggcgcaggtctattttggcaaacctatcgaccaactgaccctgagtgagatggcggtgattgccggtctgccgaaagcgccttccacttttaacccgctctattcgatggatcgcgcgaccgcccgtcgcaacgtggtgctgtcgcgtatgctgagcgaaggatacatcacccaggcgcaatacgatgaggcgcgcagcgaacccatcgacgccagctatcacgcgccgaaaatcgccttctccgccccttacctgagtgaaatggtgcgccaggagatggtgaatcgctacggcgagcaggcctacgaagatggttatcgggtctacaccaccattacccgtaaaaaccagcaggcggcccagcaggcggtacgcaataacgtgctggattacgatatgcgtcacggctaccgcggcccggccagcgtactgtggaaagtcggcgaaacgccgtgggagacgaagaagatcgtcgattcgctgaagcgtcagtctggctacggtccgcttttcccggcggtggtcacctccgcgaatgcccaggaggctgtcgcgctgttggctaacggcgactccgtttcgctgacgatggagggcgtgcgctgggcccgtcgctttatctcagatacgcagcaaggggcgaccccgcgtaaagtcaacgacgttgtgcaggccgggcagcagatctgggtacgcaaggtgggtgacagctggtggctgtcccagctcccggacgtcaactcagcgctggtctccattaacccgcaaaacggcgcgattattgcccttgtcggcgggtttgactttaaccagagcaagttcaaccgcgccacccaggcgctgcgccaggtcggctccaacattaaaccgttcctctataccgccgcgatggataaaggcttaacgctggcaagtatgctcaacgatgtgccgatctcgcgctgggatgcgggcgcaggttccgactggcggccgaagaactcgccgccgcagtatgccggtccgattcgtttacgccagggcctggggcagtcgaaaaacgtggtgatggtgcgcgctatgcgcgccatgggcgtagactacgccgccgagtatctgcagcgctttggcttcccggcgcagaacattgtccacacggaatcgttggcgctgggctcagcctcctttacgcccctgcaggtcgctcgcggttattcggtgatggccaacggcggcttcctggtcaatcctttctttatcagtaagattgagaacgatcagggcggggtcctcttcgaggagcgtccgaaaattgcctgtccgcagtgtgatttaccggtaatttacggcgatacgccaaaatccaacgtgctggaaaacaaggatgtggaagatgtcgccacctccgcggaaccgcagaatggcaacgtgccgccgcagccgcagctggagcaggccaaccagtcgctggtcgcgcagagcggcgcacaggaatacgcgccgcatgtgattaacacaccgctggccttcctgatcaagagcgcgctgaacagcaacatctttggcgagccgggctggatgggcaccggctggcgcgccggacgcgatctgcagcggcatgacatcggtgggaaaaccgggaccaccaacagctcgaaggacgcctggttctcaggctacggaccgggcgtggtgacctcggtttggatcggctttgacgatcatcgtcgcgatcttggccggaccaccgcctccggagcgattaaagatcagatctctggctatgaaggcggtgccaaaagcgcccagccggcctgggacagctttatgaagagcgtgctggaaggcgttccggaagaaccgttaactccgccgccgggtatcgtcacggtgaatatcgaccgcagcaccggtcagttggcgaacgggggcaatagccgggcggagtactttattgaaggaacccagcccacccagcaggcagtccgtgaggtgggcaccaccctgactgacggcggcggtgaaacccacgaattgttctgacaaaaaaagcgcctgcgggcgcttttttattgctgcttagcgtggacgctcgttcagagtcggccctgggcctgcagccattcccgcactaaaaacagcgcgctgacgttacgggcctcgttaaaatcttcttcatccagcagcgacatcagctgcgccagcggccagcgcacctgcggtagcggctcaggttcatcgcccggcagtgactccggatagagatcttccgccaccatgatattcattttgctggagaagtaggagggggccatactgagcttcttcaaaaacgtcagcttattggcgccatagccaacctcttctttcagctcgcgattggccgcttcatccacggtttcacctggatcaatcagccctttggagaagcccagctcgtaggactccgtccccacggcatactcacgaatcaaaataatgtgatcatccacaatcggcacaatcatcaccgcttcacgggtggaaggccgcatacgttcataaacgcgacgcacaccgttgctgaactccagatcgacgctttcgacattaaagaggcgcgaacgggcgacagtttcaacattgagaatggtgggtttttgtaatgatttgctcattgtcatcggtctatgctgtgattaagcagtcattgtgcgatacgcaacacgctttcggcaatccaaattgctacttatttacagagttgcaaccttttccctgcagggggaaaagtaataaagataaaaaagtcaatagcttgaattcgctttgagaatttaccgatttctgcgctttaacgtttttggtaagcttgtgcgctgctgcatgacatattcactaccctgtaagcaggtgcgccgctaacactgcagcttgacgttagtcttcacgttcaccgacgatttcgtaagaaaaaaataactttgatgggatgggcatgggcacctttctgatattccttacagctctgctaatctgcgtattgctcatcggatggtggtatcgcgctcacgccagacgccgccgactccccctactgcacgcctttagcgacgctaccacgcggcagcttcctgcggatgagcgccaggctattgagaagtatgttgccgagttgagccacgcccagcaggtgccggcgtccggtgcgaccagcgcgcctgtcgctctggcgctcaacgaacagagtgataccgtctatgcggtgacacgcgccatcacccgctacgggatcaccaccgacgcgccgaataaatggcgctatttcctcgattcggttgaagttcatctgccgccgttctgggaacagcatatcaacgatgaaaacagcgtcgagctgatccccaccgacagcctgccgctggttatcacccttaacggtcatagcctgagcgactatcgccaggaagcgcaaagctacgccctggaacgcgcttcggccacccaggcctccattcgcggcgaagagagcgagcaggtagagttgcggcagatccgtcgggaaacgcctgaagaacacgctctgaatcgcccggacgggctgcgcgaagcgatcctgatcgtcgcctcctttctgttcttttatttcagcctgattgggccagctgtctttaccccctggctggtcgccgcaggtttgttgctgctcgccgccggactgtgggggatttatgccccgccgcgtcgcgccgcgctgcgcgaaatccattgcctgcggggcgtccctaagcgctggggattgtttggcgaaaacgatcaggagcaaatcaataacatctcgctgggcattatcgatctcatctatccgcgccactggcaaccctggattgcccaggacctggggcagcagaccgatattgatatctatctcaaccgccacgtggcccgtcagggacgctacctgtcgcttcatgatgaagtgaaaaacttcccgctgcagtactggctacgcagcgcgattatcgccgccggcgccctggtggtggtgattatgctgtgggccagcgtaccgttgaatatgccgtttaagttcaccctgtcgtggctgaagggcgcgcaaacgattgaagccactaccgtcagccagctggaaaaagcccatgtgcgcattggcgatacgctgcgcctgaccggtaccgggatgtgtaatatccgcacgccgggcagttggtccgccaaagaggattcgccgttcctgcctttcgattgttcacagattgtgtggaacgacgcccctcctctgccgctgccggagtctgacattgtcagcaaagcgaccgccctgatgcagtccgtccagcgccagctgcacccggaaaccgacgatgattcccgcgtcagccctgccctacgctccgccattcagaaatcaggcatggtgctactggatgatttcggcgatatcgtgcagaaaactaacgatctctgctcggcaaaggatgattgcctgcggctgaagaatgcgttggtcaatcttggcaatacccgtaactgggaaacgttaaccaagcgcgccaccgccggcaagctggatggcgtgaacgtgctgctgcggccggtcagcgccgagtcgctggagaatctggtgaccacctcaaccgcgccctttgtgatacgcgaaacctcgcgggccgcgcaggcgctgaacagcccggctcccggcggttttcttatcgccagcgatgagggcagcgtattggtcaatcagccgtggccggcggtgagtctgtatgattatccggcccatgagcagtggggcgaactgcggcggctggccggtatgctcatgcatacccccttccatgccgaaggtatcgttaccaacctgtttactgacgccaacggcacgcagcatatcaacctgcatcgcatccccgaccgcagcggcctgtggcgttatctgggcatcaccctgctgctgctgtcaatggtggggtgcatggcttaccacgccgtgcaggccctgcgtcgttatcaacgccatcgtcagcgtatggaagagattcagaaatattacgaaagctgccttaatccggttttgctcccctcagctgactcgcaagattaattttcccggcgacagggtgtgataccctgtcgcccattttccgctcgctggagagtcatcatgcactttgatatcgcctggcaggaggtcgataccgttctgctggatatggacggcacgctcctggacctcgccttcgacaactacttctggcaaacgctggtgcctgaaacctggggggccgcccgcggcctcaatttgcaggaggcgaaagacgccatgcgccaggagtatcacgccgtgcagcatacgctaaactggtactgtctggattactggagcgagcgcctgggtttggatatttgtgcgatgaccagcgaacaaggtccgcgcgccacgctgcgcgaggataccgtgccgttccttgatgcgctcaaggcctgcggtaagcgacgcattctgttgactaatgcccatccccacaatctggcggtgaagctcaaacacaccggcctggacgcgcaccttgatttattactttccacccacacatttggttatccgaaagaggatcagcgtctgtggcgcgccgtggcggaggaaactggccttgaggcgcacaaaacgctgtttgtcgacgacagcgaggcgatactggatgccgcgagggagtttggcattcgttactgcctgggtattaccaatcctgactccggactggcggaaaagcagtatctgcgccatccggggctgaatgattaccgacgactgatcccttcgcttaccccgaaggagaggcgatgaaagagaagcccaccgaaaccgtcagactggacaaatggctttgggccgcccgcttttacaaaacccgcgcgctggcgcgggaaatgattgaaggcggcaaggtgcattacaacggacaacgtagcaaacccggaaaaattgtcgaactcgacgccatgctgacgctgcgccagggcaacgacgagcggacggtgcgcattatcggtattaccgaacagcgccgcccggcaagcgaagccgtcaacctgtatgaagagacagcggagagtatcgagaagcgtgaaaaaatggccctggcgcgcaaaatgaacgccctgaccatgccgcaccctgacagacgtccggacaagaaagagcgccgcgacctgatgagatttaaacacggcgagagtgaataactcgcgccagaaagagagatgattatgactcaacacgatcaattacatcgttatctgtttgaaaactatgccgtgcgcggcgagctggtgacggtgtcggaaaccctagaacagattctggcgaatcacacctatccccaaccggtcaaaacggtgctggcggagctgttggtcgccaccagtctgctgaccgcgacgctgaagtttgccggcgacattaccgtacagctgcagggggatggccctttacagctggcggtgatcaacggcaataaccagcagcagctgcgcggcgtagcgcgcgtgcagggcgagattgcggacgatgcggatctgaaaacgatggtcggcaacggctacctggtcattaccatctctccggaagaaggtgagcgctatcagggcgtggtcggtctggaaggcgatacgctggccgcctgcctggaagattatttccagcgttcagagcagctgccgacgcgccttatcatccgcaccggcgatcatgaaggccagccgatggcgggcgggatgctgctgcaggtgatgccggcgcaggatgcccagactgccgacttcgagcacctggcgacgcttaccgagaccattaaggcggaagagctgttcaccctgccggcaaatgatgtgctgtggcgtctgtaccatgaagaagaagtcacggtctacgacccgcagagcgtggagttcaagtgcacctgctcccgcgaacgctgcgccggcgcgctgaagacgctgccggatgaagagattgatagcatcctcgccgacgaaggcgaaattgatatgcactgcgactactgcggtaaccactatatcttcaatgccatggacatcgccgagatccgtaataacgcctctccggccgatccgcaggttcattaatccccgcatctttctcaggcacagggcggcaatgttgtttgtcgcgttgtgcctgacttttaatttattcgcgagttgaatcgattttccctgaaagagttacgtaatttaatttcaggaaagcgattacattcacatttcggcagtttttttaattactttttaaccattgagaaacatctaaccccaccatccgcccatttcctgagataatccactccacttcgtgacaggagtcaccgtttttatcgtcattctgaggaatgtcgagatacgtaaatctatgagcctggtcgcggtcaatacccggcaattaaccctacaatttacagcagtacatcttggctaaggagcagtgacatgcgcgttaatcatggtttaaccccgcaggatctcaaggcttatggtatcaatgacgtccaggatatcgtccacaaccccagctacgacatgttgtttcaggaagagctcgacccgaacctggaaggctacgaacgtggcgtattaaccactctgggtgctatcgccgtcgacacgggcatttttaccggtcgttctccgaaagataagtatctcgtgcgcgacgacaccacccgcgacaccgtctggtggtccgataaaggcaaaggtaaaaacgacaacaagccgctttcgcaggaaacctggcagcatctgaaagggctggtgacccagcaactgtccggtaaacgcctgtttgtcgtcgacgctttctgcggcgccaacgccgatacccgtctcagcgtacgtttcattaccgaagtggcctggcaggcgcacttcgttaaaaacatgttcatccgtccgagcgatgaagagctggctgaattcgagcccgacttcatcgtgatgaacggcgcgaaatgcaccaatccgcagtggaaagagcagggcctcaattcggaaaacttcgtcgccttcaacctcaccgagcgcattcagttgatcggcggcacctggtacggcggcgagatgaagaaagggatgttctcgatcatgaactacctgctgccgctgaagggcatcgcctccatgcactgctcagccaacgtcggcgagaaaggcgatgtcgccattttcttcggcctctcaggcaccggcaaaaccaccctctccaccgacccgaaacgccgcctgattggcgatgacgaacatggctgggatgacgacggcgtgtttaacttcgaagggggctgctacgccaagaccatcaagctctctgaagcggccgagccggatatctatcacgccatccgccgcaacgccctgctggaaaacgtggtggtacgcgccgacggcacggtcgatttcgatgacggttcaaagaccgaaaatacccgcgtctcctaccccatcgaccacatcgacaacattgttaagccggtgtctaaagcgggtcacgccaccaaagtgatcttcctgacggccgatgcgttcggcgtcctgccgccggtctcccgcctgaccgccgaccagacgcagtaccatttcctgtccgggtttaccgccaaactggccggcaccgagcgcggcgtaaccgaacccacgccaaccttctccgcctgcttcggcgccgccttcctgtcgctgcacccgacgcagtacgccgaagtgctggtcaaacgcatgcaggcggctggcgcgcaggcttatctggtcaataccggctggaacggcaccggcaagcgcatctcgattaaagatacccgcgcgatcatcgacgccatcctcaatggctcgctggacaacgcggagacctttaccctaccgatgtttaacctgcagatcccgacggcgctcccgggcgtggatacccacatcctcgatccgcgcagcacctatggttccccggagcagtggcaggaaaaagccgaccagctggcgaagctgtttattgagaattttgagaagtataccgatacgccagcgggcgccgcgctggtggcggcaggaccgcagcgctaacgggcgcaaaggtgaaaaagccgggcttgcccggctttttattgtgcaacatcctgagtagctaaccgcgggcgcgatcagctctccctggcgggtttcatcggcgtcagcatccggtgcaccggcagccaggcgcggatcagtaacccgccgcgttcgctggagccaatctccagccggccgttgtgattgtcgataatacgctgaacaatcgccaaccccagcccggtgccgctggtgctgcgggcgctgtcgccgcgtacaaacggctgaaacaggtgctccctctgctcaggtttaatccccggtccatcatcttctacctggaaccaggcccggctcgcttcgctgccgctgctgaccttgatccagccattgccatagcgggccgcgttgaccaccatattcgccagcgcgcgcttgatagacagcgggtgcatacgtaccggaatttcgccggcctgcagggcggtggcgatttcccgctcatagccgctctccgcagcgatcacttcccccagcaccgcattcagatccgccagctccatcggcatctcctgcccggtgcgcagatagtcgataaactgctcgatgatggcgttgcactcttcgatatctttgttgatcgactccgcgagatagccgtcctgctcgcccatcatctcggtggccagacgaatgcgggtcagcggggttcgtaaatcatgactgaccccggccatcagcagcgtacggtcatcagccaactgcttcacgcccgccgccatatggttaaaggcgcgcgtcaccgaacgcacttcggaggcgccatactcgcgcagcggcggcggaataatgccgcgcccgacctgcagcgccgcgtgctccagatccaccaacgggcggttctgaatacgaataaacagccaggcgccgcctatcgccagcagcatgatcgccagggtatagcggaacagcggcgagaagtcgccctgatggatctcggtcagcggcacccgcacccagatattgggcgacagccaggtcttcagccacaccacaggggagcttttattgacctctacccgcacctctgtggggccaccaagctgatgggccatctgctgacttaagaattcataatgctgcgcccagcgcaggcctgcgtcttccgccgcttcattggaatagagcgaaatccccagctcgcgataaatttcacgacgaaacgccgggggcaccaccagctgggtgccatcctccagctgcagtttgtcggtcatcagcatacgcacttcgtaggctaacactttattaaactgctggagactcggcaggatcgcgaaattcagtaccaccagataggtcgtcaccaggctgacgaacagcaaggtgacgatcaggagcagtgtgcgagcaaaggagctgcgcggcgaaaagcgcacgcgtttcatgccttagaaccgtccgggacgaagacgtagcccagaccccagacggtctggatgtagcgcggatgcgccgggtcctcttccaccatgcggcgcaggcgggagatctgtacgtcgatggagcgctccatcgcagagtattcgcggccgcgggcgaggttcatcagcttatcgcgcgacagcggctcacggggatggctcaccagcgccttcaggaccgcgaattcgccgctggtcaacggcatcggctcgtcttcacggaacatctcgcgggtacccaggttcagtttgaatttaccaaaggcgataaccgcctcttcctgcgacggcgcgcccggcagctcgttcgcctggcgacgcagcaccgcccggatgcgggccagcagttcgcgcgggttaaacggcttcggaatatagtcgtcagcaccgatctccaggcccacgatccgatcgacctcttcgcctttcgccgtcaccataatgatcggcatcgggttactctggctgcgcagacgacggcagatagagagaccatcttcgcccggcagcatcagatccagcaccatcaggtggaaggattcacgggttaacagacgatccatctgttcggcgttcgccacgctacgaacctggaagccctgctcggtcagataacgctcgagcagcgcacgcaggcgcatgtcgtcatccacaaccagaatcttataattctcttgcattgtttgtactcccaaaggttcactgcaatagtcagtgcgtattctcaaaaaagcccggcgcgctcaccagctaaatctggtatatattccaggctaaattgttacaaagcatatttaacagcaggttaagtatacatttaatcataagacacagtatttatcctgtcggtattattacgcgctacaaattgtgcgcaacgacagacagtcagaaggttgaactcacgatgaaaacgccgctgatcacccgcgagggatatgaaaaactgaagcaggagatggactacctgtggcgccaggagcgtccggaagtgaccaaaaaggtgacctgggccgccagcctcggcgaccgcagcgagaacgcggactaccagtacaacaaaaagcgcctgcgggagatcgatcgccgggtccgctatctgaccaaatgtctggaacagttgaaaatcgtcgattactcgccgcaacaggaaggtaaagtcttcttcggcgcctgggtagagattgaaaacgatgaaggcgatatcaagcgctttcgcatcgtcggttacgatgaaatttttggccgcaaagactatatctccatcgactcgccgatggcgcgcgcactgttaaaaaaagaggttggcgatctggccatcgtcaacacgccggcgggcgaagccagctggtatgtcaacgagatcgaatacgttaaatagacaagaactttccgagagacgcccggcgcggctggtatttttagccgtcagtccgtataactagtccctgttttttgaccctaaagatgaattaaaagccatgatgaatgattcgctctgccgcattattgcgggtgaacttcaggccagagccgaacaggtagaagctgccgttcgcctgcttgatgaagggaacaccgtgccgtttattgcacgttatcgtaaagaagtcaccggcggtctggatgacacgcagctgcgtaatctggaaactcgcctcggctatctgcgcgaactcgaagaccgtcgtcaggcgatcctcaaatccatcgctgaacagggcaaactgaccgacgcgctggaaaaagccatcaacaccacgctcagcaaaaccgaactggaagatctctacctgccctacaagccgaagcgccgtacacgcggccagatcgctatcgaagccgggctcgaaccgctggctgacctgctgtggaacgaaccggcccacgatccggaagcggaggccgcaaaatatattgatgccgataagggcgtagccgacagcaaagcggccctggacggcgcgcgctatattctgatggagcggtttgccgaagacgccgcgctgctggcgaaggtccgtgactatctgtggaaaaacgcccacctggtctccaccgtcgtcagcggtaaagaagaggaaggcgctaaattccgcgactacttcgatcaccatgaaccgatcgccaccgtgccgtcgcatcgcgcgctggcgatgttccgcggtcgcaacgaaggcgtcctgcagctctctttaaacgctgacccgcagtttgacgagccgccgaaagagagccacggcgagcaaattattatcgaccacctgggcctgcgcctgaataacgccccggcggacagctggcgtaaaggcgtcgtcagctggacctggcggatcaaagtcctgatgcatctcgaaaccgagctgatgggcaccgtgcgcgaacgcgcggaggacgaggcaatcaacgtcttcgcccgcaacctgcacgatctgctgatggccgcgcccgccgggctgcgcgccaccatgggactcgatccgggcctgcgcaccggggtgaaagtggccgtcgtcgacgccaccggtaaactggtcgctaccgataccatctatccccacaccggccaggccgccaaagcggccgtcgccgtcgccgcgctgtgtgagaagtacaacgttgagctggtggccatcggcaacggtaccgcctcgcgtgaaaccgagcgtttcttcctcgacgtgcagaaacagttcccgaaggtcaccgcccagaaggtgatcgtcagcgaagccggggcttccgtttactccgcctccgagctggcggcgcaggagtttccggacctcgacgtgtcgctgcgcggcgcggtctccatcgcccgccgtctgcaggatcccctggccgagctggtgaaaatcgacccaaaatccattggcgtcggccagtatcagcacgacgtcagccagacccagctggcgcgtaagctggacgcggtggtggaagactgtgtgaacgccgtcggcgttgacctgaacaccgcctccgttccgctgctgacccgcgtcgccggcctgacccgcatgatggcgcagaacatcgtcgcctggcgcgacgagaatggtcagttccaaaaccgccagcagctgctgaaagtcagccgtctggggccgaaagcctttgaacagtgcgcgggcttcctgcgtatcaaccacggcgacaaccctctggatgcctccaccgttcacccggaagcttacccggtggtcgaacgtattctggccgccacccagcaggcgctgaaagatctgatgggcaatagcagtgcgctgcgccacctgaaggcagtggacttcaccgatgagaagtttggcgtcccgacggtcaccgacattatcaaagagctggaaaaaccgggccgcgatccgcgtccggagtttaagaccgcgaagttcgccgatggtgtggagaccatgaatgacctgctgccgggaatgattctggaaggtgccgtcaccaacgtcaccaacttcggcgcgtttgttgatatcggcgttcatcaggacggactggtacacatttcgtcgctttctgaccggtttgttgaggatccgcacaccgtggtgaaagcgggcgacatcgtcaaggtcaaagtgatggaagtcgatctgccgcgtaagcgtatcgccctgaccatgcgtctcgacgagcagccgggcgacagcaacgcccgccgcggcggtggtcaggagcgcccgcagggtaaccgcccggccgcgaaagccgccaaaccccgcggtcgcgaggcgcagcctgccggcaacagcgcgatgatggatgccctcgccgcagcgatgggtaaaaaacgctaaactctccctgcccctttttcaggggcagttttttttcatgaccaggccatcgccatcacgcgcaaaacagcttcagttgtttctgataacctacttttattccacgcctgaaaggcagcgaaattaatattttcatttcgttaacttcagaaaccttaattaaacattagatcgccgaaataatatttcgcgcatttttgattacaggctgactttgcggcatatcaataaaaaggtgattttcactttaaaaatagcctgcagcgcatcatatgtattgatgataaaaaccattctcattatcatcgattacagaacgttttttcttttttcgttggctacggtccccggcgcaactgcctccaggcgtccggaaaattcttcttcggttagcgatagacaagtaggccctatgcaattcacacctgatagtgcgtggaaaattaccggtttttctcgcgatattagcccagcataccgtcagaaactgctctccctcggcatgctgcccggttcctcttttcatgtggttcgcgtggcgccgctcggcgatcctgttcatattgaaacccgacgcgtcagtctggtattacgcaaaaaagatctcgccttaatcgaactggaagcggttgcacaataacggctggcccggcacaagagtctgaaatatgcaaaaattaaccgttggtttaattggtaatcctaattccggcaagaccaccttatttaatcagctgaccggcgctcgccagcgcgtgggcaactgggctggggtgaccgttgagcgtaaagaggggattttcgccaccactgaccaccaggtcacgctggtcgacctcccgggaacctactccctgaccaccatctcctcgcagacctcgctggacgagcagattgcctgccactacatcctgagcggcgacgccgacatgctgattaacgtggtcgatgcctccaacctcgagcgcaacctctatctgacgctgcagctgctcgagctggggatcccctgcgtcgtcgcgctgaacatgctggatatcgccgaaaagcagcaggtgcggatcgatatcgacgccctcgccgcccgtctcggttgcccggtcattccgctggtatcgactcgcggacgggggatcgaagcgctgaagatcgccctcgaccgtcatcaggcgaacagcgatcttgagctggtccactatccgcagccgctgctgcgcgaagctgacctgctggcgcagcagatgtcagcgcagatcccgacccggcagcggcgctggctgggtctgcagatgctggagggcgatatctacagccgggcctatgccggcgacgccgccgataaactggatatcgccctggcgaatctcagcgacgagatcgacgacccggcgctgcacatcgctgacgcgcgctatcagaccatcgccgccatttgcgacgccgtcagcaataccctgaccgccgaaccaagccgcttcaccgccgcgatggacaaagtgatcctcaaccgcttcctcgggttgccgatttttctctttgtcatgtacttgatgttcctgctggcgatcaacatcggcggcgcgctgcagccgattttcgatgccggctcggtcgcgatctttgtgcatggcattcaatggctgggttacaccctgcacttcccggactggctgaccgtgttcctcgcccaggggatcggcggcggtatcaacaccgtgctgccgctggtgccgcagatcggcatgatgtatctgtttctctccttccttgaggactccggctacatggcgcgcgccgcctttgtgatggatcgcctgatgcaagccctcggcctgccggggaaatccttcgtcccgctgattgtcggttttggctgcaacgtgccgtcggtgatgggcgcccgcacccttgacgcgccgcgcgagcgtctgatgaccattatgatggcgccgtttatgtcctgcggcgcgcggctggcgatcttcgccgtcttcgcggccgccttctttgggcagaacggcgcgctggcggtcttctcgctctatgtgctgggcattgtgatggccatcctcaccggcctgatgctgaagcacaccattatgcgcggcgaagcctcgccgttcgtgatggagctgccggtgtaccacgtcccgcatatcaagagcctgattatccagacctggcagcgcctgaaaggctttgtgctgcgcgccgggaaggtgatcgtcatcgtcagcatcttcctcagcgcgctgaacagcttctcactgagcggtaaggtcgtcgacaacatcaacgactccgcgctggcctcggtgagccgggtcattacgccggtgtttaaaccgatcggcgtgcatgaagataactggcaggccaccgtcggcctgtttaccggcgcgatggcgaaagaggtggtagtgggtacgctgaacaccctctataccgccgaagatatccagaatgaggaattcaatccgcagaccttcagtctcggcgaagaactgctcgccgccgtcgatgagacatggcagggactgaaagacaccttcagcctcagcgtcctggccaaccccatcgaagccagcaaaggcgatggcgaaatggccaccggcgccatgggggtgatgggcagtaaatttggcagcgcagcggcggcatacagctacctgatcttcgtcctgctctatattccctgcatctcggtgatgggcgccatcgcccgcgaatcaagccgcggctggatgaccttctccatcctgtgggggctgaatatcgcctattcgctctcgacgctctattaccagaccgttagctttagcgatcacccgcgctacagtctggtatgtatcctggcggtagtgttgttcaacgtggtgctcttcggcctgttgcgccgggcgcgcagccgggtggacgtctcgctgctggccacgagaaaaacgccggtctcctgctgttccagcccggctggcgattgccactaaggagggactgtggcgtcgttaatggaagtccgcgatatgctggccctgcagggccgcatggaggcgaaacagctcagtgctcgcctgcagacacctcagccgctgattgacgccatgcttgagcgaatggaagccatgggtaaggtggtccggatcagcgaaacgagcgagggctgcctctccggcagctgtaaaagttgccctgaagggaaagcggcgtgccggcaggagtggtgggcgctgcgatgaaaggagtcaggccaggtcgcgcaacgaggtaaaacgagtaagacagctatgaaaaacgggccagcaggcccgttttcttatgactggattatttataaacgtcagcgttcgcgtgtacggttttttcgtttttctgcccggcaatcacaacaaagtatttcccacccagctcatcggcttttttcgacagatcgcggcgggcgtccatcggcgacgtcgtcctggaggtcgtaatgctaccgaccttggtcagattcatcttcgccacgtcttctttttggatctctttcgcggcgaatgcgccgaaagagagggtgcctatcaccagagatgcaaccattcctgtaacaagtttcatagcctctactctccataaggttgttattgtaggtcacggtggcggattgaaataatcaaccaccgtaacaacctaagtattgctaggaatggcccttttaccatggcgcggcaaaaaaaattaccccagccgcgtcttcagcgccagcagcggctcgcagaaggccgcgggatgggaaacaaacggcgcatgcgcggccttatcgaagaggattgactcgctttccggccacaggtcatccagcaacgggacgatcttgcgcggcaccagtccatccagccggccatacagccgcagaaacggcatcggcagcctgaccagcgcctgacgcagatcgacggttctgaggatctccagtccgccattcagcgccgcggcggaaggcatcggcagcgagagcaccgcctgctttaacgcccgcgcatcctgacgcgcgctctctgtgcccatggtttgcagggcgaggaatcgctcgacggtgcgctggaaatcgtcgctcagctgctgctgaaatccggccagcacctcgggcttgatgccgagccagtcgtcacgagccgcgaaacagggggaagaggcgaccgtcaccagcgcctgcacgcgttccggacgcataatcgcgacctggctggccaccagcccgcccaggctccagcccagccacaccgcctgtggaggggcctgctccagcacccgctgcgccatcgcctccagcgacatcgccccaaacccgccgctgcgcccatagcccggcagatccaccaggtggagggtaaaatgcgaagccagctgcggcgtgatgcaatcccatacctgagcgttcagcccccagccgtgcagcagcacaagatgacaatctccttcgccgattgtttgccaccagatgtcgttcatccgttaccgttctctttttactggacagaaggccaaatatgctaacagcacacagcttatgctggctatgccaaatgccgctggcagtcgcccgctgggggatctgctcccgctgcagccgcgccctgctcgcctgtcccccgctctgcccgcagtgcggcctgccggcggcggcatcccgtcacccctgcggccgctgcctgcaaaagccgcctccctggcattggctggtggcggtcaatgactatcgcccgccgctgagcggtctggtgcagcagctgaagtttcaccatcgcccggagctgggccccgccctcgcgcgtctgctgctgcagcgccttctgcagcgtgacgatttgccgccagtagacgctctggtcggcgtgccgctatggcatcgccgtcgctggcgccggggttataatcagtgcgacgaactgtgccgaccgttagcccgctggcgaggatgcgtctggcatcgcgaaggcctgactcgccagcgagccggcgccgtccaacattcgctcaatgcccgccagcgcaggcagaacctgaaaaatgcctttcagcttgaatttgccgtgcagggactccatatcgctctggtggatgatgtcgtcacgaccggcagcaccgtcgccgagatatcccgcctgcttttgcgaaacggcgccgcgacggttcaggtatggtgtttgtgccgtaccttgtagacccccgctgatgggcgtattataacccagtaaaatagtcaactattaggccaacgctatgatccgtatttccgatgctgcacaagcgcactttgccaaactgctggcaaatcaggaagaagggacgcaaattcgcgtatttgtgattaatcccggcaccccaaacgctgagtgcggcgtatcctactgcccaccggatgcggtggaagacaccgacacggcgctgaaatttgaacagctgaccgcctatgtcgatgagctcagcgcgccctatctggaagacgctgaaattgatttcgtcactgaccagctcggctcgcagctgacgctgaaagcgccgaacgccaaaatgcgcaaagtctctgacgatgccccgctgatggagcgcgtcgagtacctgctgcagtcgcagattaacccgcagctggcgggccacggcggccgcgtatcgctgatggagatcaccgacgacggtctggctatcctgcagttcggcggcggatgcaacggctgctcgatggtcgacgtgaccctgaaagaaggtattgaaaaacagctgctgaacgagtttccggagctgaaaggggttcgcgatctgaccgagcatcagcgcggcgagcactcctactactaagcccttcctccggcggcaccctgccgccggtcctccctggccctttctgtgttaccgcgcaacatctcccgctaaacgaccggcaaaaaccggggaaagagtatgacttaagtctcatatttaacattttcccccgtcaggtgattctcaaccctcacatgttacccgtatcatccatttcaggcgccaccggcaaaaaaatagccagctatcctttctctgggtaaggataatgcaagcgtttacggcgccagactattttgctccctgacggagcggatgctctacaggttcgaactttgacgttacccataacaaattaaggccaggtaaatcatgccattagtcatcgttgctatcggggttgccctgttgttgctgttaatgatccgtttcaaaatgaacggcttcattgcgctggttctggtggcgctcgccgtcggattaatgcagggtatgccactggataaagtgatcgtctccatcaaaaacggcgttggcggcacccttggcagcctcgcgctgatcatgggcttcggcgctatgctcggtaagctgctggcagactgcggcggcgcccagcgtatcgccaccacgcttatcaataagttcggtaagaagcatattcagtgggcggtggtcctgaccggcttcaccgttggcttcgccctgttctatgaagtgggcttcgtgctgatgctgccgctggtgttcaccatcgccgcctcggcccgtattccgttgctgtacgtcggcgtaccgatggcagccgcgctctccgtcacccacggcttcctgccgccgcatccgggtccgaccgcgatcgccaccatcttccatgccgatatgggcaaaacgctgctctacggcaccattctggctatcccgacggttatcctggcgggaccggtgtttgcgcgcttcctgaaagggatagataagccgatcccggaaggcctgcataacccgaaagtgttcactgaagaagagatgccaggctttggcgtcagcgtctggacctcgctggttccggtgatcctgatggcgatgcgcgccgtggctgagatgatcctgccgaaaggccacgccttcctgccaattgccgagttcttcggcgacccggtgatggccaccctgattgcggtactgattgccctgttcaccttcggtttgaaccgcggccgctccatggagcagatcaacgataccctgacctcttcgatcaaaatcatcgccatgatgctgttgatcatcggcggcggcggcgccttcaagcaggtgctggtggatagcggcatggataaatacatcgcctctatcatgcacgaatcgaacatgtctccgctgtttatggcgtggtctatcgccgcggtgctgcgtatcgcgctgggttcggctaccgtggccgccatcaccgcgggcgggatcgccgcgccgctgatcgccaccaccggcgtcagcccggagctgatggttatcgccgttggctccggcagcgttatcttctcccatgttaacgatccgggcttctggctgttcaaagagtactttaacctgaccatcggcgagaccatcaagtcctggtcggtgctggaaaccattatctcagtctgcggcctggtgggcagtcagcagctggcctttacccaccaggaggcgaaacaatttttcgactgtcgtctgacatcgcctatcgaagccgacgacagtagccggctgtgcgacgatgtcgccgggtgggccaccgcgctacaactcatcgccctctccgcccgccagaataactcctccgcccaacactccgcccgccgcctcgccgggattaacgccagccatctgtcggattatctggtggatgaagtgctggataacgttgacgcccgcacgcgcaactttttgctgaagagttctctgctgcgctcaatgaacgacgcgttaatcgtgcgcgtcaccggcgaagagaatggccagatgcagctggaggaaatcgaacgccaggggctgttcctgcagcggatggatgattccggcgaatggttccgctatcacccgctgtttggcagcttcctgcgccagcgctgtcagtgggagctggcggttgaactaccggagatccaccgcgccgcggcggaaagctggatggcgcaaggtttccccagcgaggcaatccaccatgcgctggcggccggcgatgccaaaatgctgcgcgatatcttgctcaatcatgcctggggcatgtttaaccatagcgagctggggctactggagcagtcgctggcggcgctgccatggtccaatctgctggaaaatccgcgcctgatcctgctccaggcctggctgatgcagagccagcatcgctacagcgaagtcaataccctgctggcgcgcgccgagcaggagatgagtgtggaaatggacaccgcgatgcatggcgacttcaacgcgctgcgcgcacaggtggcgattaacgatggcgaccaggacgaggcggaacgtctgtcaatggtggccctggaagagctgccgctggccaactattacagccgcatcgtcgccacatcggtgcatggcgaagttctccattgtaagggaaagctgaccaaatccctcgccgtgatgcagcagaccgaacagatggcccgccgtcacgacgtatggcattacgccctgtggagcatcattcagcaaagcgaaatcctcttcgcccagggcttcctgcaggccgcctgggagagccaggagaaagccttccagctggtacgcgaacagcatcttgagcagttgccgatgcatgagttcctgctgcgcatccgttctcagctgctgtgggcatgggcgcgcctcgacgaggctgaagcttgcgcccgccaggggatggacgtgctatccacctatcagccgcagcagcagctgcagtgcctggcgctgatggtccagtgctcactggcgcgcggcgatctggataatgcccgcagccacctgaaccggctggaaaacctgctaggtaatggtcactatcacagcgactgggtctccaacgccgataaggtgcgagtgatctactggcagatgaccggtgataaaaccgcggcggccaactggctgcgccagacgccaaagccggagttcgccaacaaccacttcctgcagagccagtggcgcaacatcgcccgggcgcagatcctgctgggcgatttcgaaccggcggaaatggtgctggaagagctgaacgaaaatgcgcgttcgctgcgtttgatgagcgatctcaaccgcaacctgctgctgctcaatcagctgtactggcagtcgggacgcaagagcgaagcgcagaaagccctgctggaagccctgacgctcgccaaccgcaccggttttatcaaccactttgtgattgaaggcgaggcgatggcccagcagctgcgccagctgatccagttgaacacgttgccggagctggagcagcatcgcgcccagcgtattctgcgcgacatcaaccagcatcatcgccacaaattcgcccactttgacgaagggttcgtcgagcgactgctgaatcatccggaggtgccggagcttatccgcaccagcccgctgacccagcgcgagtggcaggtgcttggcttaatctattccggttacagcaacgagcagattgccggcgagcttgacgtggcggccaccaccatcaagacccacattcgcaacctgtatcagaaactgggcgtcgcccaccggcaggacgcggtacagcatgcccagcagttacttaagatgatgggatacggcgtctgacgacgccgttgccgtttagcacagctccagctgaaggttgttatcagtgatcaccttcagcacgccggccggcggcagcacgtcggtatagaccgcatcgaccatactgatgctgcccatgttgaccatcgcattgcggccaaacttggtatggtccaccaccagcatcacgtggcgtgaattctcaatgatcgcccgcttggtgcgcacttcatgataatcaaactccagcagcgagccatcgctgtctacgccgctgatgccgagaatgccgaagtcgaggcggaactgcgagataaagtcgagggtggcttccccgatgatcccgccgtcccggctacgcagttcgccgccggcgagaataatgcggaagtcctctttcaccatcagcgtgttggcgacgttaaggttattggtcacaatccgcagatcgttgtgatcgagcagggcgtgcgccaccgcttccggcgtggtgccgatatcaataaacagcgtcgccccgtccgggatctcgctggccacccgccgggcgatacgctctttctccgccgtctgggtcgctttgcgatcgtgccaggaggtgttcaccgagctggagggcagcgccgcgccgccgtgatggcggaggatcattttctgttcggctaaatcgttcaggtcgcggcggatggtctgcgggcttaccgcgaactgctcaaccagctcttccgtgctgacgtaaccctgtttttttaccagctcgataatggcgtcatgacgttgtgtttgtttcatgaaatatccctggaaaaatatcgcctacccgacccctgtcggtaagtctttatgcgcgttttcgcccatgtaaggtatcaacaaacgccatcgccaggccggtcgccagaccagccacgtgcgcgccgttggcgatcgccatgccgaaaacatcaaaccagccagcaattaaccacactaaagagaagagtatcaacccgcgctgcagataaataccgctctgcggatcgcgctcgccccgcagccagacgtagcccatcagcgcgtagaccacgcccgacaagccaccaaaccacgggccgctaaactggtgctgcacgaagccgcttagcagagcgctgatgacggtgatcaccaccagcttgccgctgccgatgcgcttttccaccgcgccgccaagataccaccaccatagcaggttgaagagaatatgcatcagcgagaaatgcatgaaagcatggctgaaatagcgccaggcttcgaactgcagcgaaggatcgtagggccaggccagccaaatcatcaccggctgatcgcccagcagattttgcaggatgaacaccgcgatgcagatcagcagaatcgcccaggtgaacggaccggcgttatgccgcagcgtggcaaagaaaggaaagcgctgatagcgcaacccgctattggtctgtccggactgccagctcgccgccagatagcgcgggtccgccgggttttcgagaaaacgcgccagctcagccctgacgcgcccggcctgactctcatcagccagccagacgtcgctctgggtatgctgctggatggtcaggataatcccctgcgtcgccatataatcgacaaacgcctgggccacccgcgggttggcaaaagaggtaatcattaacatgcagcgaatcgcttattccacacaaagggggatagtatacctgccagtcgttaaaacgtcccgcgcgccacttccgccgggaaatggcgatgccaggcgtcgaacccgccgtcaacgctatagaccttatcaaacccctgctgcagcagatactgcgcggcgcccttactgctgttgccgtgatagcacatcaccatcaccgccgtgtcaaagtcgttgtcacgcataaacgcgcccagcgtatcgttggtcagatgaaacgcgcccggcgtatgacccatcgcatagctttgcggatcgcggatatcgaccagtaccgccgtctgctgatgcagtttctggtgcgcttcttcaacattgatgcattcaaactgttccatgattctcttctctttctcgtcatgacgggcgatggccggcccaattttaccctgtagtgtaccgtcaggcggtaaagaaacgccaatatgttacacccatcacttcaaaatgtttttttgatgttaccaaaagcgcgtttgtttgctatagtgagcgatatcgagcatttatgagcttaaacgaaagtgtgagagggtaagaacgtggaaaccaaagatctgattgtgataggcggaggcatcaacggtgccggtatcgcggcagatgccgccgggcgtggtttatccgtactgatgctggaagcgcgcgatctcgcctgcgccacctccagcgccagttccaaactgatccacggcgggctacgctacctcgaacactatgagttccgtctggtcagcgaagcgctggccgagcgtgaagtgctgttaaaaatggccccgcatatcgccttcccgatgcgctttcgcctaccgcatcgcccgcatctgcgcccggcatggatgatccgtatcggcttgtttatgtacgatcatctgggcaaacgcaccagcctcccgggatccaccgggttgcgttttggcgcagaatcggtacttaaaccggaaattgtgcgcggtttcgaatattccgactgctgggtcgacgatgcccgcctggtgctggccaacgcgcagatggtcgtccgcaaaggcggcgaagtgcgtacccgcacccgcgctatctcggcgaaacgtgagaatggcctgtgggtggtggaagcggaagatattgatagcggtgagaagtttacctggaaggcgcgcggcctggtcaatgccaccggcccatgggtcaaacagttcttcgacgaagggatgcatctgcgctcgccttacggcatccgtctgatcaagggcagccacatcgtggtgccgcgggtgcatacccagaaacaggcttatattctgcagaacgaagataaacgcatagtatttgttattccgtggatggatgagttctctatcatcggcacgacggacgtcgagtataagggcgatccgaaagcggtggccattgatgataaagagatcaactatctgctgaacgtctataacgcgcactttaaaaagaccctcagccgggacgatatcgtctggacctactccggcgtccgtccgctgtgcgacgacgagtcggattcgccgcaggccattacccgcgactataccctggatattcacgatgagaacggtcaggcgccgctgctgtccgtcttcggcggcaagctgaccacctatcgcaaactggccgagcatgcactggaaaaactgaccccctattacaaagggatcggcccggcatggaccaaaaccgcggtgctccccggcggcgatatcggcggcgaccgcgacgactacgcggcaaaactgcgccgtcgcttcccgttcatcagtgaatcactggcccgccattatgcccgcacctacgggagcaacagcgagtggatcctgaaggaagccagcgccctgagcgatctcggggaagatttcggccacgagttttatgaagccgagctgaaatatctggtggagcacgagtgggtgcgcagcctggatgacgccatctggcgtcgaaccaaacagggtatgtggctgactgccgagcagcaggcgcgcatcagcgaatggctggcgcagcatgcgggaaagtctgaactgtcgttagcgtcctgacatcgcgtggcgccaggagagaaatacccgggctatggcttgcgcttggcccggatacctgttcacaaattaaacgagactttttttccagtcggcaatgtgacatttatactgagttctccccccaatgccgcaatgtagcgttttagggtcgaaagccgagggtcgttatcagcctgttccattttagcgatcgttggctgctttacccccatagccgcagccatctctgtttgcgacatttgcaactcttctcgaagcaagtttaaagcgacagactggcgtatctctgccgctttcgctgcaatacgctgctggctatcaggactctgtttcgccatgagttcttttagcgtggccattatcgctccttagtcaggtgttggctgaattctctgtcagccagagtaatcatctctttgtaaaaacgtttctcattcatgccatccttatcgcccgcacataaaacgatagctttccgcagaggatcaaaagcaaaaaaggcgcggatggggagcccatgatgctgaacccggagttctttcatattctgaaacgttgaatctttcaccgtatcaacatacgggcgcccaagctgcggagcaaactcagacaggatgagaatcgtggccaacatatcctcttttaaagctctactttgtaattcgaaccaggtatcaaacgtatccgtcgtttctacatcccacataggctatgaacgtaaacttattgagcatttatcgtactgctggcgaattcacgtcaatagtatattcccgcaatagcctgaatcctccccggcacttttccgaataaaacgttcgccacacaacacaacggggccaaatggccccgttgtgttgtgtggtgttgcattgactggcttacagccttaccgggtcgatatgccagatatatttcgcgtactcctggatcgtccggtcagaagagaagtagcccatgttggcaatattcaacattgccttataagcccactcttccgggttttgatacagctcgtcgacgcgatcctggcagtccacatagctacgatagtccgccagaacctggtagtggtcgccaaagttaatcagcgaatccagcaggtcgcggtagcgccccggttctgccgggctgaagacgccggtaccgatctgcgtcagcgcctggtggagctcttcatcctgctcgtaatattcgcgtggtttatagccgctgcgacgtagctcctccacctcttccgcggtgttaccgaagataaagatattctcttcgcccacgtgctcctgcatctccacgtttgccccatcaagggtgccgatagtcagcgcgccgttaagggcaaacttcatattactggtgccggaagcttcagtgcctgcgagggagatctgttccgacaggtctgccgccggaatgatcagctgcgccaggctaacgctgtagttggggataaagacgaccttcagcttgtcgccaatctgcggatcgttattaatcaccgccgccacatcgttgatcaggtgaataatgtgcttggccatgtagtaggccgaggccgccttaccggcgaaaatattcacccgcggcacccactcggcctgcggatcggccttgatccggttatagcgggtgatgacgtgcagcacattcattagctgccgtttgtattcatggatacgtttgatctgcacatcaaacagcgccttcggattgaccaccacattgagctgttgagcaatatagctggccagccgctgtttgttctcaaacttggcctgacgcaccgcctgattgaccatcggatagtcgatatgctgtttcagctcatcaagctgactcagatcggtccgccaggtgcggccgatatgctcatccagcactttcgacagcggcgggttggccagcgccagccagcggcgcggcgtcacaccgttggtcacgttgataaagcgcattgggaagattttggcgaattcggcaaacagtgactccaccatcagtcgggaatgcagctcggacaccccgttgaccttgtggctgaccactaccgccagccaggccatccgcacacggcggccgttagactcgtcgataatcgaggtgcggctgaggaggtcggtatcgttcggatactgctcctgcaaagtcttgaggaaatagtcgttaatctcgaagataatctgcagatggcgcggcagaattttacccagcatatccaccggccaggtctcgagcgcttcgctcatcagggtgtggttggtataggagaagacctgacaggtcacctcgaacgcctcgtcccagctgaacttatgttcgtcgataagcagacgcatcagctccggtatcgacagcaccgggtgggtgtcattcaggtgaatggcaatcttgtccgccaggttgtcataggtcttatgcaacatgtaatggcgactcaggatatcctgcaccgtggccgacacgaggaaatactcctggcgcaggcgcagctcgcggccggagtaggtcgagtcgtccggatagagcacgcgggagacgttttcggagtggtttttatcctctaccgcggcgaagtagtcgccctggttgaatttaccgaggttaatttcgctactggcctgcgcgctccacagacgcagtgtgttggtggcgtcggtgtcaaagccggggatgatctggtcgtaggcttccgcaatgatctcctccgtctcaatccagcgggttttctttccttcctgctgaatgcggccgccgaagcgcactttatagcgggtgttgtggcgctcaaactcccacgggttaccgtactccagccagtagtcaggagactctttttgtcggccatcgacaatattctgtttaaacatcccgtagtcgtagcggatgccgtaaccgcgtcccggcagacccagcgccgccagggagtcaaggaagcaagccgccagacggcccagaccgccgttgccaagcccggggtcattctcttcatcgatcagctcttcgagatcgagccccatctccgccagcgcgctgctcacatcgtcataaatgcccagcgacagcagcgcattcgagagggtgcggccgatcagaaactccatcgacagatagtacacctggcgcacttcctgggagagctgcgcgcggttggagcgcagccagcgctccaccatgcgatcgcgaacggcaaacagcgtggcgttaagccattcatgcttgttggcgatggccggatctttaccgatgataaacatcagtttataggcaatagaatgctttaacgcctcaacgctcagcgtcggtgatgcatagctaaagggtacattcataacaatgactccagtggttacatcaagcgttgataaagttcgcgataggagttcgcggcaacctgccagctaaaatccatattcatcgcctgacgctgcacgtagcgccagagcgacgggcgcgaccagaggacaaaggcgcgacggatagcgcgcagcaatgacagcgcattgctgtcctcaaagacaaaccctgtcgccagaccatcggccagattctccagcgaactgtcagcgacggtgtccgccagaccgccggtgcggcgcaccagcggcagcgtcccgtacttcagaccatacagctgggtcaggccgcagggttcaaagcgactcgggaccagaatgacgtcggcgccgcccataatgcggtgggagaaggcctcatggtagccaatctgcacacccactttgcccgggtgttcggcggcggcggcgaggaaaccttcctgcagcaccggatcgccggcacccagcagcgccagctggccgccctgctcaagcagacccggcagcgcttcaagcaccaggtccagccctttctggctggtaagacggctgacgacggcaaacaacggcgctttatcatcgaccttcaggcccatggcaatctgcagctgacgcttgttctccgccttctcctccagcgtgtcgcgatcgtagcgcatcggcagcagcagatcgttttgcgggctccagataccgtcgtcaacgccgttgagaattcccgacagccgaccttcatgatggcgctggcgcagcagcccctccatgccgtaggcgtactgcggctcggtgatctcgcgcgcgtaggtcgggctcaccgccgtaatatggtcggcgtagtagaggccggccttgagaaacgagatctgcccgttaaactcgaggccatgcatgttatagaacgaccacggcagctcaatgtcattcatatgccaggagtaaaacatcccctggtacgccaggttgtgcacggtaaacaccgatttagccgggcgtccgcgcgccgccaggtaggccggcgtcaggccggcgtgccagtcatgggcatgcaccacatccgggcgccagaacggatccagtccgctggccatttcacttcccacccagcccagcagcgcaaagcgcaggacgttgtcgggataagcgtgctggttggtatcgtggtaagggctccccggacggtcatagagatgcggggcgtctatcaggtagatccccacgccgttaaagtggccgtacagcagcgtgatccgcccggcgaaggtatcccggcgggtcaccacctgggcatccaccacgccgcgacggatatcgggaaacgccggcaacagcacgcgcgtatcgataccctccgcgatttgcgccgccggcagtgcgccgatgacgtccgccagaccgcccgtctttaacagcgggaacatctcagaacatacatgtaagacctgcattagcgctcctgtttgtgccctaatttccgcagcatgtcgcgggtcaccagcacgataccttcctctgagcgatagaagcggcgtgcatcctcttccgcattctcaccaatcaccattccttccgggataacacaggcgcggtcaatcacgcagcgacgcaggcggcatgagcgccccacccagacatctggcaacaagactgccgaatcaatgttacagaacgaattcacccgcacgcgcgggaacagcaccgactgcaccaccaccgacccggagataatgcaccccccggaaaccagcgagttcagggtcatgccgtggctaccggagcggtcctgcacgaacttcgccggcggcagcgattccatatgggtgcggatcggccagttctggtcgtacatatccagctccggcgtgactgacgccagatcgaggttagccttccagtaggcttccagcgtccccacgtcgcgccagtaaggttcggcgttcgggtcggattgcacgcaggagagcgggaaaggatgtgcataagccatgccagcttcggtgatcttcggaatgatgtctttgccgaaatcgtggctggagttctcgttgcgatcgtcttcttccagcagctcataaagataggcggcgtcaaagacataaatgcccatgctggccagcgatttggtcgggtcggtcggcatcgccggcgggttggcgggtttctcgacaaactcaatgattttttcgttttcgtcgaccgccatgacgccgaaggcggatgcctcttcaatgggcaccggcatgcaggccacggtgcaacgcgcccctttttcgacatggtcgatcagcatgcgcgagtagtcctgcttataaatatggtcgcccgcgaggatcaccacgtactcggccttgtagcggctgatgatatccaggttctgcgtcaccgcatccgccgtgccgcgataccaattttcgccatgcacgcgctgctgagccggcagcagatcgacaaactcgttcatctcttcgctgaagaacgaccagccgcgctggatgtgctgcaccagcgtgtgcgactgatactgggtaataacgccgatgcggcggatccctgagttaatgcagttagataatgcgaaatcgataatacggaacttgccgccaaagtgaacggcaggtttcgcacgcttaatggtgagatccttcagccgggtgccacgcccgcccgcgaggatcaacgccacggatttgatgggtaattgacgcgccagcatcagcggatcgtttttttcaagcctaaccatgattaactcctttttacacccccgctttccagctcatcccgccgcgccgccgccacgggtccaaccgaaagcttcagggcttacgacctttgaaatacgcacactccgtgcgcgggcccatgccagacagccatgatgaccggattatcctctccggcgaatggaggaacggcgcgccattccccctcgggtaaaaccatatcgaccacctctgcggtggcgttcagcgtgagcagccagcgatccgacaactggatctgcatacacgcggccccctgctgccactccgcggcagtcaggggctgggcgttgcgattaagccagcggacgttgccatccccctcctgccaccagcggttgcgggtgagcgccggaatacgacgccgcaggtggatcagcgccgcggtaaaggcggttaatcccgggttcgcctggcgccagtccagccacgtcagggcgttgtcctggcagtaagcattattgttaccgtgctggctgtggccctgttcatcgcccgccagcagcattggcgtcccctgagccagcagcagcgtcgtcagcagcgcatgcgcgctggcgcgccgccgttcaatcaccgcaaaattcgcttctaatccttctataccatgattgttgctgtagttattgttagtcccatcgcgattctcctccccgtttgcctcattgtgtttctgattgaaacaaacgcagtcgcgcagcgtgaagccatcgtgggccgtcaccaggttgaccgtcgccgatggcggcttgccatcgcgggcaaagagatcgctggaggccgcgaaacgttgcgcaaaatcccccagggagacattttgctgtagccagaagcgtcgggcgctatcgcgaaaatggtcattccattcagcgaacagcggtgggaaattacccacctgatagccgcccgggccgatatcccaaggttccgcaatcagtttcacctgcgacagcacgctgtcgcggcggatagcctcgaacagcggcgcatcctggcggaattccggcgtccgccccatcactgaggcgaggtcgaagcgaaagccgtcgacatggcactcatccacccaaaagcgcaaacactggcgcgcccactccaccacgccggggtggctaagattgagcgtattaccgcacccggtccagttgtgataatcgccatcctcccttacccaataatagctacggttgtcgattccgcgcagggagacggtgggcccttcgagatcgatttccgcactatggttgagcacgatatccagaatcacttcgataccggcggcgtgcagcgccttaaccgcatcgcgaaactcatccagggcgcgatccgggtcgctggcgtagcgcggatccagcgcgaaccacgccaacgggttgtagccccagtagttgcttaaccccatccgctgcagtcgcggctcgctggcgaactgcgccaccggcaacagctcaagggcgctgatgcccagcgatttgaagtaagcgatcatcgccgggtggcccagcgctttataggttccgcgaatggcttccggtagctgcggattaagcaaggtgagccctttcacgtgcgcttcataaatcaccgtttccccccatggggtacgcggcggtttatcgccacgccagtcatagcgcagatccaccacctgcgattttggcgcgaccgcggcgctgtcgcggcgatcgggctgccacatgccgccgtgcaggcgctcatcgtcaggcagatcgccctcgacccggtgggcgctgggatcgatcaacagcttggccgggttaaagcggtgcccctgcgccgggtcccagggaccatgtatccgatagccgtagcgcaggcccggcccggcggcggccagccagccgtgccagatgtcgccgctgcgcgccgggagatcgaagcgttgctcgttgccctgctcgtcgaatacgcacagctccacccgctccgcatgggcggagaagagggcgaaattcacccccttgccgtcatagctggcgcccaatggcgcaggtttgcctgccgcgagtgaggtcattgcgcctcccggaccagccagatcgtcgccagcgggggcagggtcagcgacagcgaatgttcgcggccatggctggcgatagcgtcgctttccaccacgccgccattgccctgattgctgccgtgatagtgcatggagtcggtatttagcgcctcgcgccagcggcccggctggttaatgccgaagcggtagtcgtggcgcggcaccggcgtgaagttgctggcgacgataatctcgttgcccgcccggtcacggcgtacaaagacaaacaccgagcgctcatggtcgtcgaccaccagccattcgaagccgtaggggtcaaaatccagctcgtgcagcgctttatgatgacggtaggtatggttcaggtcgcgcaccagccgctggacgccgtggtgccagttgtcgccgccctccagcagatgccagtcgaggctaacgtcatggttccactcgcggccctgagcgaactcattgcccataaacagcagctttttccccgggaaggcgaacagccagccgtagtaggcgcgcaggttggcgaacttctgccaggcatcgcccggcatgcggtcgagaatcgattttttgccgtgcaccacttcatcgtgggagagcggcagcacaaaattctcggtgtagttgtagagcatgccgaaggtcattttgtcatgatggtagcggcgatgcaccggatcgagcttcatgtaatccagggtgtcgtgcatccagccgaggttccatttgaaccagaaaccgaggccgccgccggctggcggacgggtcaccccggcaaaatcggtggactcttccgccatggtgaccgcgcccggcgtctgttcgccaaggatgcggttggtgttgcgcagaaactcaatggcttccagattctcccgcccgccgtattcgttggggatccactctcccgccttgcggctgtaatcgcgatagatcatcgaggccaccgcgtcgacccgcagcgcatcgatgccgaagcgttcgatccagtacagcgcgttacccaccaggtagttgctgacttcccgacgtccgtagttgtagatcagggtattccagtcctggtgatacccctcgcgcggatcgctgtgctcatacagcgaagtgccgtcaaacgaggcaagggcaaaatcatccgccgggaagtggccgggcacccagtcaagaatgacgttcagcccggcggcgtgcgcggcattgataaagtaacggaaatcgtcgcgggtgccgaagcggcgggtcggcgcatagagcccggtgggttggtagccccagctgccgtcgaacgggtgctcgttaaccggcaatagttcgagatgggtgaagcccatccatttcgcatagggcaccagctggtcggccagctcgcggtagctcagccagaaattattatcggtatgacggcgccaggagccgagatgcacttcatagatagagatcggggcatcaaactggttcgccgctctgcggtccgctggctgttccactttgggcggcaggtcgcagataagcgaggcgctttccggacgcatttgcgactcaaaggcgtaagggtcggctttgacccgcagattgccgtgggcgtcaatcagttcgaatttatacagctggccattatgcgcgccgggaacgaacagctcccagatcccggactctttgcggaatcgcatcgggtggcgacggccatcccagtagttaaactgccccaccaccgatacgcggcgggcgttcggcgcccacaccgagaaacgggtaccggtgacgccgtccatggtggcagcgtgcgcgcccagcgtttcataagggcgcaggtgggtcccttccgacagcagccagacgtcaaggtcctgtaacagcggaccaaagcgataagggtcatcgatcagattctgctgcccgtgccaggtgacggccagctgatagcgaaaagcgtttttacgccgcggcaggacgccgctgaagaaaccacgcgagtcgagacattcgagcttgccgactttgcgtccggttttcggttcaataacccacacgtcggtggcatcgggtaataatgcgcgcacttccagcccggcgtcagtacggtgcatgccgagcacggaaaagggatccgcgaaatgaccggcgattagcgcattaatcacgtctctatcaatatgattagacatgctttcatcctgttgtaagtgtcgctcattcctgtaactggcgactttttttgacctgaacggcgcagtgctctcagcatcctcctgctccgtcccaccttcaggtaaggaattccttacttaaagcatagccaaggctgagttacctccgtggggaaaaatctaacatccgcgtttactccttgtattacgcaaaaaaaaagggggcttgaagaccccctttctgttcatcctgggcttacgccagctggcgaagcatccggcgcagcggctccgcggcgccccacagcagctggtcgccaacggtaaaggccgatagatactccggccccatattcagtttacgcaggcgtcctaccggggtggtcagggtgcccgtcaccgcggctggggtcagctcgcgcatggtaatctcacgatcgttcggtaccactttggcccacgggttgtgcgcggccagcagctcctcaacggtcgggatagaaacatctttcttcagcttgatggtaaacgcctggctgtggcagcgcagcgcgccaacgcgaacgcagaggccgtctaccgggataacggacgaggtggcgaggatcttgttggtctccgcctggcctttccactcttcgcggctctgaccgttatccagctgtttgtcgatccacgggatcaggctgcccgccagcggtacgccaaagttatcgaccggcagctcgccgctgcgggtcagcgacgtcactttgcgctcaatatccaggatggcggaagccgggtccgccagctccgcggccacatgattatgcagctgccccatctggctcagcagctcgcgcatatgacgcgcgccgccgccggaagccgcctggtacgtcgccacgctgacccactccaccagatcctgagcaaacaggccgccgagggacatcagcatcaggctgacggtgcagttgccgccgacaaaggttttcacgccgttgttcaggccggcggtgatcacgtcctggttaaccgggtcgaggataatgatcgcatcgtccttcatgcgcagcgaagaagccgcgtcaatccagtaaccctgccagccgcttgcgcgcagcttcgggtaaatctcgttggtgtaatcgccgccctggcacgtgacaataatgtccagcgccttcagcgcgtccagatcgaacgcatcctgcagcgtgccaccggtgctaccgccgaatgacggcgctggctgtcccagctgggaggtagagaagaacaccgggcgaatggcgtcgaaatcgcgctcttcaaccatgcgttgcatgagaacagagccgaccattccgcgccagccgataaaaccaacatttttcataacgtattcctgcgaggtgtgtgctgtttgtgcctggccagtttccaactggattatccctcaccttacaaaatgcagctaaagtcgcaagtgaaattaatcaatgattgctgaacaatcagaaaagcaacttatcctgcacattgtccaccgtcgctggtcgtcgtcaaaagcgcaacgattatcggggaaatcccccggggaatggaatattttccgtcgctattttattgatcctgattatggattaagcgtgaaatctggtgcttttccgcttgccaaaaaaaagcgacaaacccagtcacagcaagggatgacgagggatacgagcatcgtcgtagcgctaataagggccaatagctggcaaggaaaagagggaaaaagggcggtttattgcaaagaagccagggtaagcagcgttaccctggctttttatttcccgcgagcgggagatgagcgggcttagctcagcagctggaaggcgatcataccgacaatcgccccggtggtgccaaggatggtttccatcatggtccaggtcttcagcgtctgggcttcactggcgccggtaaatttaccgaacagccagaagccggcgtcgttcacgtggcttaccacaatcgagccgccggcgatacagatagacaatgccgccatctgcgcgccgctgtagttcagctgctcaatcaccggcatcaccaggccgaccgccgtcaggcacgccacggtggcagagccctgaatgatacgcaccgccgccgccagtacgaagcaggtaatagcgatcggcagccccattccggtcagcgcttcaccaagcgccgggccaacgccggagtcaaccagcacctgcttgaagacgccgccagccccgatcaccagcagaataatcccggccggctgcagcgcgtggccgcaaatctccatcacccggtctttcgccattccctgacgtaccgccagaccgtaaatcgccaccaggcaggccaccaggatcgcggtgaacgggtggccgataaactcgaaccattcgtaggcagtggaacccaccggcacaaagcgcgcggcgatggttttcaggccaaccagcaccagcggcagcaggatcagcgccaggctgaagccgaaggagggcattttgccttcgccgagatgcggttccgtgacgtcgtcaggaatatgcaattcgacgtagcggctgatgaagttgccccatagtggaccggcgataatcatccccggaatggccgcgcacaggccaatcaggatcatccagccaaagtcggcgtgcatttgcgacgccagcagcatcggcgccggtccaggcaacagaaacgccgcggcggcggcaacgccggcaaacagcgggatcaccagcttcacgaggttagtaccggtatggcgcgccatcgagaaggcgacgctaatcagcagtacgatcgccacttcgaagaacagcggcagcgcgcagatgagaccggcgagaccaatcgcatagtgcgcgcgattgtggccaaaggatttgagcatcttgacggcaatctgatcgaccgcccccgtttcatgcaggatcttaccgaacatcgcgccgagcgcgacgacgatcgccaggaagcccagcgtaccgcccatccctttctccatcgtcgccgcgattttatccagcggcatgccggagaagagaccggcgccaatagaaaccaccatcaaagccacgaaggcgtgcattcgcgccttcatgactaaaaacagcagcagcaataccgagccgactgctgttaaaacaagcgttaaagtactcactagtgactgcctttgttgatcacctcgatggtgctggccaccacgccttccagcggctggtcgatatcgacgataagcacatcgctctcgtcggcgcctggttcctgcagcgtttcaaactgcgtcaccaacatttgggttttaaagaagtgccctttacgcgccttcagacggctttcgatcacgtcgaaatcgcctttcaggtagatgaaggagaggttcggattgcccttgcgcagaatgtcgcgatagctcttcttcagcgccgagcagacgatcagcgacaccttgttggtacgctgcatggcgaacgcggcgtcatttagcgcctgcagccacggcgtgcggtcgtcatcgttgagcggctcgccggaggccatcttggtgatattgctgcgcggatggagaaagtcgccgtcaagaaacgcggcatgcagttgatgcgccacttcgctggcgacagcggattttccgctgccggaaacgcccatcaggacatagacgtggtgatcatggttagtcgtgctcaaagcgtcctcccactggactggtacgccgcgccggggctgactcatccagcgcgaaggcggcgtatcggttaattgttacgggtaactgttatcggtaacattgtcatgccggacctgtggagaagcaatatccattcgtgccagatgtgaatatgtgtgatctacttcaaacttgtcagtttaaattgatccgcccggtgacaatgtgaaacctaaatctaacatcttaggggtaatcgcttcaccacgaatgcgcgccagcagccgttcggcgccgatgcgccccattcgctcgcgcggggtcaggacgctggccagccgcggctccatcacctggccgatatcatggccgtggaacccggcgatcgccatatcatcggggatcttcagccccagacgctggcactcgaacgccgcgccgaccgcgaggtcatcgttggtgcagaaaatgccgtcgagctgtggatattcgcggcgcgcctggcgcatcagctcaatccccgaagaataggacgaggattgctccaccatcacgctgtagggcgtcatcccggcgtcaagcatcgcctgctcgtaccccttctgtttgatgatagtacgttcatcaagacgcgcccccagataggcgacatggcggtggccgcgggcgatgatcgccgcggtcatctgccgggcggcttcaaagttatcaaacccgacggcaatatcgagacacggcgaccggctgtccatcagctccaccaccggaatgccagcgacttcgatcatcttcagggtgcgcggcgtatgggtgcgttcggtgaggatcaggccgtcaatgttccaggagagcatcgattcgaggcgtttctcttccatttccggcttatagccgtagtgcgccagcatggtttgatagccgaaggcgtcggtgacgctttcgataccgcgcagcacttccgagaagacctggttggttaacgacggcagcagcacgccgatggcgcggctggtggcgttggaaagaatgtcaggggcgcgattgggaatataacccagttcatcgagggcaacggcaatcttgccacgcagcgcttcggagacctgctccgggttgcgtaaatagcgactgaccgtcattttggtcacgccgacaagatcggctacatcctgaagtacgggtcttttctttttcatcgtcctgactgtgatcaacgggaaacattttctcagtttatcacggacaaagcgcaaccttccctaacatgagggaaggctgcgcaatttatttaacctggctcagataactatcaaaccggcggcagatcgaacagcaggatctcgctatcgctgtcggcatgaaccgaaatcgcctgctcgtcccagatggccaaaccgtcgctggtggtggctttagtaccgttgatggtcacttcgcctttgaccacctggatccacacgcggcgttccgcggcaatctggtgaaccgactgctcatctttcagcagcgcccagcgatagagttccatatcctggtacaccttcagcgagccatctcgcgcatctggcgacagtaccagctgtttgccctgggcggcgtcgaagcggcgctgctcgtagcgcggggtaatgccggtttcttccggaataatccagatctgatacagacgcagacgatcggttttgctcgggttgtactcagagtggcgcaccccggtacccgcgctcatgatctggaactcgcccgccggcacctgctctttgttgcccatgctgtcctggtgctccaccgccccttccagcacataggtcaggatctccatgtctttgtgcgggtgggtaccgaagccctgaccggcgtcgatgacgtcgtcgttaatcacccgcagggcggagaagcccataaagttcgggtcataatagttggcgaaagagaaagtatgccaggaatccagccagccatggttagcgtggccacgttcgttcgctttgcgtaaatagatcatgttgcacccccgtatgttgtcgatggagtcagtgtggacccatttcgccggcgatcatagagggtgaaaattgactcctctgttcaaaaaatatgaacaagcgcagaggagccaatttgacttatcgggtaagggtaatggtggccggtgaaggctgctcaaagccgcgctgcaggatctccatattggtgagaacgtcagtttccttgacgtaattcggctggccgttgacgagggtgtcgtacagcgcgtcgtacacccgaccataatcgccgctctccagcggcaccgcttcgcgcaccatctcccctgcctcgttgacatacaccagctcgccaacgctgtcgtccgcgccaaatcccggctcgcccggcatgatattggccttcaggctggtctcctgctggtcaatgccgtacttcacaaacgaacctttgtgcccgtgaacgataaatttcgggtaatcgatctgcaccagatggctggtcttaacgatggccttcatatcgccgtagaacagctgggcttcaaaggtgtcatccgggttggctttattgcgcagcgagcgcagatcgtaagagacatggtccgggcggccgaacagcgaaatgatctgatccagggtatgcacgccaaggccatagaactcgccgttttgcggaccgccggggttggtctccgccagtgggcggtagttatcaaaatgactttcgatctccaccagttcgccgagtttcccgctctcaatcacctttttggtggtcaggaagcaggagtcgaaacggcggttctgatagggcgtcaccgtcagacctttgctgttcgccagggcaaacagagtttttgcttcctccagcgtcggggtgaacggcttttccaccagcacgtttttccccgcctccagcgcctttttcgcatattcaaaatggctgtcggcgtgagtgcagaccaccaccagcttgaccagtggatcgtttaatacttcatcaaggtcgctggtgaaatgaatatgggaatactgcggcgcctgctcctcgggcttcgcccggcggcggtaaatgtgcgctacctgccagcggtctttgcggtgcaaaacgtaaggaaggtgatagcgggtggtgcttttaccaaagccaataaatgcgcagtgcagagtcataacgctgtccttagttaatgagctaccttcaaccatagcgcaagccggtccctcacttcatcctctctgttcgcttgcagtgaagattcgttaggaaaatagttcgagtatcactcatacgtaattattaataacttattgattaataagtgattaaatcagcagttttcggcaaaaaaccttgatcgccatggcaaaactgcggataagtggagagcaaaccaggaggttgctgatgactaacggagtagccagccgctgctgatggacaaacagtatctcgccataaacggcgccctttttttctggcttctcgcgctgatcgcctggtctgtcgatgcaagcgcgctggcgcgcctggcggccgcctgcgcgcttatcgctttcctcctccatagccaacggaacaagattaacgcgatgtttattaagaaaaataaaacggaacctcagatatcagaagcagccacgcctccggcaattaacccagaacccgaagcggtcgccagcaaaaaacacgagactacggtcatcgccagcggggtgcatttcgtcggcaatatagtcgccagcggccatgtctatatccacggtcaggtcaccggcaacattgaggccaaagagcatttgattaaggtaatgcgtgaaggccaggtggagggcaacgtcagctgccgggagctaataattgacggcaaggtgcagggccagtgtcatggcgacagcatcaccatcgaggagcacggccatctggagggtaccctcgcctatcgcgcgctggcgatcaagaaaggcggcgtttttagcggtcgcgctgaactgctggccgccgcggagaacaaaagtcatattctcggtctggtagtagacgcaccctccaaaaccgacgcggagcccgtcaggccgcagagcgcctgagatagcagcaaaaaaaaagccagcacccggctggctaaagtaatactggaagcaatgtgagcaatgtcgtgctttcaggctttccgcaagggtctccctgaatgcaggacaataataatcattctcattcgcacttgtctacttttttttgcaaataatgcgtgttgactcgaacgccgtagtcagtgatgtttaaagggacttttcacctgaatgaggaacaaggaatgagtgacatcgtgatacgccatgctgaaccgaaagatattgacgcgattcgtcaaattcacgcccagccggaggtgtatcacaacacgctacaggtccctcatccatccgaacatatgtggcgggagcggctaaccgatacgcccggcgtgaagcaactggtggcctgtatcgatgagcaagtcgtcggccatttaagcattgccgtcgtccaacgtccccgccgtagccacgtcgccgattttggtgtcagcgtggattcgcgctggcacaaccgcggcgtcgccagcgcgctgatgcgtaccatgattgatatgtgcgacaactggctgcgcgtcgagcgtattgagctgacggtgttcgccgataatgccccggcgattgcggtgtataagaagtacggctttgagatcgaaggcaccggcaggcgttacgcgctgcgcaacggtgagtatgtggatgcgtattatatggcgagaatgaagtagcgtgttgccgggtggcggcttcgccttacccggcctgcgttcgtgcagttgtaggcccggtaagcgcagcagcgccaccgggcaacacatcaataccccgccgttaaatcatccggcgaacgcggatcggaggcgccatacagcatgccgtccggtcccaccatgatgctctgggtactgcccatcgcctctttcagcgccactttctgccccttcgcctccagcagcttgagggtatccgggctaaagcctttctccacccgcagctcatccggcagccattgatggtggaaacgcggcgcgttggtggcttccgcgacgttcatcccgaaatcgatggtattgaccaccatctgcagtacggtggtgatgatccgactgccgcccgggctgccggtcaccagccaggttttgccatctttcaccacaatggtcggcgacattgacgacagcgggcgttttttcggctccaccgcattggcgtcgccgcccaccagaccatagacgttaggcacgccgggcttcgccgagaaatcatccatctggttattgagcagaatgccggaattaccggccacaatgccggtaccgaaggtcgtattcagtgtataggtcaccgccaccgcattgccgtctttatcgaccaccgagaagtgggtggtctggttgctttcatagggcgccagcttgcccggacggatctggctggaaggcttcgccttgttgacatcaatctcggcggcgatcgctttggcgtaagccttgctggtcagcgcctgccacggcacgttgacgaagtcagggtcgccgagatattcagagcggtcggcgtaggcgtgtttctctgcctccgccatcacctgcatggcgtcggcgctgccaaaaccatatttctgcatatcgaagttttcgaggatattgaggatctgcacgatatggatcccgccggaggacggcggcggcatagagtaaacctcatacccgcgatactcgccgctaaccggcgtacgctccacggccttatagccggcgagatcggctttggtgattagcccgccgtgctttttcatctcgtcagcgatctggtcggcgatggcccctttatagaaggcgtccgggccgtgctcggcaatcagctccaggctcttaccgaggttcttctgcaccagccgatcgcccttcttcagcggctcgccgttcttccagaagatcgctttactattttcatgctgcgggatcacttcgctgccgtaggtcttcagatcgtccgccagcgcatcgttaacgataaacccctcttccgccagcttaatcgccggacggatcactttgttcaacggcatggtgccatacttttccagcgcgagggagaaaccggcgacgctgcctggcgtgccggaggccagatgcgaagtcagtgattttttactgtccgggttgccctggtcgtcaaggaacatgtcgcgggtggcctgctctggcgccatttcgcggaaatcgatcgccgtggtcttgccgtctttagtccgcagcatcataaaaccgccgccgccaatattcccggcctgcggatgggtgaccgccagcgcgtagcctaccgctaccgccgcatcgacagcgttaccgccctggcgcaggatatccacgccgacgcgggtcgccagcgcgtccaccgaggccaccatcccctgccgggcgcgtaccgggtggaacacatcttcctctacgccataagagaccggcggcggtggcggattggcggcgacggtaaagctgccccccgccagcaacgcagcgatgaccacctgacgccatattgttgtttttatcattgtcttactcctgaaaggtaggtttcattccccgcttaagcctggttgataactcctaaaaaatcattgttatggcagattcgaggtacacttaagtgatcccacgcacgggaggagaaaaccatgaaagcgattctgtttctggcggcgctgatgccgcttggcgtattagcccagccgatcaatattaataacaaccctaaccagccgggttacgtggtccccagccagcagcgcatgcaaaatgagatgaaggtgcagcaacagcagcagcagagcatgctgaagcaggatctgaacaatcagacccgctcgcagcagcagcatttgcaaaaccagctgcagactaatcagcagcgcgcggcccagggcggcaatctgaatgcgccgcagcaggtgcggccaaataacaacggtggaatgctgcggcagactaatccgtaaaggtcgtccgccgcaaatccgtcttaaggctggaaattcggcccgataacatcaatggcatcggtgcagatgcagtctacgccccagcacagcagttcggcggcgcgctggggtttattgaccgtgtacaccagaatgtgcaggccggcctgtttcaggctcgccacccgcgccgcatccagcagtttgtgattgaggtgaatcgacacgcagcccaaccgggtggtcaattcgcgccagtcatcgcgccactcatccagcagcagcccgcgcggcagctcgggcgcggcttcttgcgccgcctccagggcgtcgatttcaaaagaggagagcagcggcgcggtcatgccttgccatagatcgcgcgcggccagcgccaccactttcccggtctgcggccccagcccggtggtcggcttaatttcgatattcgccatcatgccgtggcgacggcagcgctccgccacctgggagagcaacggcagcggctcgcccttaaattcacggctgaaccagctaccggcatcgaccttcagcagatcgtcccacgccagctctcccgccacgccccagccattgctggtgcgttcgagattatcgtcatgcagcagaaagatctgcccgtccttcgacagcttggcgtcaaattcaatcatcgtgtgcccgtagcgggcgccgacgtcgatagccgccagggtgttctccggcgccagtttaccgccgccgcgatgggcgacgatgcggggataaggccagttactcatgcgcgttgtcctgtttcaccatcaaagaggtgcagatgttccaaaggcagatgcagccatagcgtgctgcctgccgccgggcgctgctggtgcggcagtctgaccaccagcttctgttcgccccagcgcccgtgagcgaggttatcggcacctaaaatttccagggtgtccatcagcagcggaataccaccttgcgcctgcgagcttaagataaaatgctccggacggataccgagcgtcattttacgcccagcgtggcgccggtgctcatgattcgtcggcagctgcatgccgcccgccagctcaaagcgaccgccgtcatcgctgatgcgcccttccagcaggttcatggccgggctgccgataaagctcgccacaaagcggctggctggcttctcgtacacttccaccggggtgccgatctgctcggcaacgcctttgttcatcaccatcacccgctgggcgagggtcatcgcctccacctggtcatgggtgacgtacagcgaggtggttttcaggcggcgatgcagctgctgcagttccagacgcatctgcacgcgcagcttggcgtcgaggtttgacaacggttcgtcgaagaggaataccgccgggtcacgcacgatggcgcggcccatcgccacgcgctggcgctggccgccggacagttcccgcgggcggcgcttgagcagaccatccagctcaagaatgcgcgccgcctcctgcacccgctcggcgatcaatcccttacccatgccgcgaatcttcagcccccacgccatgttctcttccacgctcatatgcggataaagggcatagttctggaacaccatcgcgatgccgcgatccttcggctccatctcggtcacccgtttacgatcgatccagatatcgccgctggtcacccgttcaagtcccgcgaccatccgcagcagcgttgatttcccgcagcccgacgggccgaccatgacgataaattccccgtccgccacgtccagcgtcaacggttgaattacctgggttttgccatcccagcttttgcttactgcctgtagttttaaaccagccattttatttctcactatcgaccaggccgcgcacaaacgcgcgctgcatggctaaaacgatgacgaccggcgggatcagggtcagcagcatcgccgccatcacctgattccactgggtagtaccttcgccggtggcgatcatgcctttaataccggcgacggcagtgccaagattcacatcctgaataatcagcaacggccacagatactggttccagccgtagataaaggtgatgacgaacagcgcggcgaggttggttttcgacagcggcagcacgatgtcgcgaaagaagcgcatcggcgaagcgccatcgatacgcgccgcttcaatcagctcgtccggcagggtcataaagaactggcggaacaggaaggtggcggtggccgaagccatcaacggcagcgttaacccggcatagctgtcgagcatgttgaggttggcgatcacctccaccgtcgggaaaatacgcacctcgaccggcagcatcagggtgataaagatcatccagaagaacaggttacgcagcggaaagcggaaccagacgatggcgaacgccgaaagcatcgacaccacgattttgccgaccgtaatggcgaacgccatgatgaaactgttgagcatcatcagccagaacggcgcgctgttgacgccgacgccgttcacccagatggtcttcatgttctccagcagatggccaccggggatcagcgtcatcggcgtttcaaataccgatttgttatccagcgtcgccgccacgaaggcgacgtacagcgggaataaaatgacggcgatacccaggatcagcatggtgtggctgaaaatcgtcagcccgcgacggttctcaatcattggtaacgcaccttactttcaacgtaacggaactgcaccaccgtcaggataatgacgaggaacatcagcaccaccgactgcgcggcggaagcggatagatcgagcccggcgaaaccttcgcgatagattttgtagatcagagtggtggtcgcctgcaccgggccgccagcggtggcggcatcgatcaccgggaaggtgtcgaagaaggcataaaccaggttgaccaccagcaggaagaaactcaccggcgcaatcagcggcagcgccagcttaaagaagcgacgaatcggcccggcgccgtcgatggcggcggcctcaaccagcgaacgcggaatcgactgcagcgcggcgaagaagaacaggaagttgtagcttatctgcttccacaccgaggcgaagaccaccagaaacatcgcctggccgctgttctgcgcatggttccagtcatagcccagctcgccgaggaaatgggtgatcagcccgcgcccggggttaaagaggaagatccacagcaccgccgcgacggcgggggccacggcgtacggcagcagcatcagcgtttgataaaagcggctgccgcgcaccacatagtcgaccagcgcggcgaaaaacagcgaaatgagcaggccgctgacggtcaccagggcgctgaattttatggtggtccagaacgagtccaggtagtacggatcgtggaacagcgcaacgaagttatccaggccgacgaactggctggaaaggccaaagggatcgacgctctgcagcgagtaccacagcgcttcgcctgcgggccagataaagaaaagcagcgtgataatcagctgcggcgcgaccagcacatagggcagccagcgcgagcggaataccggacgggatgatgacattgagattgggttcctgaacaatgccgggtggcggctacgccttacccggcctacatagggcacatcgtaggcccggtaagcgcagcgccaccgggcaagttacagattacgatttggtcgcttgctcgaagcgacgcagcagctggttcccgcgctgcacggcggaatccagcgcctgctgcggggttttcttgccggtccacacgctctccagctcttcatcgacgatggtgcggatttgcggcatgttgcccaggcgcagacctttggtgaacggcaacggcggcttgttcagcatctggcgggtagcgatatcggcgcccgggttcttatcatagaagccctgctgacgcgtcagatcgtaggccgcggtagtgatcggcaggtagccggttttctggtgccactcggcggcgttttccggtttggtcaggaagtcgaggaacttcgccacgccggtgtaggtctctttgtctttgccctgcatcacccacaggctggccccgccgatgatggcgttctgcggcgcgcctttcacgtcggcatcgtaaggcatcatgccgacgccgtagttaaatttggcgtacgggcggatatcggccagcgatccggacgaggcagtggtaatggcgcagtcgccgttatagaacttttcggtagactcgtctttacgcccgaagtagctgaaatcgcccttcttgttcatctcttcgagcagcgcgatatgcttcacctgctccggcttgttgaactcaagaaccgcgtcggtaccgtcgaagccgttattcttcgtggccaccggcagaccgtgccaggcgctgaagttttcaatctggatccagccctgccagccgctggcgtagccgcacttcatcccggcggctttcagcttcgcggtgtaggccgccagatcctgccaggtcttcggcggctgctccggatctaagccggcttttttgaaggcgtctttgttgtagtagagcaccggggtagagctgttaaacggctgggagagcagatggccggttttcgaatcggtgtaatacccggccaccgtcggtacgaactgcgattcatcaaacttgatgcccgcctcgctaaacacctggtagaccggcttaatggcttttgacgccatcatggtggcggtgccgacttcatacacctgcaggatagccggcgcgttgccggtacggaaggcggcgataccggcgctcaggctctgctcgtagttgcctttgtataccggaacgattttgtaatcaggattggccgcgttaaagcgttgcgccagagaatccacttctttacccagctcgccttccattgagtgccagaacgggatggtggtaaccgccagggcctgaccggcaaaagccaggctcagcgccagtcctaaagctgtatgtcgtaacgatatcatcggttatctctcttgttgtgccggatgcgcgatttcacgcgttttatgctcgcggggtaacatgacatgttcgaattacagaaaaataacttttttattacaaaaaaaagatagtaacgggtcagagagatgacaagccgatgaaaggacgggggaagtaaagtgggagctgagacacggataatattcgtgcggtcggctcccggggtcggcgcaagcgcctcgcccgggctacaaaccggcgaagccgccgggttgcaacgagttaaccgtcatccgcgcaagcgcgcgacaatctgttccagggtaagttgccctgctgccgcctcgacggtcatgccgacgaagtctggattcgccggcaatataattccatttcgctttaaaaaaagcagagtgataaacagtgccgtacgcttattaccatcattaaatatatgaccgcgagaaatcgccagcagatgcatcgcagcgagtcgccacacgtctgtcacaccttcatattcaattttgtttagcaccctatacattatcgcttcggcacgccccggatcgggcataccggcaacgccaggcgtgacgcggagcagcctgtcgtgaaactgtattatctcttccgctgagataatctgcagcgtcatttatccgcaagctccctgatctcatcaccatgaaccgccatgatagccgcgaactcatcatccattctggccgtctggtagcgttcaaactcttctgcactaatgatgactgcagatttatgcccacgacgggtaatggtcacaggtacacctgtcactgcgctttccagcacatcggccagattttgccgggcttcgctatagttaaccgttctcataaaaacctccaaagctgtactcttttattgtacaacatacatgtacaaaaaaagagccaacaggctcttttaaatgtattcgtgcgatcggctcccggggtcggcgcaagcgcctcgcccgggctacaaaccggcgaagtgaacgacgccgggttgcgatgaattaaccgccgagataggcgctgcgcaccgcctcgttggccaacagcgcgtcgccggtgtcctccagcaccacgtggccgttctccagcacatagccgcggtcggccagcttcagcgcctggttggcgttctgctcaaccaggaagatcgtcattccctgctcgcgcagctgctcgatggtgtcgaaaatctgctgaatgataatcggcgccagccccagcgacggttcatccagcagcagcaggcgcggttggctcatcagggcgcgaccgatcgccagcatctgctgctcgccgccggacatggtgccggcgcgctgaatacggcgttcatgcagacgcgggaacagctcatacacccatttgatgcgggtctggaactgatcgcggtcggcaaaaaaaccgcccatcgccaggttctcttccaccgtcatacgcgaaaagacgcgccgcccttccggaacgatcgccaccgcctcgcgcatgatcttcgcggtttgccagtcggtaatatccttaccgtcaaagacaatgcgcccgctggaggcgcgcgggtcgccgcacagcgtgccgagcagggtggttttccccgcgccgttggcgccgataagcgtgacgatctcgccctgtttgatatgcaggctgacgttgtgcagcgcctgaatcttgccgtagtgggcgctgacgttgtcaaaagttaacatcgcgttttccatcttatgcctcaccaaggtatgcgcggatcacatccgggttattacgaatctcttccggcgtcccgttggccagcggtgttccctggttcacgacgtagatgcgatcggaaatgcccatcaccagcttcatatcgtgttcgataagcaggatggtggtgttgtgatggttacgcagctcggcgataagctcgtccagctctttggtctctttcgggttcagccccgccgccggttcatcgagcatcagaatttccggctgggtcaccatgcagcgggcaatctccagccgacgctggtcgccgtaggccaggttgctggcctgacggttggcatgctccagcaggccgatgcgctccagccaggtggcggccctgtccagcgcttcgctctgcgcccgacggaaggccggcgttttcagcaggccggagaagagcccggttttcagctgctgatgctgcgccaccagcaggttttcaatcaccgtcatttcgcggaacaggcgcacgtgctggaaggtccgcaccacgcccatccgcgcaatctgctgacccggcagcccttccaggtgctggtcgcgcagcagaatagtgccgccggtgggcttgtaaaaaccggtcaggcagttaaagacggtggtcttcccggcgccgttggggccgatcagcgagacgatctcgcgctctctgagctccagcgacacattgttgacggccagcagaccgccgaaacgcatcatcaggccgctaacggataataatggctgactcatgcctgctctcctttcgcctgaccgtttttcagcttcaactgcacgcgcgtcattggcagaagcccctgcggacgccagatcatcatcagcaccatcaggccgccgagcattaacatgctgtattcgttgaagtcacgcatcaactcgcgcgagaccaccagcagaatagccgcgaggatcaccgcgaactgcgagcccatcccgcccagcacgacgatcgccagcacaaaggctgactcggcgaaggtaaaggattccgggctgacgaagccctggcgcgcggcgaacagcgtgccggcgaagccagcaaacgcggcgctgatggtaaaggcagtcagcttgatgcgcgtcgggctcaggcccagcgaacgacaggcgatctcatcttcacgcagcgcttcccacgcccggcccagcggcattcgcagcaggcggttgatgacgaacaggctgagcactaccagcagcaacgccaccaggtagaggaaaatcacccggtcggagggatcgtatttgacgccgaagaagttgctgaaggtatcccagccgccttcgcgggcgctgcggctaaattcgaggccaaagaaggtcggtttcgggatctggctgataccgttcggcccgccggtgatctcggtattgttgagcagcagaatgcgcacgatctcgccgaagcctaaggtcacaatcgccagatagtcgccgcgcaaacgcaacaccgggaagcccagcaggaaaccggccgccgcggagaccaggccggccagcgggagacaggtccagaagccaagaccgtaatagtggttcagcagcgcaaaggtatacgcgccgatggcatagaacccaccgtagcccagcaccagcaggccggaaaggccgaccaccacgttcaacccgaggccgaggatgatatagatcatcgtcagggtggcgatatccaccgtgccgcgcgacaccataaacggccaggccacggcaatcaccagcagggcgatcaggaacagcttctgcttcaccgtcgacccgtcaatcgccggcataataaacttcggcccggagacgttcttaaccgctttctggaacagcggccgcagcagctggaagaaaaagaccaccgcggtaccgatgaagatccactgccagcgaatatcggcggcggtatcgaccaccagtttggtgccgttcagctccagctgcacgcccataaagacgcccgccagaatgaagaacatcacggcagagagcagcgccattgcaatttgcatcggtttcatactttttccacctccgggcggcccagaatgccggtcggcatcactaacagcaccagaatcagcagcgcgaaggaaacgacgtccttatattcggtgctgagataggcggaagagagcgcctcggcaatacccaggatcaggccgccgatcatcgcgccagggatactgccgatcccgccgagcacggcggcggtgaacgccttcatcccggccataaagccgatgtaggggttaatcacgccgtagaactgccccagcagcacgccggccaccgccgccatcgctgcgccgatgacaaaggtcagggcaatgacgcggtcggtgttaatcccgagcaggctggccattttcagatcttccgcgcaggcgcggcaggcgcgccccatccgcgagtagcgaataaacagcgtcagggccagcatggcgataaaggtcaccacccagatcaccagttgcatggtggtgatcgtcgcggagaagctgtcgctgtggccgacgacccactggccgttaaacaagctcggcagcgccacgtcgcgggagccctgggtcaggctgacgtagttctgcaggaagatagacatcccgatggcggagatcagcgcaatcaggcgcttggagttacgcaccggccgataggccacgcgctcaatgctccagccgtaggtgctggcaatcacaatggcgcccacgaatccggcggcgaccagcagccagctagtgtcaatgcccatcatcatcagcgcggcgatgatcatgaaggagacatagctgccaatcatatagacctcgccgtgggcgaagttgatcatgccgataatgccgtacaccatcgtatagccgatggcgatcaacgcataggtactgcccagcgtgacgccgttaaacatctgctgcagaaaatagagaaactgctcggacataaggtaacctttttcaaaccgcccgcggttcgcaggcggagggataactcgtcttcagcgcttatttcgccgcgctcgaagagccgtcggcgtgccactggaagacaccaaactcaaatcccttcagatcgcctttttcatcccaggtcagcggcccaatcacggttttcgccccgtgcgctttcaaatctttgattaaatccagcggctgctggctgccggttctgtccatcgcctgcgccagcgactgaacggcggcataggtgatccagacgtacggtccgctcggatctttcttctccgctttcagcgcgttgacgatggcgctgttggcagggtcctgatcgtagcgttttggcattgtcaccagcatgccttccgccgcggcgcccgcgatattggacagcgaggcgttgccgaccccttccggccccataaacacggttttcaacccgacggagcgcgcctggcgcagcatctggcccatttccgggtagtagccgccgtagtagacgaagtcgatgttctctttcttcaggcgcgccagcagggcggagaaatctttttcccccgcggtgatgccatcgaagaagacgatgttggccccggctttcttcaggttgtcctgcaccgaacgcgccagcccttcgccgtactgctgcttgtcatgaatgatggcgatacgctgcggtttcactttctcgacgatatatttcgccgcggtcggcccctgcgaggagtcgaggccggcggtacgcatgatgtactggtatccgcgctgggtcagctccggattggtcgccccgggggagatcatcaggatgccttcatcctcatagatgtcggaagccggctgagtggaagaggagcacaggtggccgataacgtactgaataccgtcgttgacgattttgttggccaccgcgaccgcttgcttcggatcgcaggcgtcgtcatattcgacggccaccagcttgtcgcccttaatgccgccgctggcgttgatgtctttaatcgcctgacgcgcgccattgaactccatgtcgccccactgggccaccggacccgacatcgcgccgaccacggcgaccttaatatccttggccatcgccgcgtgcgacatcgctaatgcgacaatgcccgcgacgatggttttcgcgttccttttcatgctgcagaaccccgttcgtgatgtggtgtaaatgttttgtatttttatggttaaaaagcattctgtgcttttattaaacaacgccatttttaccattgagtttaatggtttagcgcagtttttcactaaaaaacagattaaaacctctatttttcagtcgattaagcaaagataatattctgtattttggtgaagataaacaaaaaaaagtccatcctgcagcataaaataacgatacataaggcggaataaaacgctgcacattaggttaaaattctgcttatttttcgatccatgacggattgcgctaccctgacaacgccaggaaaacgaatcccctgatgtacgcgcaaaaaacagcgctccgccagacagcaatattgggtacactggcgcctctgttttgcactggatttgccgcccatgaaactgaccattatccgtttacagcacttcagcgatcaggatcgcattgatttggggaaaatctggccgtcacaggatctgtcgacgctgacccttgatgaaaaccatcgtctctacgccgcccgctttaacgaacgcctgctgggcgccgtgcgcgttaccctgcgcggcgtcgaaggtgagctcagcgatctgtgcgtgcgtgaagtgacccgccgccgcggcgtcgggcaatacttagtggaagagacattgcgtgataacccggcgatcaatagctggcgcgtcgccgaccatggggtggaggaccgcggcgtgatggcggcctttatgcaggcgctcggctttagcgcccagcagaatggttgggaaaagcattaagccgtagccccaataagcggagcatgcccaaggaagaacccggcggcgcttcgcttagccgggctacctggcgactgtagccccggtaagcgcagcgcgaccggggtcagacaacgcatttgcagtgggaaaggcgccccccatttaatccagcatttcgcgttgtaaaaaggcgtcaagacccgaaatccccgggagcttacatcagtaagtgaccggggttgagggccgcagacaacgcatttgcagcgtgaaaggcgccccccatttaacccagcatttcgcgttgcaaaaaggcgtcaagacccgaaatccccgggagcttacatcagtgagtgaccgggattgagggccgcagacaacgcatcggcagcgtgaaaggcgccccccatttaacccagcatttcgcgttgcaaaaaggcgtcaagacccgacatccccgggagcttacatcagtaagtgaccggggttgagggccgcagacaacgcatttgcagcgtgaaaggcgccccccatttaacccagcatttcgcgttgcaaaaaggcgtcaagacccgaaatccccgggagcttacatcagtaagtgaccggggttgagggccgcagacaacgcatttgcagcgtgaaaggcgccggttaaattatttggcgtcggtcgccgtaccgttcgcatgccaggtaaagaccccgaactcgaagcctttcaggtcgcctttctgatcccacgacagcgggcccatcacggtgtctactgtcgcgcctttcaggtatttagcgatttccgccggatcgtcagactgattcaggcctgcctgcagcgactgcagcgccgcgtaggtggtccagacgaaggcgccgctcggatcctgtttcttcgccttgatcgcgtccacgatcggtttgttcgccggcacctggtcgtagttcttcggcttggttaccagcaggccttccgccgactcgccggcgatgttagacagggagacgttcgctacgccttccgggcccataaactgggttttcagaccggcggcgcgcgcctgacgcaggatctggcccatttccgggtgatagccgccgtagtagacgaaatcgatattctctttcttcaggcgcgccaccagggtggagaaatctttctcaccggcggtgatcccgtcgaagaagaccacgtttgccccaccttttttcaggccatcctgcaccgcacgggccaaaccttcgccgtactgctgtttgtcatgtaccactgcgatacgctgcggcttcactttgtcgagaatgtatttcgccgcggttggcccctgatcggagtccagaccggtggtgcgcaggatcagcttatagccgcgcgccgtcagttccggagcagtcgctgccggggtaatcatcagaatgccttcgtcttcatagatatcagacgccggctgagtggaagaggaacacaggtgaccaataacgtatttgatgccgtcgttgaccactttgttggctaccgctaccgcctgtttcgggtcgcaagcgtcatcatatttgacgatctgcagcttattgcccttgatgccgcccttagcgttgatatccgctaccgcctgctctgcgccggtaaactcctggtcgccgtactgggccaccgggccggacatcgccccgactaccgcgattttgatatcttccgccagcgccgcgctgctcataactaaggcaatacatcctgccagtaacgctttacccttcatattcatcctgaggctccccattattatggtttttgcatttgttgtgatgttgtttattagcgcattattttgtttataccgataggaaaagcatatgatagctaatcaaccgggggctgcccgcgcttttgcagcacactatgctaaacataccgtcattctgaggaatttgaaacgactaaattgcgggctatgtaacagataagtgacaaataaaaaaaccgcgccagcatgaaccggacgcggtgcaaaacagagcctgattaccagcctacgggtaggtagcccaccgcggatgctatcgcgtaggcggcgctgcaaagatacaacaacacaatgaagcattggataagcggatgggtcatccaggccggacaggtccagcccggggtcagatcgccacgctggcgggcgcccttgagcatcaggatcggcataatcgataaaatgacgccgctgaacaccccggcaaaatagagcgcgttgacgaaggagaccatgccgctataggccagcacgaacggcgggatcgccaccaccagcagcaccatcaggcgccgggcgggctgttcgtcattccccaggcggaactgatcgaagatattggtcaggaagctgccgcccagtccccagtaggaggtcaacatcgcgcacagcgcaaacagattggctgagaagaaggcccattcgccaagcgcccgaccccaggagatggtggccacatccgagatattgtccagaccgttaagcgagatcaccgacaacggcaccagcgccagcagggtaaaggtcagcgccatgccgaccatgatggctttaggcaatttttccggtttatcggcgaagccccgcgccatctccggcacgatatactgtgccgagaagcagaatgccacgacgttgaagaccggaaccatatacagccagttgccgtcgagcagatagccgacgcgggtggtctctttcaacagcgtggcaatcaccagcaccgagatcatcaccaccatgccgatgctgataaatttctcaccgcggccgatcgccttcagccccaggtagagtacccctgccgccggaacgaaaaacagcacgctgcccagcgccggcgagatgccaaacagggagtgcagcagcttaccgctgccggtcatatacgccgtcaatgccccgacgctattgacgcagacggagagaaacatcatcagcgcgccaaaaccgccgacatagcgcttcgataaaccgctgagctgcagatgtttacgggtgcgcagcgtggattccgcgacatagagcatagtcaccgtcgtcaggctgcccaccagcaccagccagaacagcagcggtaagaagcccgctttgctcgacgcataggcgatagagaggacgcccgcgccaatattggtaccgacaatcatcgataccccttcgacgaagctcagagattttgcagagacagccgtacgttcccggccggtgaggacgggagaaaaggtggagttttcagacataatactttccgttttactccggcggttttcaccgccggaaaaaaggtgatatcagggtgataaaccactcacgctgagcataaacagccggctgcggcgtcctgtttctgttcggcttccctgccgccgcagcccgccggggagacgttagctcttcagtacgcgcgccagaatatccagcgctttcgagaactgggcgtcggggatagtcaacggatacaggaagcggatcacgttgccgtagacgccacagctcagcagcagcaggccgttctcctgcgctttctgttgcacctggcgggtgaactccggcgacggctcgccagtttgcggatcgttaaactccactgccaccatcgacccccggccgcggacatcaacgatcgccgggcaggtagcgcgcgcctggttgagcacttcctgcagatggctacccagctgttcagcgcgctggcacagctgctcttcggcaatgacatccagcaccgcgtgcgccgcggccaccgccagcgggttaccggcataggttccgcccagcccgcctggggctggcgcatccatcgcctcggcgcgaccgacaacgcccgacagcgggaaaccgccggcgaggcttttcgccatcgtcatcagatccggtttcacctcatagtgctgcatagcgaacagcttgccggtgcgggcgaaaccggtctgcacttcatcggcgatcagcagaatgccgtgggtatcgcacaggtcgcgcagcgcctgcataaaatcggccggcgcgacgttaaagccgccttccccctggatcggctcgagaatgatggccgctacctggtccggcgcaatatccgctttgaaaatgcgctccagacttttcagcgcatccgcggtggtcacgccatgcgccgcattggggtaaacgccgtgatacaccgagcccgggaatggcccgaagccgattttgtagggcgcgaccttaccggtgagggccatggtcataaaggtacggccgtggaaaccgccgccgaaggtaatcagccccggacgaccggtgtaagcgcgggcgattttcaccgcgttctcgaccgcttccgcgccggtggtgaagaaagccgtttttgccggcccgtcaattggcgccagatcgttgatacgctccgccagcgaaacatagctttcgtacggcacaatctgataggcggtgtgggtgaacgcctgcagctggtcggcaaccgcggcgaccactttcggatggcggtgaccggtatttaacacggcgatcccggcggcgaaatcgatcacctcattgccttcgatatcccacagcgtggcgttttccgccttctcgacaaagtagttacacattacgcctacgccgcgcggcgtcgcctgctggcgacgttgattcagttctgagcttttcacctgcgaatctcctgtcgtgtatgtcacgttatcgcaacaaattagaaacgatgtcgtttatttacacaggagttggccctataatcgagtaccaattttgaatatctgagggatccaattgcgttcgctggtgggtgacctggtgctggtccgtctgcaggaagagcgggatcctcttctgcacaaacgcttatataacgcgctgcgccgcgcgatcctcgacggttcgctggcgcctcaaagccgtctgccgccgtcgcgggacctggcgggcgaacttggcgtatcaagaaacaccatattaacaacttatgaacaattgctggcggaaggatatgtggtttcccgtcggggaagcggaacattcgttgcccaaaccgcccctgagagctcattgacggctaaaggtcagcaagaaaacagcagtatcgcagcaccgacggcgcatatttcacgccgaggccagcatctgctcggccaggtcagcgccagcccgcgccagtggggagcgtttatacccggcgtgccggacgttaacgcctttccccacccgctgttcagtaagatccaggcccgcatcagccgtcggcccaaaccggagcggctcagctatagctgcaacggcggcactccggaactgcagcaggcgctggtggattatctgcgcgtgtcgcgcggcgtccactgtcagtcagatcaaattcttatcaccgaggggatccaccaggcgatcgatctggtcacccgcatgctgtgtgataacggcgatctggcgtgggtggaggagccttcctactgggggatccgccacgtgctggcgatgaacgacgttcgggcagagcccctgaccgtcgatgccaacggcctgtgcccgccggagacggttgacgatgcgccgaggctgatcttcgttacgccttcccaccagtatcctctgggcgcggtgatgagccttgagcgccgccagcgcctgctggcactcgcccgtcagcaggggagctggatcgtcgaagatgattatgacagcgagtttcgcttttccggtcagccgatccccgccctgcagggtctggtcgccgacgccccggtggtctatatcggcaccttcagcaagacactctatcccggcctgcgcctgggctacgtggtgatcccgcggccgctggtcagcgacctgaagcacgcccatgccgagctttaccgcggcggccattcgctgatccagatggcgctggcggagtttattaccgccggccactattcggcccatatccgccgtatgcggctgctctacagccgtcgccgcgcctttttaactgagcttatccagcggcactgtatgccgtacgccctgtctgacttcagcgataaggccgggctgcatttgatcctcaatttgcccgcagaggctgacgatgtggcgatcgccagagaggccaatgcgcggcacattctggtgcggccgctgtcgcgctactacctgacggcggcgcgcaagaaaggattactgatgggattcgccagccagcccgaagagcagatggcgtcggcgttcagcgtcttactcggctgcctgcagacgcactgcccgcagatgctcctgcccccgggggacgcagaaaaacaaaacgccccaacctgaggcggggcgttatcgtggagcctgatatcaggtatcaggcaggcgtggcgtatcaggcttcgatagcggcgcgcagttttttcatggcgttcttttccagctgacgcacgcgctctgcggagacgccgtagcggtcggccagttcctgcagcgtggacttgttatcttcgtccagccagcgggcgcggatgatgtcctggctacgctcgtccaggccctgcatcgcgtcagtcagcttattcgccgcctgctcttcccagttatcgtcttcgatgccgtcggcaaagttagacgttttgtcctgcagatacaggaccggcgccatcggctggctgtcggactcatcgtcggacgacatgtcgaaggtcatgtcctgggccgccatacgggattccatctcgcggacgtctttgctcgacacgcccagctcacgggccaccatttccacttcatcctgattgaaccaacccaaacgctgtttggttttacgcaggttaaagaacagcttacgctgtgctttggtggtagcgaccttcacaatacgccagttgcgcagcacgtattcgtgaatttcggctttaatccagtgcacggcgaaggagaccaggcgcacacccacttccgggttgaagcgacgcacggctttcatcaggccgatattgccttcctggatcagatccgcctgcggcaggccatagcccgagtagttacgagcaatgtgaacaacaaagcgcaggtgagacagaatcagctttttcgctgcttccagatcgccctggtaatgcagcttttcagcaagctcccgctcttcatcagccgacagcatcggccaagtgttagcggcccggatgtacgattccaggttaccaacgggggctaaagctaaagtttgcatttctttggtcattcaaatcctctcaattgatatcttctgacgcgttcttgtccccatcaggcaacaagcatgccagcattcatgagcaacgagaatatcactcacattagtatcagacagtgattttatccacaagttccatgcaacggtgtgaataaattacgcacaaaatgtgacaccacgatgaaaaagtgagggcaggaaaaggggaacaagcttgcggtatctttccctgcgaacaggaactcattgcagcagggaaagattatatcacgcttttattaatcgggagtaaagtgacgtaaatgttgcactgtcgccagccaggcggctacccacccgatcatcgagcagacgatcaacatcaacagacactcgtcgaagcctaagccgctcagctcaaactgggtgccgaagactttcgccacttcggtcaccgccgacgagaggcgcattaccagaatctccgacaggatcagcgataaaaacgcgccggaaaagcccagcatcgctccgccgtagaggaacggacgcaggataaagccgtcggtggcgccgataagcttctgaacgttaatggtatcgcggcgggcgaagatgctcaggcgcacgctgttgccgatcaccaggaacaccgccgccaccatcagcacgccgatcatcgccgacacgcgtcctaccagcccggtgagcgaggagagacgggcaaaccaactgtcgtccatccgcacttcatcgacgccctggatccgcgttacccgatcgcgcagggtattcagcgcctcggtgctctggaaatccagcttcggcaccacgatggcgaccgccggcagcgggttctcctccagcatatccagggcgccgccaaagccagaccagttacggaattcccccagcgcctcgtcacgggacaaatagtttaccttgtcgacgccctgctccgcctgcagctggcccaccacccgcgccgcggcatcgtcatccagcgttttttccagataaacggtgatctgcggcgagggataatactgggacgccgcgctgctgacgtttttgtagaccatgtagcagacgcttggcagggtcaacgaaatggcgatgaccattaccgtcaggaaggtcgccagcggcgtgctttttagatcctgcagcgcgccgtgccaggcatagcgcacctgctcgttgaatacgttgctcttacgcgaggccgggttaggcgccgctttcggccgttttggcgcattgcgcccgccgccgccgccgcccgcggcgttgcgcaggcgatcgaacttgctgccgaactggcgaatctggttcattgcgtcgcgcttattcaccccgaatgcctccatgcagatggccgtcgctaagcgtcagcacgcggtacggacgactggagataagccccagatcgtgcgtggccatcagtaccgtcaccccgacgcggttaaactcttcaaacagacgtaaaatcccctccgagagcgcctcgtcgaggttgccggtcggttcatccgccagcagcaccgccggcttgttgaccaccgcgcgagcgattcccacgcgctgctgttcaccgccggagagctgaatgggaaaattcttcgctttgtccagcaggccaaccttgtccagcgccgccgagacgcgacgacgaatatcatcgccgctggcgccggcgataatcagcgggatcgccacgttgtcatacacggtacgatccatcagcaaatggtggtcctggaaaatcataccgatctggcggcgcaggaacggcacctcacggctcttcagacggctgatttcatgaccgctgaagaagattttcccggcgctgggccgttcgataccacagataagcttcagcagggtactcttccctgcgccggaatggccggtcagaaacgccatctcgcccggctgcaggtggaaggtcaccccctgcagcgcttgtctcccaccgagataggctttgctgacttgttcaaagcgaatcattcttaatcctctcgggcaaaaagtgcctcaataaagtcgcccgcattaaacggacgcagatcctcaatacgctcgccgacgccaatatagcgaatcggaatgccgaactgatcggccaccgagaagatcacgccgcctttggcggtgccgtccagcttggtcagagtgatcccggtcaatcctaccgcctcatgaaacagtttggcctggctaatagcattctgcccggtgctggcgtcaatggttaacatcacctcgtgcggcgcgtcgacgtccagctttttcattacccggacaatcttcttcagctcttccatcaggtgcgatttattttgcaaacgcccggcggtatcggcaatcagtacgtcaacatggcgcgccttcgccgcctgaatggcgtcgaaaatcaccgaggcggagtcggcgccggtgtgctgggctatcaccgggatattattacgctggccccagacctgcagctgttccaccgccgccgcacggaaggtatcccccgccgccagcatcaccgacttaccctgctgttcaaactgacgcgccagcttgccgatggtagtggttttccccaccccgttcacgccgaccatcagaataacaaatggcgttttgccttcaacgttcagcggctcgtctactttggcgagaatctcgcccatctcttctttcagcaggccgtacagcgcttccgcatcgcgcagctgcttacggctggcgccttccgtcaggttggtaatgatcttgcgggtggtttccaccccgacgtcggcgatcagcagctgttcttccagctcttcaaacagatcatcgtcgatcttcttaccgcggaacaggctgataaatccggaaccgagattttgcttcgttttcagcaggctacgtttgaggcgggcgaagaaaccttcttttgtcggtttttcctgctcctgagccagcgcttcaagcggcgcctcgtcctcgggcgccggcaccactaccgccgcctcttctgccgcttcggccgccagcgcctgcgcttccagctcttcatcgcttaacggcgcgtcctcttcgggcgcttctgtctcctgcggctggacaacgatgccttccacaggctgctctgctacggcttccgccaccaccggttcggcgataacctcttccgccagcggctcaaccaccgcaggctgttcaggcggttcgctgaccgcgggctccggttcaacaacaggcgtttcttcggtcagagcaggcgtttccacccactcttcttcctgcgcgctggcaggctccgcgaggtgcgctttttcgctttcgaccaccgtctcggtcacttcgacgacgtcttcggcaaacgcctccgggtctgctttcggcgcgctcggctcagcaggggtttcaaccgccggtatctcttcggcaaccgcttgctgttcttctactttttgctctgtctcggtttcctgtgcctgttctttctgtccaaagcccagccaggaaaagaagccacgttttttctcttttgccatttgcgaccacactcctcgctgtttattcatggcgcagcttcatcagaagctgaaaaaatgatgaaattagttggatagtctatcacttaacttaactcgcagcaccgcccccggattaaggtttcgtcaaccgccgtcgatcgctagaatagcaggctggaagttgagacttgagcagagagatgaaaaaaccaaaccacgcgggcagcggtcagatccgcatcatcggcgggcaatggcgcggccgtaaattaccggtgccggagagcccgggcctgcggccgaccaccgaccgggttcgcgaaaccctttttaactggctggcgccgtccattgttgacgcgcactgcctcgattgctttgccggcagcggcgcgctggggctggaagcgctgtcccgctatgcggccagcaccacgctgctggagatggagcgcggcgtagcccagcagctgcaaaaaaatctcgccaccctgaaagcggatcgcggcaaggtgatcaccaccaacaccctcagcttcctgagccagccggggaccccgcaccagatcgtgttcgtcgacccgccgttccgtcaggggctgctggaggagacgctacgtctgctggagacacaaggctggctggccgatgaggccctggtgtacgtcgaaagcgaagtcgaaaacggcttaccgccggtgccggctaactggcaattgtatcgtgaaaaagtggccggacaggtcgcctaccgtctttaccaacgtgaggcccaaggagagcaccatgctgattaatttaggccgcctgctgatgctgtgcgtctgggcctttctgttattgaatctgtttcagcccttcccgaagccgctgaatatctttgtcaacgtcgcgctgattttcatgatcctgatgcacggtctgcagctgacgctgctcaaggcgacgcagccgaaagaggcgccgccgctgagccgctttgagcaaatccgcatttttattttcggcgtgtttgagctcgtcgcctggcagaaaaaactgaaggcgacgctgaaaaaatagtcctgaaaagggctcagggatcgggcgtaaacgccacgaacgctgtgcccttataactcaacattccacgatcgccgacgctcagcgcgtgatattgcggcgcgtcaaggcgaaacaccacctccagaccaccgttttcggggcgaaagctcgcttcatagcgcatctcactgcctgcaggcgtcaccgtctgctgccgcgatcgccgatcgttaatcactttttcccgtttattgctgacgataacccgcttttgtagcaacggcgcggcgtcattcgcctgtttctcacggcgctgctggacatagcgaaacgaagccgccaccacaatcaccgcgacgaccagaacaaaaaagaggggcattttactcatcaaggttacccataaaaaatatcaggaatcagcatactgcgtcgggaataacattgtcatctgctacaccaaaccactacactgagtagtagcatcacgcatccgtaactttctttatgataacagatacagggacttactatgctttggtcatttattgctgtctgtttctccgcatggctttatgtcgatgcatcctatcgtgggccggcatggcgacgctgggtttttaaacctgtcaccctgattctgttgctgttactggcctggcaggcgccgatgttcaatgccatcagctatctggtgctggccggcctgtgcgcctcgctgctcggcgacgccctgaccctgctgccgcgccagcgggtgatgtacgcggtgggcgctttcttcctgtcacatctgctgtataccatctggttcgccagccagctgacgctgtcgttcttctggccgctgccgctggtgctgctggtattcggcgccctgctaatggcggtgatctggagtcggctggaagagatgaaaatgccggtgctgacctttatcggaatgacgctggtaatggtctggctggccggcgagctgtggtttgcccgccccaccaacaccgcgctgtccggtttcgccggcgcagccctgctgctgctgagcaatgccgtgtggctggtgagccactatcgtcgccgcttccgcgccgataacgccatcgccgccgcgttctactttgccggccacttcctgatcgtgcgcgcgctgtacctgtaatttagtccttgactctggagtcgactccagagtgtatcctacggctaatgagaaaattatcatttcccggagggtgccatgtcgactccagacacgcaggataaaaaagtcccacaattctcgtctttcaccatgcggccagcgaccgccccggcggagagctgctgtacagatcacgcctgcgccacagagtccgcccctgccgccgaagcgcttagcgacgcccgctatagctggcaagttgatggcatggactgcgccgcctgcgcccgcaaggtggaaaccgcggtccgtcaggtgcccggggtcagtcaggtccaggtgctgttcgccacagaaaagctgctggttaacgccgagggcgatgtccgcgctcaggttgagaacgcggtccgccaggcggggtatacgctgcgcgatgccgatgctcccgcagctaagcaaacccgagggtcgctgctgcgcgacaatctgccgttactgacgctggttatcatgatggccttgagctgggggctggagcaggccaaccaccctgccggtcagttggcctttattgccaccaccctggttggcctgtggccggttgctcgccaggcgctgcgcctgatcaagagcgggagctggttcgccattgaaacgctgatgagcgtcgccgccatcggggcgctgtttatcggcgccactgcggaagcggcgatggtcctgctgctgttcctgatcggcgagcgtctcgaaggctgggccgccagccgcgcacggcagggggtgagcgcgctgatggcgctgaagcccgacaccgccatccgtctgcgcaacggcgtgcgggaaaccgtcgcccagcgcgacctgcgtcccggagatgtgattgaagtggctgccggcgggcgtctgccggcggatggccagctgctgtcgccgtttgccagctttgatgaaagcgctctgaccggcgagtcggtgccggtggagcgtcaggccggggaacgggtagcggcgggcgccaccagcgtcgaccgcctggtgcagcttaccgtgatatccgaaccgggcgacagcgccatcgaccgcatcctgaagctgattgaagaggctgaggagcgtcgggcgccgatcgagcgcttcatcgaccgcttcagccggatctacaccccggccattatggtggtggccttgttggtcgccattgtcccgccgctgttcttcgccagcgcctggctgccgtggatttataaaggactgacgctgctgctgatcggctgtccatgcgcgctggtcatctccacgccggcggccatcacctccggcctggcggtcgccgcccgccgcggggcgctaatcaaaggcggcgcggcgctggaacagctgggccaggtgcgccaggtggcgttcgataaaaccggcaccctgaccgtcggccagccgcaggtgacttcggttattgccacggccgaagttgacgacaacgcgctgctggcgctggcggcggcggtggagcaaggctccagccacccgctggcgcaggctatcgtccgtgaagcgcagcggcgtcagctgagcattccgcttgccagcggccagcgggcgctggcgggctctggtatcgaagccgaagtcaacggcagccgcatcctgatctgcgcagccagcaaagccgccccggcagagcatgaggcgcagatccagcagctggaaagcgccgggcaaacggtagtgctggtgatgcgcggcgagacgctgctcggcattctggcgctgcgcgataccctgcgcgacgacgcgcgtcaggcggtggatgctttgcatcagttgggcgttcagggggtgatccttaccggggataacccgcgcgccgcggcggccatcgccagcgaactggggctggaattccgcgccggtctgctaccggcagacaaggtcaacgcggtgatagcgctgaatgccgacgcgccgctggcgatggtcggggacggtatcaacgacgcgccggcgatgaaagcggccaccatcggcatcgccatgggcagcggaaccgacgtggcgctggagacggccgacgccgcgctgacccataaccgtctgaccggcctggcgcagatgatttccctggcgcgcgccacccacgccaatatccgccagaacatcgcgattgccttagggctgaaggggattttcctcgtcaccaccctgctcggcctgaccggtctgtggctggcggtgctggcggataccggcgccaccgtgctggtaacggctaacgcgctgcggttattgcgtaagaagttgtagcatcgataccggcttccctgctcgcgctacgcttagcagggctacggttccagaccgtcgggtagcccggataaggcgctacgcgccgccatccgggagaggctcagggacgtaggccaggtcaggcgcagccgccaccggggaaaatatcggacactgtgcctgaaatagcgcccggcggcgctgcgcttgcgcgggcctacgggtggagcggtttgttgctgctgtaagccgggtcaggcgtagccgccacccggcaaaagacaacataacggcataaaggggtagcccggataaggcgctacgcgccgccatccgggagaggctcagtggcttttgcggatcaggtagcggtacggcagggcttcggtttcctgggccaccagctcatgctccataaagcggcagaatcccgggatatcgcgggtggtggccggatcgtcagcaataatcagcagcgtctcgcccaccggcatcgtccgcacggttttacgcaccatcatgaccggctccgggcagcggagtcccagggcatccagggtgtggtcaggagtggagaaaagttcgctcattttagtctcacgtcaacaaaacggccctagtttaccccctgctcgccagtacgcaagacaggttaacgtttgcgcgaaaaacaaccattgcattacgccggcaacgcagtatcatgcagccgtttttaattgggttccctcaccccaacgttccgctgccgattgctcattcacctgaagcatgacgggcataaaaaggtcacaatatgaatccgtttactaccgtacagcgcaaaaaagcgctcgtctggctttcgctatttcatttgctggtcatcacctccagcaactatctggttcagctgccgatctccatctttggtttccataccacctggggcgcgtttagttttccgtttattttcctcgccaccgacctgacggtgcgaatttttggcgccccgctggcgcgacgcatcattttcgcggtgatggtcccggcgctggccatctcttacggcatctccgcgctgttctacatgggcgaatggcagggctttgccgcgctgggcacctttaatctcttcgtcgcgcgcatcgccgtcgccagctttatggcctatgcgctggggcagatcctcgacgttcacgtctttaaccgcctgcggcagagccgccgctggtggttggcccctaccgcctcgacgctgttcggcaacatcagcgataccgtggcgtttttctttatcgctttctggcgcagcccggacccgtttatggccgcccactggggggaaatcgccctcgtcgactacagctttaaagtgcttatcagcatcattttcttcctgccgatgtacggcgtgctgttaaatatgctgttgaaaagactggcggataaatctgatttgtcggcattacagccgagttaaaggtactcgcgggctgatgtgttaagatagccggatgagccattagtggccgtttatcgaaaggaagatgtcaatgcgcaatttggttaaatatgtcggtattggcctgctggtgatggggcttgccgcctgcgataacagcgattcaaaagcgccaaccgttggcgcagcagcggagagcaatgccagcggccaggcaatcagcctgctggatggcaagctgagcttcaccctgcctgcgggcatggccgaccagagcggcaaactgggtacccaggcgaacaatatgcacgtctactctgacgctaccggccagaaagcggtcatcgtcatcgtcggcgacagcaccaatgaagatctggcggtgctggcgaaacgcctggaagatcagcagcgcagccgcgacccgcagctgcaggtggtgagcaataaaccgctggagattaaaggccataccctgcagcagctggacagcatcatctccgccaaggggcagaccgcctggtcttccgtgatcctcggcaaagtggatgacaagctgctgaccctgcaggtcaccctgccggcggataaccagcagcaggcgcagaccgaagcggaaagcatcatcaacaccctcaccatccagtaattactggcctggtgcgctggcctccggttcgctaaccgggggccgtttttttagccgccagcccaacagcagcgccgccatcaccagccccgccgcggcgagataaatcatcgagatcccggtccacgccatcagcaatccggccagcggcccgctgacgcccaacgacaaatccataaacacggtataggtcgccagcgccgacccctgattgtgctgcggcaccgctttcaccgccaccacgcccagcgccggaaagaccagcgaaaagccagccccggtaaggaaagtaccgattttcgccatcatcggcgtatcggcaaagccgaccagcagcaggccgatcgcctccacgctaaagcagagcatcgccacgttcagcccgccgagtcggttaatggcgttgggaaacagcagccgcgcgccaacgaatgcgcagctgaataatgtcagcgcgaaagccgcgccgtcccaacctttggcgtcataaaatagcgtgataaaggtggcgatcaccccaaagccggcggaggccaacgccagcgccatgccgtagggccagacccggccgagcaccgcgcgaaacgacatcgctttgcctttggcagccttcaccgccgcgcggggcagcgcgcagaggatagccaccagcgctaccgccataatgaccccggccagaccgctgagtccaatgtgcgaatagcacagcacgccgagcggcgcgcccatcgccatcgccccataggtcacaatcccgttccacgagatcacccgcccgatatgcagcgaaccgaccacgccgacgccccacagcgtcgagcctgtgccggcgaagctctggccgataccaaggatcacccgtccgaggcatagcagcagcaggctaatcagtggccagccgctgccccaggcggccagcagatagctcaaaccgctcaaaaagcagccgccgaggccgaagacgacaatctttttgggccccagcaggtcggcatagcgcccggcatgcgggcggctgagcagcgtggcgaaatattgcaggctaatcaccagcccggcccagaaagcgctaaagcccatgacatcatgaacatagccgggcagcaccgccagcggcaggccgatggtgaggtagctggcaaagttaaagataacgacagagacaatccgcagattgaggcgcagtccattaagcgccggttcggcgacgggttcgggcatcaggttccaccagatttcgacaaccagctttcactattaccacgctgtcggcggaaaagcagccctcctttcggaatattggcagtcggcgaaccgctacacttatctggcgcgactcataaaaggaatacctatgtcccctccgcaggctgataaagccgggcttcatattttacttaagctggcggcgctggtgattatcctcgccgggatccacgccgccgccgatatcctggtgcagctgctgctggcgctgtttttcgctattgttctcaacccgctggtcacctggttcattcgccgcggggtgcggcgtccgttcgccattaccctggtggtgacggcgatgctggtgatgctcaccgcgctgctcggcgtgctggcggcgtcgctcaatgactttgtcgccatgctgcccgatttcaaccgcgccctgacgcgcaagatcctccagctccaggagtatctccccttccttaatctgcatatcaatccggagcggatgctgcggcgcatggattcagaacggctgatgacctgggccacgacgctgatgacccagctttccggggcgatggccagcatcgtgctgctggtgatgacggtgatctttatgctgtttgaggttcgccacctgccctacaaactgcgttttgccctcaataacccgcgcctgcatatcgccggattgcaccgggcgctgaaaggcgtcacccattatctggcgctgaagacgctgattagcctgtggaccgggctgattgtctggctggggctgctggcgatgggggtacagttcgccctgatgtggggggtgctggcgtttttgctgaactatgtgccgaacattggctccgccatctccgctatcccccccatgctgcaggcgctgctgttcagcggcatctatgagtgcctgttggtaggggcgctgtttctggtggtgcatatggtgctgggcaacatggtggagccgcgcatgatgggccaccggctggggatgtcgaccctggtggtgttcctgtcgttgttggtctggggctggctgctggggccggtgggaatgctgctctcggtgccgttaaccagcgtctgtaaaatctggatggaaaccaccgtcgggggcagcaagctggcgatcctgctcggcccgggccgtcccaaaagccggctccccggctagcggcgtttcaccggccagaagatggtcaatacgccggcgacgatgatcgccacgcccagcagcgattgccagtagaacggctcatgccagccgggcagccagatggcggcggcccacacgaggatatagctcaggctcagtagcgcatacgctttcgacagcggcaggcgatggagggcaaagtaccagcagaccatcgacagcaggtagcccagcaggccgaaaaacaggccgaaagtcccgggctggaaatgcagcagatgctggagaaatgccacaatatcggtcagcggcggcaaggccaccatggcgctgcgcagcagcaactgcgcggcgctgacgaggccgacgctgagtaatgcccagaaaaagcccatcagacgctggtccccagaatgacaatgcccacgacgatcaacccgacgccaagccagtggcgacgggcgaccggctcatgccagatgccccagcccgcgagggtaacccagacgaaattcagactcagcatcggataggcgatgctgaccggaatagactgcaggacgctcagccacagcagcatgccgcagcccagacataacagcgccatccccaaccagaagagtatatggcgactccgccgtccgcgacgggacgggcgggtcgcctgtttctggcagagctgtccggcgcagctcagcaggctggcgcacaccagacagatccagacgctcattgcggcaggtactgaaggaaaacgacccggcccagctcgtaggcgttatccggtttcggtaacggtaagtcgagcatactctctcctttatccatcaacagcaccagcgagaccggcccctgctgacgatgcgcggccagccagtcggcaaaaccggcctggctgacaaagcttccctgagcatccggccagtcgagaccgtacttcagctcaccctgtttgtcgaacataataatatcgcttcgcttcagctcccaggccaggccgccggcgatcccaacgttgttggtcaggacgtaacggctgggctgcagggattcgctgacgatctccacaaggaactgcggctgtttgctgtcgataacccggtccgggatggcgaagcccaccagcagcgccaggccgagcggacagagcgcggcgaggctccagcggcggccagagtctttcatcgccagccagcccatcagcgcccagacggcaaaagcgatcgccgccagcagacatttatacagctcaatcttggtccacaccggcttatgcatgaagccccacggcgagaccaccagcacggcgataagccccagcaaaccaacgcccaggttgatcatcccgttgatgcgcaacgctttcgcgccggtctttgcggcctccagcgcgtagcgggccatcaggatcgacagcggcgcaaagcacggcagaatataggtcggcagtttgcctttggcgatactgaagaacaggaacggcatcgccacccaacctaacagatacagcgcgccgcgggcctcatcgcgctcaagccagccgcgctttagcgcccccggcagcagggccagccacggcagactgccgacgatcaggaacgggatgtagtaccagaacggcgctttgtgctgggcgtctttttcagcaaaacgctgaatatgctcgacccagaagaagtagcgccagaagtccggctcgcgctgggcgatagccagcccccagggcagcaccaccagcgtacagacaatcaccgccagccagccgtaggtcagcacttcacgccagcgtttacgggcgatcacccacggcagaacgcccaccaccggcaccgccagcgccaggaagcctttggtcatcacccccatcccgcaggcgacgcccagcagcacgtagcccagtattttgccgctgcggccctgcgcctgcgccgcgtcccagaagctgcacatcgccagcgccagccacagggtgatcatcgggtccagcaccgcataggtgccaatcgcatacaccagcatcgcggtgaggaagataaccggcgacaggatagctacccgcttatcacgaaagatccgccacgccagccaggccaccagcagggcggtcatggtgatggcgaagaccgacccgaagcgtacgccgaagttattatggccaaacagccactgaccgatactgttgatccagtaaccggcaatcggtttttcgaagtagcgcaggccgagaaaatgcggtaccacccagtcgccggtggccagcatttcacggctgatctccgcgtagcgggtttcgtcgggttgccagagcaaacggaaattgagcggcagcagataatacagcgcaaacagcgcaatcagagagacgccatagcgaatgcttttcatcaaatacccgaagtcagtaattgttcacgtccgagccagccttcccggccagccagttcaccacgaaccactttgcctgagggcagctcgctaaagtcagcgggcagcagctggctcagtgggcaaaactgaatttcttcttccgccgccatggtcagtagttcattgaactgatcggcgtaggcaatgccttccacttcagcgtgaatggtatagaccggaacgcccgcatcgcgatggatgcaatccagcaggtagcggttaaagccggcgatatccaccgccgtgcccaccgcctcgtcccaggtcggcaacgtgaccgggatctgcacggtaccagagacgccgctgccgagctggggcagaaacggccgcgtgccgcgacagtcgctgttgtagagaaaatcgaaggattctttggctttaaccacccgctgatcggcgcgccagccggcgacggccgagcaggtcaccggccggccgatgatgcgctcgagctccagcaggccgcgctcaacctccagcgccagcctttcctgcggccagacgccgctccacgcctgccagctgtagtggtcccaggcgtgcaggccgacttcatgagattcggcggcggcgcggatcaccgcttcgttccctgcgccgatgcggcgccccggccaggcggtgccggccagcagaatatcccagccgtacagcgaggcggctctggaacgcagcatcttccacagaaacttcggttttaccaggcgccacaggtggcgccccatattgtccggcccgacgctgaagaagaagcttgcctggatcccatgccggcccagcagctccagcagccgcggaacgccgtcccgcgtgccgcgaaaggtatcgacatctatgcgtaagccgacctgtttcatggatttttatcgtccaccagttcaaccgtgcgcagaaagaagtccagcgtgtgttcgaccgtttcttccatctccaccttcggctcccagttcaggcagcgtttggcgttgcggatgctcggcttacgatgctcaacgtcctggtagccctttccgtagtaatcgctgctttccacttcacggaagccggcgaacggcgggaagcgatcgcgcagcggatgacgttcgaagcaggcgagcagcatttcggccagctctttgatactcgcttcgttatccgggttaccgatgttaatgatctgcccgtcgcagcggccgtctttgttctcgatgatgcggaacagcgcttcgataccgtcgctgatgtcggtgaagcagcgcttctgcttgccgccttcgataagcttgatcggcgacccttccaccaggttgaggatcagctgagtgatggcgcgggagctgccgatacgcgcggcgttgaggttatccagccgcggccccatccagttgaacggacggaacagggtgaacttcaggccattcttatcgccataggcccagatcacacgatccagcagctgcttggagaccgagtagatccagcgctgtttgttgatcggccccaccaccaggttggagctatcttcgtcgaaatttttgtcggtgcacatgccgtacacttccgaggtcgacgggaagataatgcgcttattgtatttcacgcagtcgcggatgattttcaggttctcttcgaaatccagctcgaacacgcgcagcgggttgcgggtgtattcgataggcgtggcgatggccaccagcggcagcaccacgtcgcatttcttaatgtgatactcgatccactcagagtgaatgctgatatcgccttccacaaagtggaaacgcggacagtcgagaaaacggctgatggcgtcggagccgatatccagaccgtaaatctcatagttgtcgtcctgcagcaggcgctcggtcaggtggttaccgataaagccgttgacgccgaggatcagcacccgggtgcgacgcttaatcgccaccaccggtttgctgctgatcaccgccccggacaccaggcccagcgcctgcgccagctgagcgccctgcatgtacacgccgcgttcggtctggccggtgacaatctccagcgccccgtcctggcacgcgaggatcagcggcgcaatggagagcacggtgcccggtttagctgctggcaaatcgtggcgaacgcgggatttccagacgataaacttgttcgctccggcgtagccgaaggcgcccggccacggatccgagaccgcacgcaccagattgtgcagggtctgcgccggcagctcccagtccagccggccatcttccggggtacgacgccccacataggttgcctggctgtgatcctgcggacgctcatcggtggtgccggcgaggatcgccggcagcgcccggctcagcagctcagtggcggcggcgcacagcttacgatgcagcgtcagggcggcgtcatccgcgccaatcgccacggcctgctgggcgacgatatcgccagcgtctgcgcggttcaccatccggtgcagggtgacgccggtttcgctttcgccattgaccaacacccagttcagcggcgcgcggccgcgatattttggcagcagcgaaccgtgcaggttgaacgcccctttcggcgccagattgaggatctcatcgcccagcaggttgcgatagtagaaggagaacagcacgtccggcttcatctcgcggatacgctcaatccacagcggatggttcacgtcttccggcgcccacaccggaatgccctgctcggcggcaaggcgcgccacggagccaaagaaatggttttcgccagggttatccgggtgggtgaaaatagcagcgatatcatacccggcgtccagcagagcctggataccggtgcagcccatatcgtgataagcgaagactacggctttcatgaacgatcttcctctttagatgccgtttccggctggcgaacaacacgttgaataaagtagcgggggcgggcgcgcacgtcgttatagatgcggccgatatactccccgagcaggcccataccgacaaactgggcgccgatgaacatgaacagcacggcgaagagcataaacaccccttccgccgcccactgcgggccaaaggccagacgcagcaccaccagcagcaggccgaaggcgaagcccagcagggcaatcacgctgccgaaaatgctgagcagacgcagcggcgtggtggtcagacaggtcaccaggtcgtacatcaggttgatcaggcgcatgaagctgtatttggagtcgccgaattcgcgctcggcgtgcatcaccgggatctccaccgcgcgccgggcgaaggtattcgccaggatcgggataaaggtgctgcgctcatggcagttgagcatggcgtcgatgatatggcggcggtaagcgcgcagcatgcagccgtagtcgcccatcgctttgccggtggtgcgctggatcaggcggttgatcatcttcgacgcggttttacggaagatgctgtcctgacggttctggcggacggtgcccaccacgtcgtaaccttcatcagccttcgccaccagccgcgggatctcctccggcgggttttgcaggtcggcgtcgagggtaataatcagatcgccggttacatggctgaagccggccatgatcgccgagtgctggccgtagttacggtttaacagcacggcgacgacgtggctgccttccgcctcggcggcttcggtgagcatgcgcgcggaatcgtcgctgctgccatcgtcgatcaacagaatttcatattgccgccccagggtggcgcaggcggcatccgtacgacgaagcagttccggcaggctatcctgttcgttataaaccgggataaccaccgagaccttcttcacgggagggtaagtaagcatatcaacgtcctgacaactggcgcagtgcggagataacgcgagtgacatcgtcatcggtcatatccgggaacaacgggagagagcagatgcgggcgctgttccattcggtattcgacagggaaacctcagggaagcgctcgcggtaatatttttgcgtatgggccgcacggaagtgcaggccggtgccgatgcccatcgccttcagcttttccatcagcgcgtcgcggctaatgccgcacgcggcctcatcgacgcggatgataaacagatgccaggcgtgctggtgatcccaggtcgggacgctcagcggtttaaacggcgtgtccgccagctcgcgcaggtagcgctgggcaatctcggtccggcgctgattggcgtggctcagtttttccagctggaccagcgccagagcggcgttgatatcggcaaggttgtacttgaagcccggggtgatcacctccgcctgcggcgcgcggccgtgggtctggcgatcataagcgtccacgcccagaccatggaatttcaggctacggatgcgggaggccagctcgtcgtcatcggtgacaatcagcccgccttcggcacaggtcatgtttttgatcgcgtggaacgagaaaatggcggtcccctgccagcccacgtgacggcctttataatgggtaccggccgcatgggcggcgtcttcgatcaccgaaatgccatggcgctcgcccaccgcgcgaatggcgtcgatgtcggctggcgccccggcgtagtgcacgggaattatcgctttggtacgcgaggtgatcgccgcttccaccgctgcaggggtaatcatcagattgtcgttatcgacatcgatcatcaccggcgtggcgcccagcaggcagatcatattgagagtggagacccaggtctgggacggcgtaatgacttcatcgccggggccaatacccagcgccatcagggtcacatgcatcccgccggtcgctgaactgacggcaatcgcgtggcggttgccggtcagctggcagaatgccgcttcaagtgcctgattcttcggtccggtggtgatccagcccgacgctaaaacttcacgcagggctgccagctctgcgtcgcccatcgacgggcgcgaaaaaggcaaaaaatcgctcatcatcatcctgttctgtagatgacccacgcacgaatctgggtcgttagaataaaatatcctgcgcctgcggacttaaacgaaattaaaatgaagtgagttcagcacggcattccatttcagggtatctcgaccactattaatgtagtcgaccttgcttaggataatattaagaaattaatatttcttcggaataagaaataaattcttaataaacagtatgataggatttttttatggcagaaatttgacggagatgcgttcctgtcacgaaaaagagaacaggaacgcaatagttgaaattaaacgagaactaaaccagttcacaatttattattctgtcattgtcacgcttaatgacaaaaagttagcgcagatcacaaagttatttctgctgaattacaaatttgcaggaaaatccgcaggcaattcgctcgccgggcaattaatgacctcgtcattatccgcgccacagtcgcgaatgaaggtgatagtggcgaactcgtcaatcacttccgtcgggtaggccgggccggcatcgcgatacgaattcatcagcggaatatggtcgttctggaagcagatagttttttccgggttattcatgatccagcgcgggaagaaaatagtgccgtggaacagtttgtcgcccaggttgacgatcaggctgacgtcggtgccggtcggttcggtccaggagattttgtagatactttcccccacccgcacaatgtacgcttcctgatctttcacccagcgattgccgacgatgccgctgtgaatacggtagtcgagggtgtggccatttttgacgtaaatctcgtagttccagccgttgtcgtaggtatagaccagatgtttaccgataaagccgctgaggtcatgtttgtcgaaagtgctcatcatttattctcctctgttttgttgaggacagcatacgtctttaaaaaatgaatgaataacgctatgtttggattaaatacattcaaattttagattgattatgcacaagacaaccctggagcagtgggcgttactcgaaaaggtagtggaattggggagctttgccagagcggcggaggagaccaatcgcagtcagtcatcggtaagctataacctcgcgctgctgcaggagcgcttaggcgtggcgctgctggcgccgtccggccggcgggcggtgcggacgccggctggcgaactactgctgaatcaggtcaagccgctgctgcaggccttcgcctacgtcgagacgcacgccgccactctgcgcaacggggcgcggacccgcctggatctggtggtcgacagtattttcccgcgccagcggctgttcgcgattttacgccagtttcagcagcgctatccgcagacccaggtcaggctcacagaagtgctggaaaacctggatgacgagagcgcggcgcggacggaagccgatgtgatggtgctgacccgccgccaggatattaccggccgcggggagtggctgatgaatattgatttcattgccgtcgcccaccgcgaccaccctctcgccgcgctggacggacctctggaggatagcgcgctggcgccgtggccgctggtgcgcattgccgatcagggcggcgatggccaggcgccgcgagacgcctggaccttctccaccattgatgccgccattgatgcggtgatgtatcaggtcggcttcggctggctgccggaggagcgcattcgcccccatctcgaccagggcgtgctgaagcggttgcccctcagccatggcgcgcgccgcgcgacgccgctgcatctgatcgtcaagcgggacctggcgccgatcgacgaacaggtggccacgctgctggcgttgttccggacgccctgaggggtaaggcggcgctggtcgcctgggcgtaatgatacgattttcttatactttccggcgcaatattgatccaggttactcccaaagtatgatgaatcactaaaatcgtcatactttcctgtcgttgagattgccgtcttgtctattatccgcctcaccctgctggcgctggtcgcttgcgtccctctgctggctcaggccgcgccgtaccagctcaccaccgcctggccggttaacgtcggcccgctgaatccccatctctatacgcccaaccagatgtttgcccaaagcatggtctatgaaccgctggtgaagtatcaggctgacggcagcgtacagccatggctggcaacccgctggcgtcactccgccgacggaaaaacctggtggttcaccctgcgcgacgatgtggccttctccaacggcgaaccgtttaacgcccaggccgcggcggccaattttcaggcggtgctggccaaccgccaacgccacgcctggcttgagctcgccaaccaaataaccgacgtgcgggccctcagcgccaccgagctgcagatcaccctgaaaagcgcctacgcccccttactgcaagagctggccctgccccgcccgttccgcttcatcgccccctcgcagtttatcgatggcggcaccgccaggggcattaaagccccgatcggcaccggcccgtggcggctggcaagctcgcagctcaatcagcgcgatgtgctggtgcgcaatgagcgctactggggtcgcaaacccgcgctacagcaaatcaccatcaaggtgatccctgacgccaccagccgggcggtggcgttcgaaaccggggaaatcgatatgctctacggcgatgaagggctgctgccgctggacaccttcgaacgctttcgccatcaccccggctacgtggcgcgcctgtccgccccggcggagacggtaatgctggcgctaaacgccagccagggcccgacccgcgagctgacggttcgcgaagcgctcaactacgccgtcgataaacagacccttgtcgatagcgtgttgtatggcacccagcaggttgccgacaccctgtttgccccctccgtcccttacgccccgcaggatctgacgccgcgccgttacgacccgacaaaagcccgcgccctgctggaacaggccggctggcagcagctggagggccagccctggcgacaaaaagccgggcaaccgctggcgattgagctggcgtttatcggcaccgacgcgctggctaaatcgatggccgaaattattcaggccaatctgcggcaggtcggcgtgcaggtcaccctggtgggcgaggaggaaagcagcatttacgcgcgccagcgcgaaggccgcttcggcatgatcttcaatcgcacctggggcgcgccctacgatccgcatgcctttttaagctcgatgcgcgtcccttcgcatgcggattaccaggcccagcgcggcctgccagacaaggcactgattgataaagagattagtgaagtgctgaccaccggggacgaggcgcagcggagaaaactgtaccatgatgtgctgacccgtctgcatcaggacgcggtgtatctgcccatcagctatgtctcgctgatgtcggtcgcgcgccaggaggtcggggagatcccgttcgccccggtgaccagcgagatccctttcgaccagattaccccggtaacgccataatgctacgctatattttacgccgcctgctgctgctgatcccgctgctgctcgccgcctcagccatcatctttctgctgctgcggctcggcgccggcgacccggcgctggattatttacgcctgtcgaacctgccgcccactgaagagatggttgcctcgacccgcgagctgctggggctcaaccagccgctggcaatgcagtatctgcactggctatggcgggcgctgcacctggatttcggtctctcctatgccacccagcgcccggtgctggacgacctgctgcacttcctgccggccaccctgctgctcaccggcgcggcgctggcgctgatcctcgtcacctccctgccgttgggcatctgggcggcgcgccatcgcgatcgcctgccggactatatcgtacggctgattgccttcctcggcgtctcaatgcccaacttctggctggcctttctgctggtgatgctcttttccgtgcatctgcagtggctcccggcgatggggtatggcgactggcagcacctgattttgcccgccgtctccatcgcctttatgtcgctggcgatcaacgcccgcctgctgcgcgccagcatgctggacgccgccagccagcgtcacgtgatatgggcgcggctacgcggattgagcgcgcgccaggtggagcgccgacatatcctgcgcaatgccaccctgccggtggtgaccgccatgggcatgcacattggcgagctgatcggcggcaccatgattatcgaaaatatctttgcctggcccggggtcggccgctacgcagtttccgccattttcaatcgcgattacccggtgatccagtgctttaccctgatgatggtgacggtgttcgtgctggctaatctggcggtagatgtgcttaacgcggcgctcgacccgcgcctgcgccgccacgaggaggtgagcgcatgagagggctacaaagctttcgctggccggtaaaactggccatgctggttatcgcgctgctggcggtcatcgccatcggcagcggctggtggctgccctgggatccagcggcgattgaccttcagcagcggctgctaccgccgggcgcagcgcactggctcggcaccgatcatctcggccgggatattttctcacgcctgctggccgccacccgcgtttcgctgggggcggtgatggcttgtctgctgctggtgctgctgatcggcctggcggtcggcggctgcgccggactgctgggcggccgcgccgaccgcggcctgatgcgcatcgccgaactgtttatgacttttccgacctcgatcctatcgttctttatggtgggagtgctgggtaccgggctgaccaatgtgatcctcgccattgcgctgtcgcactgggcctggtacgccagaatggtgcgtaacctggtggtttccctgcgccagcgcgaatttatcctcgccgcccgtctgagcggcgccagccagtggcggctgttcagcgaccatctggccggcgcggtgatcccctcgctgctggtgctcgcctcgctggatatcggccatatgatgcttcacgtagccggcatgtcgttcctcggtctcggcgtcagcgcgccgacggcggaatggggggtgatgatcaacgacgcccggcagtatatctggacccagccgctgcaaatggtctggccggggctggcgctgttcatcagcgtgatggcttttaacctgctgggcgacgcgctgcgcgatcgtctcgatccccacctgatcgcggagcatagccactgatgccgcagaagatccaactggaacagatctcgcttgccgctgaccgaccgctggtcagcgacgtctccttcaccctgcgccgcggccaggtgctggcgctgctcggcagcagtggttgcggaaaatcgctgacctgcgccgccgcgctgggcctgctgccgcccggcgtcaggcaaaccgccggccgggtgcttctcgacggcattccggtgcacggcgaacagctgcgcggggcgaccatcgccaccatcatgcagaacccgcgtagcgcctttaacccgctgcagaccatggccgcgcatgcccgggaaacctgccgggcagcgggtcgtgaaacgaatgacgccgtgctgctggcagcgatggaggaggtcggtctggacaatccgcgggcgctactgaagcgctacccttttgaaatgagcgggggcatgctgcaacggatgatggtcgctctcgccctgctcagccgcgcgccctttatcatcgccgacgagccgacgaccgatctcgatgccatcgcccaggcgcgcatcctcgacctgctggcggatattgtcgccaggcgcggtctgggactgctgctggtgacgcatgacatgggcgtcgtggcgcggctggcgcatcacgtaacggtgatggagaacggtcgcctcgttgaacactgcgatgtgaatacgctatttagcgccccgcggcacccgctcagccagcgcctgctggccgcgcatctggcgttatacggtctggagaaaacaccatgaatttactcagcgctaccggggtgagtcacgattatcctcaccacggcagggtcctgcatgcgatccatctcgccatcgcccccggcgaaacggtggccctgctcggacgcagcggctgtgggaaaagcaccctggcgcggatgctggtgggtctggaaacgccgcagcacggtgatattgcctggcgcggcgcgccgctgactgccctgaagggcgaggccatcggcgccttccgccgtgatattcagctggtatttcaggatgccttcagcgcggtgaatccgcgcaaaacggtgcgcgagatcgtcagcgagccgctgcgccttctgttgtgcttgtcgcgtgaggcgcgtgcgcggcgggtggaagagatgctgctggccgtcgacctcgcgtcgtcgctgctcgataagcgcccggcgcagctcagcggcggacagctgcagcgcgtctgcctggcacgcgccctggcggtacggccgcagctgttgatccttgatgaagcggtttcaaatctcgatctgctgctgcaggcggagattatcgccctgctgaagcgtctgcaggcgcagtttgacaccgcctgcctgttcatcacccatgacctgcggctggtggagcgcttttgccagcgagtgctggtgatggagcacgggcgcatcgtcgaaaccgcaacggttagtctaccgctacgcctgcgctcccctgccggacaggcgctccagcaggcggtgctccccccttttcctgccactctgcttaacgaggccatgccatgcagcgcgtaaccctgacccttgatgatgacctgctggccgccctcgatgcgctcagcgcccgccgcggctaccacaaccgttcggaggcggtacgcgatattctgcgcgacgccctcaaccaggatcctccgtcgccggaatcacggcgcgggtatgccgttctgtcgtacgtgtatgaacatgagaaacgcgaactggcgagccggctggtggccacccagcatcatcatcacgatctctccgtcgccacgctgcatgtgcatatcagtcatgacgactgcctggagattgcggtgctgaaaggtgatatggccgaggtacagcattttgccgacgacgtgattgcccagcgcggcgtgcgccatgggcatttgcagtgtttagcggatgattaattatttgaaaattcttgggtggtttatcaacagttgataaaccacataaactatacgctttgtgaattatccctcttcgccaataatggcgcctcatttaacgatctcgttatggcgaggctcctgcataaatacaagttaccgccctgttggtatcgagagagaccactcagggaaatacaggcttccatcgaatcaaggtgttgccaaggtaacttctggcggtcatgaccgttcagatacgttatgcagtgctaaaaccaggacgtagggatctgcctgcgctaaccctgtcttgttcgcccctatgagtgattttttatagggatttttaaacatgtcttccattcaactctgcgccgcccatcaggcgacctctggcttcgacggcgatgcgatcgtccagtacatgcgtaccgattttattacgctgcaggaacatctcagcgttcatgaggcgcgcgaacactttatctcccagctggccagcgatgatattcccgggcaggtgtttgtcgtcgccggcaagaagctgcgtggcagcctgtcggtcaaaaagctactccaggaaacggatatcaaccagtctatccgccacctgatggacagctgcctgtttcgcgtcaaacctgacgatgagcgccagcaggtgattgccgagctcagcgagcgcggcctcgacctggtccccgtcgtcgataaaggcgagctggtcggctgcctgatggagaaggagatcgcccatctgctggaggatgacgtcaccgaagatgctcagctgcagggggcaacgctgccgctggaaaaaccgtacctcgagatcagcccctggacgctgtggaaaaaacgctcggtgtggctgctgctgctgttcgtggccgaagcctacaccagcagcgtactgcagcatttcgaagaagccctggaatcggccatcgcgctggccttctttattccgctgctcatcggcaccggcggcaacagcggaacgcagatcacctcgacgctggtgcgctcgatggcgctgggggaagtgcgactgcgcgatatggggcgggtgatccgcaaagaggtatcgacctcgtttctgattgccctgaccctgggcctggcgggctgcctgcgcgcctggatgatggggattggcatggaaatcacgctcatcgtcagcctgacgctggtgtgcattaccctgtggagcgcgattgtctcctcggtcattccgatggtgcttaagcggatcggcattgacccggcggtagtttccgcgccgtttatcgccacgctgattgatggcaccgggctgattatctatttcaaaatcgcccagtattttcttgggttgaactgatcatatacgtccgggcaccagggcgcccggacgcgtagattacccttccaccagcgcctgcgcgcaggcccaggcgcttgaccacgcccactggaagttataccccccgagccagccggtaacgtccatcacttcgccgataaagtagagacccggcgccttacgcgcctccatagtacgcgacgagagttcgttggtgtccacgccgccgagggtcacctccgccgtccggtagccttcggtgccgttcggctgcacgcgccaggcggttaacgtctccaccagcgtctgctgatcgcgaacgttcagttgcttgagcgtcacatcaggtatctgccccagctgctgcagacactccaccagccgcttcggcagctgcatcgccagggtgttcttcaggctctggttgggatgcgcgctgcgctgctcgttaaggaagtcatcaagatcgcagtccggtagcagattaacggtgacgaactcgccgggctgccagtagctggaaatttgcagcaccgccggtccggaaaggccgcggtgggtgaacagcagattttcgcgaaacagagtgccgttctcggcggtaatggtcgacggcaccgacacgccggagaggacctgcagctgctcaagcaatggcttgtggagggtaaacggcaccagccccgcgcgggtcggcagcaccttcaggccgaactgctcggcgactttatagccaaacggcgaggcgccgagccccggcatcgacagaccgcctgaggcgatcaccagctttttggtcaccagcgtttcgccgttcacctgtagccggtagccttgttcatcgcgctccacgctgaggatttcgctgcgcagacggatctgcacgccgcccttttcacattccgcgagcagcagattgacgatctgctccgccgaatcatcgcaaaacagctggccgagggtcttctcatgccaggcgatgccgtatttaccgaccagctcgataaagtcccactgggtgtagcgcgccagggcagatttgcaaaaatgcgggttttggctcaaataggccgccggttcaacatacatgttggtaaagttgcagcggccgccgccggacatcagaatttttcgccccggctttttgccgttatccagcagcaggacgcggcagccaagctggcccgcctgcgctgcgcaaaacattcccgccgctccggcgccaacgacaatggcatcaaacctttccacaccgcgttcctcgttccccaattgtcgggttttgtaaatatttcactctggtcacaccagcgggaaaaatcccgcattagatacatcattgaaagatataggattactcccaacagggtaaaacctaaacaggaagaaaatcaaaaaaagtctatatttcactttgcccgcgccgctaaagtcactgataatgcgccgcgttcatgtcctcaaaatggcgtaacgtcctatgctacatttatttgccggtctggatttacataccggactattattattgcttgctttagcttttgtactgttttacgaagcgattaacggtttccatgataccgcaaacgcggtggctacggttatctacactcgcgcaatgcgctcacagctcgctgtggcgatggcggcgctcttcaacttcttcggcgttctgctgggcggtctcagcgtagcctatgccatcgtgcatatgctgccgaccgatctgctgcttaacatgggttccgcacatggcctcgccatggtgttctctatgctgctggcggcgatcatctggaacctcggcacctggtacttcggtcttccagcttccagttctcataccctgattggcgccatcatcggcattggtttaaccaatgcgctgatgaccggtacttccgtggttgatgcgctgaatatcccgaaagtcatcggtatttttgcttcgcttatcatctcgccgatcgtcggtctggtgatcgcgggcggcctgattttcctgctgcgtcgctactggagcggaaccaaaaaacgcgcgcgtatccacctgacgcccgcagagcgtgaaaagaaagacggtaagaaaaagccgccgttctggacccgtatcgcgctgatcctgtctgctattggcgtgtcgttctctcacggtgctaacgatgggcagaaaggcattggcctggtgatgctggtgctgatcggcgtcgcgccggcgggtttcgtggtgaatatgaatgcctctggttacgaaatcacccgtacccgcgatgcggtcaacaacgtggaaaccttcttccagcagcgtcctgaactgctgaaaaaagccaccggcgtcgatcagctggtgccttctccggataccaataccgcggccaatggcgagttccactgccatccggcgaacaccatcaacgcccttgaccgcgtcaaaaccatgctgaccggcgttgagaactacgagtcgctaaaaccggaacagcgcggccagctgcgtcgcatcatgctctgcatctccgacaccaccgacaaggtggcgaagctgccggatgtgagcgctgacgaccagcgtctgctgaagaaactgaaaaccgatatgctgagcaccatcgagtacgcgccaatctggattatcatggctgtcgcgctggcgctgggtatcggcaccatgatcggctggcgccgcgtggcgaccaccatcggtgagaagattggtaagaaaggcatgacctacgctcaggggatgtcggctcagatgaccgcagcggtttctatcggtctggcgagctacaccgggatgccggtttccaccacccacgtactctcctcctcggtagcggggacgatgctggtggatggcggtggtctgcagaaaaagacggtgaccagcattctgatggcctgggtgctgaccctgccggcagcgattatcctttcaggcgtcctttactggctctccctgaaactgatttaagcgttattcgttcaaaacgggccagcttgctggcccgtttttttattctgaaacgttagtgccagatcatcagcgcaatcaggctcaccaccaccaggccgcacagggcgctggtcaggataaactggcgacgaacacgttcgcagcgacgaataaattcatcatcgtgatggtcacggtagcgctgggcatagatataccacaccagccgcatctgtttgctgggctgcccgtgcgaggtaaaaaagccgccgccatcaacatactgatagagcaagggatcgcaaccacgtagcaccaccaataatgcacgcaacgatgagaagtagcgtgccatattcaccacacaaacgacacacagggcccaaaacagcgcaatagtgctgatcatacctcctccccggcgacccgcctacggagaaaacctccgcggctaccgctccccaaataacccacgacgataccgtaaagagtgcgattccgatcacatttatttttccgaccggctcattaaatagtgtaggagatccattaatttttttaccacaaggttattcgttatcaatacgtaagacggataaatttgtttaacttttaggtgaacccagtgcattgacggagtgcggggggcgctataaggtaggaaatatcttctacaatgaagtccttaaaggctaccctcccgcgaatgtagcacgcaggacgcgggcgaaacggcagcgccagctgtcaggtccaatggtcatcgacaaacttatggaaggagtaacactatggcttacaaacatattctgattgcagtagacctgtccccggagagtaaagtactggttgaaaaagccgtttctatggcccgcccgtataacgcgaaagtctccctgatccatgtggatgtgaattactccgacctctacaccgggctgattgacgttaacctcggcgacatgcaaaaacgcatctccgaagagacccatcacgcgctgaccgagctctcgaccaacgcaggctatcccatcaccgagaccctgagcggcagcggcgaccttggccaggtgctggtcgatgcgattaaaaaatacgatatggacctggtggtctgcggccatcatcaggacttctggagcaagctgatgtcctctgcccgccagctgattaacaccgttcatgtcgacatgctgatcgtcccgctgcgcgacgaagaagacgaataaccgtctcgttttatccgcgcaatacgcccgccgatgcgggcgttttttattttcgctttccctcgccatgcggcagaacttcaatccataaaatcgccattcaattagtgtgatcaaccagttattcggcgaaatatctatataataatctattccataagccaataaccgcagcatggcgagttatcagacattttcggcgcgttctggcatacgcgttcatactttttgggaaagtaatacaaggcgaaggaatatgaatacaactgcacctacgggcttgctgcagcaacctcgtccgttctttatgatcttctttgtggagctctgggaacgttttggctattacggcgttcaggggatcctggcggtcttctttgttaaacagctgggcttctctcaggaacaggcctttatcaccttcggcgccttcgcggcgctggtttacgggctgatctccatcggcggctacgtgggcgaccatttgctggggaccaaacgcactctggtgctcggcgccattgtgctggctatcggctactttatgaccgggatgtcgctgctgaaaccgcagctgatctttatcgctctcggcaccatcgccgtcggcaacggtttgtttaaagccaacccggcgagcctgctctccaaatgctatccgccgaaggatgcccgtctcgacggggcatttaccctgttctatatgtcgataaacatcggttcgctgctgtcgctgtcgctggcgccggtgatcgccgaaaaatttggctacgcggtaacctataacctgtgcggcgcggggctgattatcgcgctgctggtctacttcgcctgccgcgggatggtgaaagatattggctccgagccggatcatcgccccctcagcctacgcaatctggcgctggtgctggccggtacggtggtaatgatttttctctgcgcctggctgatgcataacgtgatgatcgccaacctggtgctgattgttctgtcggtcgtggttattgcgttctttttccgtgaggcgtttcgcctcgataaaactggacgcaacaaaatgttcgtcgcctttattctgatgatcgaggcggtgctgttttacattctgtatgcccagatgccgacctcgctgaacttcttcgccatcaacaacgtccatcatgagatccttggctttaccatcaacccggtcagcttccaggctctgaatcccttctgggtagtggtcgccagcccggtgctggcggcgatctacacccatctcggtcataagggtaaagacctgaccatgccggtgaaatttaccctcgggatgttcctctgcgcgctgggcttcctgaccgccgcggcggccgggatgtggttcgccgacgcccaggggttaacctcgccgtggtttattgtgctggtctatctgttccagagtctgggggaactgttaatcagcgctctggggctggcgatggttgccgcgctggtgccgcagcatctgatgggctttattctggggatgtggtttctgacccaggccgccgctttcctgctgggcggctatgtggcgacctttaccgcggtgccggaaaacatcaccgacccgctgcagaccctgccggtctacaccaatgtgttcagtaaaattggcctggtgacgctgggcgtcacggtggtaatggcgctgatggtgccgtggctgaaccggatgattaatacaccggccagcgccgagtaaccgtttaagatggccgatccgcactggcgccgtttgttcagatattgtggttcccggcttgcgctacgctgagccgggcgacaattcggtagcccggataaggcgcgttgcgccgctatccgggagttaccaccacggcgtaatattactccggcgtaccggcgtaaatatcaaaccgatgccctttggtcaccaccgcattcggcgtggcgacttccgccagcggcggcgcgtaatccgggcgcttcaccaccacccgcttggtcgccagctggcgcgccggggccagcaggccatcggcgtctaaatccggccccaccagcgactgaaagacgcgcatctctttcttcaccagcgcgcttttctgcttatgcgggaacatcggatcgaggtacaccacctgcgggcgcggggtgatatcggttaacgccgtcaggctggaggcgtggatcagctgcagccgctcctgcagccagccgccgatttccgcgtcagcatagccgcgcgccaggccatcatcgagcagcgcggcgaccaccggattacgctccagcatccgcacgcgacagccgaccgacgccagcacaaaggcatcgcgtcccagcccggccgtcgcatcgacgacatccggcaggtaatcgcctttaatacccaccgctttagccaccgcttcgccgcggccgccgccaaacttgcgccggtgggccatcgccccgctgacgaaatcgacgaagatgccgccaagcttgggctcatcgcgcttgcgtagctccagatgctccgtcgtcagcgccagcgccatcgggttatcgtcatcctgctccagcccccagcgggcggctaaaacagataaggcgccgtcaccggcgcctgtttcatcaattaagcagatcttcacgtagcaatcagcctttgatcccgtaatgctccagcatcgcgtccagctgcggctcgcgcccgcggaagcgtttgaacagctccatcggctcttcggaaccgccgcggctcaggatattgtcgaggaacgactgaccggtttcacggttgaaaatcccctcttcttcgaagcgtgagaaggcgtctgccgccagcacgtcggcccacaggtagctgtagtaacctgccgcatagccgccagcgaagatgtggctgaaggcgtgcgggaagcggccccaggtcggccccggcaccacggcgacctgctttttaatctcggccagggtctcaaggattttcgctccctgctccggtttgtactccgcatgcaggcggaaatcgaacaggccgaactccagctggcgcagaataaacatcgccgcctggtagtttttcgccgccagcattttctccagcagctcctgcggcagcggttcaccggtttcataatggccggagataaacgtcagcgcttccggctcccagcaccagttctccataaactggctcggcagctcgaccgcatcccacggcaccccgctgatgccggaaaccccggcggtgtcgatgcgggtcagcatatggtgcagaccgtggccgaactcgtggaacagggtgatcacttcgtcatgggtgaacagcgccggcttgccgttgaccgggcggttgaagttacaggtcaggtaggcgaccggcttctgcagggaaccatccagtttacgcatctggccgacgcagtcgtccatccacgcccccccgcgcttatgttcgcgggcatacaggtcgagatagaagctgccgcgcagctcgttgtgttcgtcatacagctcgaagaagcgcacttccggatgccacacatcgacatcggtacgctctttagcggtaataccgtaaatgcgcttaaccacttcaaacaggccgctaacggctttgttttccgggaaataggggcgcagctgctcatcgctgatgctgtagaggtgctgcttctgtttttcgctgtagtaggcaatgtcccacggctgcagctcatcgacgccaaactcggctttggcgaaggcgcgcagctgggccagctctttttcgccctgcggacgggcgcgttttgccaggtcggtgagaaagtcgagcacctgctgcggatccttcgccattttggtggcgagggatttatacgcatagctgtcaaagcccaacagctgcgccagctcgtgacgcagggcgaggatctccgccatcaccgggctgttatcccatttcccggcgttcgggccctgatcggaggcgcgggtggaataggcgcgatacatctcttcgcgcagcgcctggttatcgcagtaggtcatcaccggcagatagctcggaatatccagggtcagcagatacccttcctgctctttggcctgcgcctgagcctgagcggcggccagcgcgctttccggcatgccggccagatcggcgacatcggtcaccagcttgttccagcccatggtggcgtcgaggacgttgttgctgtactggttgcccagctcagagaggcgcgcggcgatttcaccgtagcgtttctgcgcctccggcggcaggccaatcccggataattcaaaatcgcgcagcgcgttatcaaccgcttttttctgcgcggtattcagcgtggcgtagttatcaccatcgcgcaggtcgcggtaggctttatacaggccttcatgctggccgacccaggtgctgtactcggagagcagcggcagcgtctgttcgtaggcctcacgcagttcagggctgtttttaaccgaattcagatggctgacaggcgagaagatgcgtcccagcacatcgtccacttccgccagcggctggcaaagattttcccagctatacggcgcgccatgcgccaccgcgctttccaccgcggcccggcaatcctccagcgctttggtgaccgcagggaccacgtgctctggtttgatcgcagaaaaaggcggcagggagaaaggcgtcaataatggattggtcatatgcgctgtcctgttgaaaagggtgaatgaagcgcgcgtccggcgcttatgcatgagatctagaatgggggatagttgggggaatttcaatgacgggcggtgcgtcagcctgggtattgctgcgataagtccgcccgttgccggaaaagcgcgacacgcagtgcagcgtgccggaaaccacattaatgccttttttgcgccatctcccaggccgccgacagattcagccgctgccagaattgctgttcgggggtggtgccggatagcgggtaacccgccggcagcgcggtgttgaccatcagcgcccgacgctgggccgctgacagatgcggcagggcatcttccagcagcacttccgccccctccggcacctgtaaacgcggctgcggacccttctgctgcggcagatcgtaggtcatggtgaagcgagagaaatcacgcatcgccggatcgcgccagggatcgtctttcacgctgctcttcgcgcactcggcaagcgatgtgccgcaggccttcgccagcgcggcgcgcagctgatcgcgggcttcgttaaataatacccggtagtgcggatcgttaagatagtgggccacgttgcgctcggccactatccgcgagccgatcacgtccagcgggtagtggacgcccagcacgatgcgcgagtagccatagcgggcgccgcgcgccaccagcgcgtcgtagcgctccgggatcatcgccgccagcagcagcgcatcggtatagccggtgttggtgtggccgctgggaaacgagccgccgtcggcggtgtagggctggttatctttcaccaccacatcgtcaggcaccaggtgaatggtgttgccctgcaccagaaacggccgcggattattgaagtgctttttcgcctcgccggtgctgacctccgaggctttgatcaacgctgccgctttccccagcgcgccctggtcataggcggtcagaaacgctttgccaaggcgtggccccagcgcatcgctgaggaagtagaggtagctaatgccttccgcatcggccagcgcctgacggcgcgtggtctgcacggcgtcgcgattgatggcggtcaccgtcgccagattctgcttcacgacggtctccggcagggtgctgaacgccgacagcagcgcaatgcccgcctgctggttggcccgggtctggaagtcatagccgctggccttcagccaggcggtatcggcctgagtttggttttgtttggtgtgcgccagccgatcgcgggtcagcgtagcggcattcccctgcagagcgtggcgtagctgcgccagcgcctgttgctcaagatcgtcatacgcctggctggaggcagccggcgtcacgctattggcgagggccgccgccctgttcagcgggatgtctttagccagaaccggttgcgccagcagcagcgcgacggccagcagcgagagttgccttttcattatttttccttttattcaaataattaccttgcctgtacccgacgctagcgcggccgtttgacgtttttatgacagcgttatgttttgcaacgcttttggcagaaatgaaacagcgcggcggcgcagcggtaatctcggccgatctgcggtaaactatcggttaacttgtttacttcccggaatctctgcatccatgctcagttatcgccacagctttcacgcaggcaaccacgccgacgtcctcaaacacaccgttcagagcctgatcattgaatcactgaaagagaaagaaaaaccgtttctctacctggacactcacgccggcgcgggccgctatcagctgagcggcgagcacgccgaacgtaccggcgagtatcttgaaggcatcgcccgcatctggcagcaggacgacctgccggcagagctggagccgtatatttcggtcgtcgaacacttcaaccgtaacggccagctgcgctactacccgggctcgccgctgattgcccgccagctgctgcgcgagcaggacagcctgcagatgaccgagctgcacccgagcgacttcccgctgctgcgcgctgaattccagaaagacagccgcgcgcgcgtcgataaagccgatggctaccagcagctgaaagccaagctgccgccggtatcgcgccgcggtttgattctgatcgacccgccgtacgaaattaaaaccgactatcaggcggtggtcaccgggattaacgaaggctacaaacgcttcgccaccggcacctacgccctgtggtacccggtggtgctgcgcgcgcaaatcaaacgcatgatcaaagagttagaagccaccggcattcgcaaaatcctgcagattgagctggcggtgcgtccggacagcgaccagcgcggcatgaccgcctccgggatgatcgtcatcaacccgccgtggaagctggagcagcagatgaataacgtgctgccgtggctgcacagcaaactggttccgaccggcaccggccacgccaccgtcagctggatcgtaccggagtaatcgcaaccatcggtggaaccttttaagcctcgcgctacaatcgcggcaatcaacgattaaggacatatgggcatgagcaaacattatgattacctcgccatcggcggcggcagcggcggtatcgcctcaattaaccgcgcggccatgtacggccagaagtgcgcgctgattgaagccaaagagctgggcggcacctgcgtcaacgtcggctgcgtgccgaaaaaggtgatgtggcatgcggcgcagatccgcgaagcgattcatctttacggcccggactacggtttcgataccaccatcaaccattttgactgggagaagctggtcgccagccgtagcgcctatatcgaccgtattcatacctcttacgacaacgtactgggtaagaataaagtcgacgtgatcaaaggcttcgcgcgctttgtcgatgcccacaccgtggaagtcaacggcgagatcatcaccgctgaccatatcctgatcgccaccggcggccggccgagtcacccggatattccgggcgtcgaatacggtattgattccgacggtttcttcgaactgccggcgctgccgaagcgcgtggcggtggtcggcgcaggctatatcgccggtgagctggcgggggtgattaacggcctcggcgccgaaacccacctgttcgtgcgcaaacacgcgccgctgcgcagtttcgatccgctgatcgttgagaccctggtggaagtgatgaacgccgaaggcccgcagctgcataccaatgcgatcccgaaagcggtggtgaagaatgccgacggcagcctgacgctggagctggaagatggccgcagccagaccgttgactgcctgatctgggcgattggccgcgaaccggcgaccgacaacttcaatctggcggcaacgggcgttaaaaccaacgataaagggtacatcatcgttgataaattccagaacaccaacgtgccgggcatctacgcggtgggcgataataccggcgccgttgagctgacgccggtcgccgtggccgcaggccgtcgtctctccgaacgcctgtttaacaacaaaccggaagagcatctggactacagcaacatcccgaccgtggtcttcagccatccgccaatcggcaccgtcggcttaaccgagccgcaggcgcgcgagcagtacggcgacgacgccgtgaaggtctacaaatcttccttcaccgcgatgtataccgccgtgacctctcaccgtcagccgtgccgcatgaagctggtgtgcgtcggcccggaagagaagattgtcggcatccacggcatcggcttcgggatggatgagatgctgcagggctttgcggtggccctgaagatgggcgccaccaaaaaagacttcgacaacaccgtcgccattcacccgacggcggcagaagagttcgtcaccatgcgctaagacgcgatcgccggatgataaaaagaagcccctgggggcttctttttttatgctcaggccacgccgttattgccatggcgcataaacgccgggcgctgattgagcgccatataccagcgctccacggctggcatctccggatgggcgaaaggggtcattttccagcgatgcaccgacagccccagcacgatatcggccagggtgaagcgctcgccggctatccacgccccggtacgctgcagctgcgcttcaacaatgcgcacgcagtgggtccaggcggcaatactctctttaatcgccaccggatcctgaaagcgcggatctttacgcaccagccccataaaagcatggcgccaggcagtattgaactcggtcgcctgccagtccatccagtgctccacctcggcggcgggctgcggttcggcgggcagcagatcccagcgctccgctttgcgcgccagatagcggcagatactgttcgactcccagagcacgaagtcatcgtccagtagcaccggcaccaggctgttaggattcagacgctgaaactcaggcgtatccaggggcttaaatccgctgccgtaatcttcctgctggtacgccagcccggcttcctcgcaggtccacagcactttccgtacattaattgaagagcgtttacccagaatttttagcatcgtcagcgattcctcagccataaaagacagttcattcactctactctattgccagccagcaacaaggcagagcgctggataatgtgtatagttgattccagcctgtttgccgaaaaggaacccgacatgttgaccccttttaccgttttgatgcctgcaaatattcgttttggccgtggtcaggccgagagcgccgccccctggctggcgcaacagggcggcccaatcctgctggtgcatggcgccagcccgcagcgggctgcgtttctccgccagcagctggaggcgctgcagcttgcggtcacgacgctggcgataagtcgcgaaccctggcttagcgatatcgagcagggcgtccagctggcgcgcgagaaagggatcagagcggtggtcagcctcggcggcggcgcggtgattgacgccggtaaggcgattgcggcgctggtccccgccgccggcccggtgatcgactatctggaggtggtgggaacgggccgtcagctggaagtcagtcccctgccgttcgtggcgatccccaccaccgctggcacgggcgcggaggtcaccaaaaatgcggtgatcaacgttccggaacagcagcggaaagtgagcctgcgcgacgaccgaatgctgcctgacctggcgattgtcgacccggcgctaaccgacaacgcgccgcggagcatcaccctgagctccggcctcgacgccctgacccaggtgatcgagccctggctctgcagccgggccactcccttcaccgatgctctctgccagcaggcgatcccgcggggaattcgcgcgctaaaaatcctgatggaacaagagtgtccggccagccgcgacgagatggcctgggtcagcctgggcggcggactggcgctggcgaacgccgggctgggggtgatccacggcctcgccggcccgctgggcggcctgagccgcgcctcgcacggcgccctatgcggcagtttgttgccgtttggcctggcgctcaatgagtcgcagatcaacgaccctggcctgcgccagcgcgttaacgatgtccgccgctggctggccgacgggctggacgtccctgtggatcaggtctgggacagtctgcgggaatggagccatcgcgctggccttggcaccctgcgcgacctcggcgtagcgcgcgatgcgctggaaccggcggcgctggccgccagcacctcctcatcgatgaaggccaacccggtcagcctgagcggcgaacagctgctggagatgctggaggcggcgtgggagtgagcgtcccgggataaaattttgttgcataatgaatgctccgaatttcatctgcgccaggatctacaatttttaattacttatcaacagcatactttgaaatggcagcttttcttctcggcggaaaagcgtgatctcacgcacagtttgcttcacactcaccgaagcgactgtctacgcttaatagacaaggccgggtatgcccggccccgaactcacgctatccggaggtccgtatcgctatgttcagccagaaattacgccacgttgaagacgacgagttaaggatcgacatcgatccctgctacgaagccgatccgtacgaattaaagctggatgagatgatagacgctgaaccggagcctgaggtgatcgaggggcttccggcgtccgatgccctcaccccggcggatcgctatcttgagctgtttaccaacgtgcagaaatcacgcattttcgcggacagcaaaaccttccccgactgcgcgccgaaacacgatccgctggacatcctgcggaactaccgcaaggtcaaacgccagcccgacttcgatctgcggcagttcgttgaggacaacttctggctgccggagagccagagcgacatctatatctccgaccccagcctgaccctgaaagaacacatcgacaagctgtggccggtgctgacccgcgagcctcaggatcatatcccgtggtcatcgctactggcgctgccgcaggcctacatcgtgcccggcggtcgctttagcgaaacctattactgggactcttatttcaccatgctggggctggcggagagcggccgggaagatttgctgaaatgcatggccgataactttgcctggctgattgaaacctacggccacattccgaacggcaaccgcacctactacctcagccgctcgcagccgccggtgttcgccctgatggtcgaactctttgaagaggatggcgtgcgcggcgcgaagcgctatctggaccatctgaagatggagcacgccttctggatggacggcgccgagtcgttgatcccgcaccaggcgtatcgccacgtggtgcgtatgccggatggctccctgctcaatcgctactgggacgaccgtgacacgccgcgggatgagtcgtggcgcgaagacgtggagaccgcccgacactccgggcggcccgccaatgaagtataccgcgacctgcgggcgggcgccgcgtccggctgggactactccagccgctggctgcgggatatcacgcggctggccagcatccgcacgacgcagtttatccccatcgacctgaacgccttcctgttcaagctggagacgaccattgccaacctctccggcctgaagggcgatcgcgagacggagacggccttccgccagaaggcccaggatcggcgggcggcggtcaaccgctatctgtgggatgatgagaacggctgtttccgcgattatgactggcgccgtgaacagctggcgctgttttccgcagccagtatcgtcaccctttacgtcggcctggcgacccacgaacaggcagaacgccttgccgatgcggtgcgggcccgcctgctcacccccggggggatcatggccaccgaatacgaaagcggtgagcagtgggataaacccaacggctgggcgccgctgcagtggatggcgatccagggatttaaacgttacggccaggatccgctgggagatgagattgcctggagctggctgcagacggtcaaccacttttacaagcagcatcacaagctgattgaaaaataccatattgccaccggcgtcccccatgagggcggcggcggggagtatcccctgcaggatggctttggctggaccaacggcgtggtgcgccgactgattggcctgtacggtgagccaacctagtcgggctgttcccggcggctttctcctgctatgttcagaggattcgccctgcccggaacgacgcttatgcctgaacttctgacgccgcgcctgcgctgctcaccgctgcagctggacgactggtcgttttttctttccctgcagcaggatccgcaggtcatgctctacgtcgccgatccccgaccgcaggcggccatccgcgaggcgttcgattcgcggctgccgccgtggacgcccggggatgaacactggctgtgcctggtggtgcgcgacaggctgacccataccccgctcggcctgaccggttaccagcatcatcagcgcgacattgccgaggttggctttctcttcgccccggcggcgcagggtcggggctacggctacgaatcgctgcgcgcgctgtgcgactacgcctttaccaccggcggcgtccgccgcctgaccgccagcgtcaccgccggcaacgagacgtctaagcagttactgctcaaagccggcttccggctggagggggagctgcgggaaaactactggctcaacggacgctggcacaacgactggctgttcggtcggctgcgtggggagggcgatgcgccgtagcgcaccgccggtcacaggctgggggcagtcaggatcagaggaacatcccgcccgagacttccacacgctgcgcgttcatccacgccagctcatcgctgagcagggcggcgatggcgtcgccgatatcatccggcagcccaacgcgccccagcgcagtctgggcggcgatatgccgattcacctcggcgttatcgcgcacctccccgccgccaaagtcggtctcaatggcccccggcgcgatgatgttcaccgatatcccccgtccgcccagctctttcgcctgatagcgggtcagaacctccatcgcccccttcatcgcggcgtaggccgcatagcccggcagggcaaagcgcgccaggccgctggagacattgaggatacgccccccatcctgcaggagaggcagcagacgctgggtcaggaaaaacggccctttgaactggatattcatcagctcgtcaaactgcgcttcgctggtctcggcgaagggcgcgttgagtccgatcccggcattgttcagtaaataatcaaaggtagtgcgtccccacttctgcgccagcacctgcgccacctcgctggcgaatgcgtcgaatgttgtggaatcgccgacgttcagcgctaatgctgccgctttgaccccttttttctctatttccgccaccacgtcgagggccgcctggcggttgctgtgataggtcaaaagaatatcggttccctttgccgccagcttcaacgcggcgtttttacccagaccgcggctgccgccggtcactaaagcgatacgttgtgtcatcagaagacccctttcaggttgcgttgtgattgtgttgtagcttattaactgctcatgcaacaataaatacgctacattgcgttttactgtttcattaacaacaacaataggcgatcggcatggataaaattcatgcaatgcagttattcattcgcgtagcggatctggagagcttctcccgcgccgccgagaccctggcgctacctaagggtagcgtctcgcgacagattcaggccctggaaagccatcttggcgtgcggctcctgcaccgcaccacccgccgggtccagctcacccaggatgggatggtctactacgagcgggcgaaagatctgctgagcaacctcgacgaactggacggcatgttccagcacgatccggcgagcatcagcggccggctgcgggtggatatgccggtcggttttgctaaaaaaatggtgatcccgcatctgccgacttttttacagcagtatccgggcatcgaactggagctgagcagcagcgatcggctggtggacgtgatccgcgaggggtttgactgcgtggtgcgcgtcggcgcgctcaaagactcagggctgattgcccgcccgctgggcaagctgacgcaaattaactgcgccagcccggactacctggcgcgttttggctatccgcaatccctggaggatctggcggatcatgccctgatccactacgccagcaccctcggggtccgtccccccggctttgaggtaatgatcgacggcgcggtgcgctgggtaaaaaccggcggcatattgacggtcaacagtacggaaacctatcaggcagcctgtatcgccgggctggggattattcaggtgccacgcaccggcgtgcgcgaggcgttacgcgccggcgacctgattgagatcctgccccagtaccgcgccgagccgctaccggtctcgctgatctatccgcaccggcgcaatctctcccgccgggtaaatctgtttatggagtggctgggcggactgatgaaagcgtatgtcgattgagcggcgcggctgaaaaacgggcggtggagagaggcattcctgcaggatacggcatttaaggtatactttttgctgaatctcgctgtaaaaaaggaagaaattacgtatgacgccggaaaacgacgatcgacgcccgccacaggaaccggatacgcagccggagaaaagcaaaagcacgctcgaggccctcaatgacaccgcagtcgggcaaaaagccagccaggcgctgaagaccgtcaccggaacggcggccaaagtgcagcgcaacccggtgatcgcccatctgttgcgcgccgcagagcgcttcaatgaccggctcggcaatcagtttggggcggctatcacctatttctcgttcctgtcgatgatcccaatcctgatggtctcctttgccgccgccggcttcgtgctggcctggcacccaaccctgctgcaggacattttcgacaaaattctgcaaaacgtcagcgacccaccgctggcggcaacgttgaaaaacaccatcaacaccgcggtgcaacagcgcaccgccgtcggtctggtcggcctgctggtcgccctctattccggtattaactggatgggcaacctgcgcgaagcgatccgcgctcaatcgcgcgacgtctgggagcgccggccgcaggacgaggagaaaatctgggtaaagtacttccgcgatcttatctcgctgatcggtctgctggtggcgctgattattacgctgtccatcacctccgtcgccggctccgcccagcagatgattatctccgcgctgtatctcgacaacattgaatggctgaaacccgcctggcggctaatcggcctcgccatctcgatttttgccaactatctgctctttttctggattttctggcgcctgccgcgccatcgtccgcggcgcaaggccctgtttcgcggcacgcttatcgcggcgattggctttgaaatcataaaaatcgtcatgacctggacgctgccggcgctggtgaaatccccctccggggcggcgttcggatcggtgctggggctgatggcctttttctatttcttcgcccgcctgacgctattctgcgccgcatggatcgccaccgcggagtataaagacgaccggcggatgccgggcaaaacccaccgctgaggtattgcgaggatgaataaaagaggcaaaattcatcctcgcgcttgatttcagcagataaatccagcatgtaacttttatttaactcaaaactggttttattctctatctttttaattgcgtgaagcatttcatagaactatttttactggtgtaaaaattatccgctttttgcctcttttttgcccattttccgcgtttgttacagattgaaatgtccctgtggctgtggctatatggcttttcgttcgcgcaaaaataagaaagatctatgcaagccacagccaccactctcgaaaacacgcaggaaaccgccccggtcaactcacgcaacaaggttgttgtcgcctcgctcattggcaccgccattgagtttttcgacttctacatctatgccaccgccgcggtcatcgtcttcccgcatatctttttcccgcagggcgatgccgctgcggccaccctgcagtcgctggccaccttcgccatcgccttcgtcgcccggccgatcggctccgcgctgtttggccacttcggcgatcgcgtcggccggaaggtcaccctcgtggcctcgctgttaaccatggggatctccaccgtggtgatcggcctgctgcccggctatgaaagcattggcattgtcgcgccgatgctgctggcgctggcgcgtttcgggcagggccttggcctcggcggggaatggggcggcgcagcgctgctggctacggaaaacgccccggcgcgcaagcgcgccctgtacggctccttcccacagctgggcgcgccgatcggcttcttcttcgccaacggcaccttcctgctgctctcctggctgctgaccgaccagcagtttatggagtggggctggcgcgtgccgtttatcttctccgcggtgctggtgatcatcggtctgtatgttcgcgtctcgctgcatgagaccccggtcttcgccaaagtagcggcggcgaaaaaacaggtcaaaatcccgctgggtaccctgttgaccaaacacgtccgggtaacggtgctgggcaccttcatcatgctggccacctataccctgttctacatcatgaccgtctactcgatgaccttcagcaccggcgcggcgccgaatggcctgggtctgccgcgtaacgaagtgctgtggatgctgatgatggcggtgattggctttggcgtaatggtgcctgtcgccggcctgctggcggacgcttttggtcgtcgcaagagcatgattatcatcaccacgatgattattttgttcgccctgttcgcctttaaaccgctgctgggctccggcaatccgctgctggtcttcgccttcctgctgctgggcttaagcctgatgggactgacctttggcccgatgggcgcgctgctcccggagctgttcccgacggaagtgcgctacaccggcgcgtcgttctcctataacgtgtcgtcgatcctcggcgcttcggtcgcgccgtacattgccgcctggctgcagggtaactacggtctcgcggcggtcggcacctatctggcggcgatggcggcgctgacgctgatcgccctgctgctgacccacgagacccgccaccagtcgttgtgatccttcgccctgacgcccccggcgtcagggctctcctctactttttcatctgcgacaaaatggtccgacactggttgctatcgccctccgccggggagatcagcgccagcagcgcggcggccggcgtcaccagggttgccagcgccgccgctaccgcgccgcggacaatcagcggcccggccttcacccccgcctgcggcgatttaaaggtgccccggacatacagcggggaacgcagggtgatcacccgaaagcctttgctttccggatcgatggtcaggtccagctgctcggaggcgaagctggcggtcccggtcacattgatcagcgcgttttctgtatcgaaggcaaaaatctgcggccgggcgacgccattggttacgtcgatattggccgcggcgcagtttacccgaacctcctcatcgccaaaaatctggccgatcaggtagttaccgacgttaagaccgaggatttccatcaggttgcgactgatcagtccgtcgttcatcagcagcttcaggttaccgttgctgttgccgagcagggccgccaccgagttgccgctgccgcgcagctggacgtcgccattcatctcgccgagggttttctgcatcatctcgacgtttggcatcagcgccttcagcttcaggcgtcgcgcctgcagattggcctcaccctgcagcggctttttatcgccctgcaggtgtacgctgccggcaatcgacccgttggccaggccaaagcgcaccggctgcaggcgcaggtcaccatcctccagaatcacatgggtcgacagatcgctgatcggcagggtgccgccgtgctcaattctccggcccttaaagcgcacatcggcatccatcacctgccacttgtcggtttcaaagcggtccgccggcagcactttacccgccggctgcggccggtcccccgcctggcgcgaagcgcttttcttcgtccctttgccggaatcgacgccgattaatggcccgaggtccgccagacgcagctgcttcgactccatatcgccgctgagtttcggccgcggcttgccggtggtgtaggtcagggagccatgaatgtcgctatcgccgattcggccgttaaaattctgatagttaaagcgcatgcggtttttttgcgtaaagtcggcgcgcaggcggccgtcggtggagaatgacggcgtctccggcagcagcacgccggtcaggtcatagagatcgcgcagcgagtcgccggcgaattttagccgcaggtcaatgccgccgacgttgagcgggtcgctgaccgtgccgctgaacgctacccgggtgttaccggagtggaagtcgccctgcaatgggaagggggcgcttgcgctgcgcagggccagcatgccgccgattttcccgttgccggtgaccggctggcccttgtagcggcccttcagcgacagaccaaagacatagtcgcctggtttcgccgcgctatggctatcttttgtgccggtcacttcgctgaacggcagcggtttgccgaggggatcgacgaggatggtgatatcgctgcgggtgatcttgtcgtcaatggcgatagtcccgcgatcaaagagaatattatcgaggcgaaaggaccagctggagggcgcgctgtcgcccgaagtacgcttatcgcccgccagctgaaaggtccagttattgttgtcttccgccaggcggatcaaccgtacgtcgggctgctccagcttgatccacggcaggtacaccgttttgctcagcagcgccagcggggcaagggtcgcctccacccgcggcaaatggatcatggtcacctggggaatggccggcgggttgcccagcacgatatcctccgcgtgtacgtggggccacgggatccagctgcgccagccgcgctcgtccggctgccgctcccagaccacgccgagatcgccgcggatggcgaacgggcggttaagttcggcggacactttctgattgatcgtcggcttcagccggttccagtcaaaggtggccagcacgataaagaaaagaacgatcagcaatagtatcgttcctgtgatgataaccaacgttttacgggttctgctcatccctactccgctccttttgcatcacgtcagtcctgaatatagtcaaaaagcggcgtttatcctggaaatgcgcttttcgtcacattacgcgcgtcaggtcaaaaaaataatggaacgatgttttaatatgattgaccagcaaaacagcgcagcgcacactagcgcttatatcaattccattgcaggttctggctatgtctaaaaaaattgccgttattggcgaatgcatgattgagctgtcagagaaaaacggggccgttaaccgcggctttggcggcgataccttaaacacctcggtctatatcgcgcggcagacggatgccagcgcattgagcgtccactacgtcaccgccctgggaaccgatgcgttcagccagcagatgctcgacagctggcaacaggaaaacgtcaacaccgatcttatccagcggatggccgaccgcctgccggggttgtattacattgaaaccgatgacaccggcgagcgcaccttctactactggcgcaacgaggcggcggcaaagttctggctggagagcgatcgcgcggcggcgatttgcgaagagctggccactttcgactatctctatctgagcggcatcagtctcgccattctcagcccggccagccgcgacaagctgttcacgctgctgcgtgagtgccgcgccaacggtggcaaggtgatcttcgacaacaactatcgtccgcgcctgtgggccagccaggcggaaacgcagcaggtctatcaggagatgctcgcctgcaccgatatcgcgtttctgaccctcgatgatgaagacgcgctgtggggagaaaaaccggttgctgaggtgatcgcccgcacccacgccgccggcgtggaagaggtggtggtgaagcgcggcgcggatgcctgcctggtctcggttagcgggcaaccgctgcgggaagtgccggccgtcaggctggccaaagagaaggtggtggataccaccgccgccggagactccttcagcgccggctacctggcagttcgcctgaccggcggcgatgccgaatccgccgccagacgcggacacctgaccgccagcacggtgatccagtatcgcggggcgatcatcccgcgggaagcgatgccgcagtaattctccgcacaaagcgctctccggccgccgctggcgcgccggagaggcgttaggttactgccccggcgggatgtcgctggcctcgctgtgggcgtcaaccgtatcggcgctgccgctagccgccgtggccgccggattcggcgccatcagtttttcccaggtggcctgcagttccttcatattgtattccggttcgcccttcggctgttgcagcaccagcgccatgtcctgcgagagctgctggcgcagatactggttcagcatgtccaccgtcagggagttgaggaactcctgacgcagcttctggtactgctccggcgcgatgtccaccacctgattctgcagggagcgcatgcgctggctcatcagaatgtcggtgtcagtgcgcgcataggtggcaaacagcttctgcagctcgaggcttttctgagcgataagcgcgtcaaactcctcctgaggcagcccgttgtcccgcactttcgccagctcgcgcgaaaccacgctcaggttgttgttcaggcgctcgcccggggaatcgatgttgatggcgcactgcgcgcgctgatatagcacccggcagtcaaagccaaggccaatatccttcacgttatttttgctcagactctgctgcacgtgccagaacagcgcttcacgggcgagatcgtcacgccagtagcgctgcagcgccgcggagtcgcggatcggctgccatggcgcatcccacatgatggacagtttgtcctgacgcaccgcgttggtcatgatgctgaccggcacggtaggcagcggcgataaggtcggcaccgctgcgggggtttcccgcttgcccttcagatcgccaaaggtcttattgatttgctcggcaacgctgcggctgtcgacattccccaccacgatcagcgtcatggcgtcgggggtgtaccatttttgataaaagtctttcagctgcgccacgtcgatcggctgcttcagcggcgcggcggggtcatggcccagcatggtggaccctttcaggcgatagcgccaccaaccctctttggtatccagtggccaggtcgccaccatgtcgctgccctgcagcgcatgattgatcgattcaggcgtaatggccagtttaccgctggcgtccgccagccagctcagcgcctctttcaatagatcgttgcggttattgggcaggctgagattaaacatcgtgtaatcgtaggagacgatggccggcggcagaggacgcttcgggtcaatactctgctgccataaagagcgcgcctgcatcgtcggcaggctgccgctttgcgtcaacgccaggcggggaataaagcggctgaaaccgctctgctgagtgctttcgctcagcgagccattattgacggacaaacggacttcgatacggtcgctgggacgttgcggcgtggccaatacctgccacgacaaaccattcgctaaggtcccttgttgccaggccggatcaggctggagcgcttctgcctgcacataaccggccgccgctaccatcagcaaaccgcccgttaagagtttaattgttgtgccctgcatgtgaacccctgatgaacattcctggttacaacagcaccccactgacgggctgccgaaaaaagtgagagtgaaatacgtcggttagaccacacggagacgaaaatgtcgcatgacaacgtaaaataatcatttcgtgtcattcccgccgggcgggaatgacctctaattatgcgcaggaggccgtactccagcaagggagtacgggcctaagaggaggatttaagaggataattcgtgcgttttgttcgccggaacacggttattcagaacgtcatccatctgtttggcatccagttctttcacccatttcgccaccaccaccgtggcaacgccgttacccaccaggttagtcagcgcgcgggcttcggacataaagcggtcgataccgaggatcagcgccaggccagccaccggtaaatgcccgacggccgagatggtcgccgccagcacgatgaagccgctgccggtcacccctgccgcccctttcgaggagagcaacagcaccaccagcagggtgatctgatggaaaatatccatatggctgttggtcgcctgggcgataaagactgcggccatcgtcagatagatagaggtgccatcgaggttgaacgaatagccggtcgggatcaccaggcccaccaccgatttacggcagcccagcttctccatcttgtcgagcattctcggcagcgccgattctgatgaggaggtccccagcacaatcagcagctcttcccggatatagcggataaatttgaagatgctgaagccggtggcccgggcgatgctccccagcaccaccaccacgaacaggatacaagtgatatagaagcagataatcagctgccccagctgcaccagggtgccgacgccatatttaccgatggtaaaggccatggctccgaaggcgccgatcggcgccaggcgcatgatcatattgataatgccgaagataacctgggagaagctttcaatgacgttgaaaatcagctggcccttgctgcccagacggtgcagggcaaaaccaaacaggacggcgaacagcagaacctgcagaatgttgccgctggcgaaggcgccaatgacgctgcccgggatcacatccagtaaaaaggccactaccccttgatctttagcctgctcagcgtacaccgccaccgctttcgcatcgagcgtcgacgggtcgacgttcatcccggcgcccggctgcaccacgttgacgataatcagaccgataatcagcgcgatggtgctgaccacttcgaaatagagcaacgccaccgccccggtacggccaacggctttcatgctttccatcccggcgatccccgtcacgacggtacagaagatcaccggagcaatcaccattttaatcagcttaacgaaggcgtcgccgaagggtttcatttgcgcgcccagttccgggtaaaaatggcccagcagaataccgatcgctatggccgtcagaacctggacatagaggcttttaaagatagaggttttcatagggtgtcctttgggaataaccacagagcaagaagggatatttgacgtctgtggcttaaaaataacaccctggaaacatttcagaaataactaacgccgaaagtgcaacgcaattgttaaaatctttgagctgactcgcacaagtcaacaaaacatttacaaatttgcatcctcccgggccggggagagatagcgcgcgctgaatgcctcctgcggtaaagcgcaaccgaacagatggccctggagcacctcgacgccagcggcttgcaaccagcggcgctgggcgtcgttctccaccccttccgccacgatacgcagcgacaggccgcgcgcgagctggatcatcgccggcaccatgctgacatcctccggcagcatatcgatgaataccttatcaattttcagaatatccaccggcagggccttcatctgctgtagctggtgcaacccggcataacccatgccaaaatcatccagcgcaatctgcaccccggcctcgcgcagcgggcgcaaccgggccatcacatcctgcggatcgtccatccggcagctctccgtcacctcgaggatgagggtacccggggcgatgcggtagcgggcgatcagcttcagcatctcctcgccgcggtcatgctccagcagctggagcagcgaaacattgaccgacagcggcagcataatcccctggctttgccaggccgccagctggcggcaggcctcttccattacccagtagccgaccgggataatcagcccgcaggactcaatgcgctcaatcagcgacggcggtagcgaccagctgccatccgcctgccgctggcgcagcagtacctcggcgccgcagatctcgccgctggcgcaggccacctgcggctgcagccagatcgcgaactgctggttatcgagcgcggtcataatgtcgtgctcttccatcaggcggcgctgagccttttccatctgctcgggatcgaagaactcgatctggtttttgcctttacgtcgtgcggtgacggcggccgacaccgcgcgccggtaaaactgctcggcgctgagcccggcgtggaacatggctatcccgacgctggcgtaggggcgcagctgcagcccatgcagcggtaaacgctcattaataatagtgagcacttgcttacttaacgttaccgcctgccacggttcagcgaggccatcggcgagaatcgcgaagtcatacccgctcacctgagccagcaccatctgcggcgggatcgcggcccgcagcttctccaccagcgtcaggagcagcatttcgcgctgactctccttgaggactccggcggcgtcctgcagggtttcacaggcgacgacgatcagcgcggcgctctgcgggcgggccaccgtctgctccagcatcgccagcaaaaaggctttattcggcagctcggagaccgggaagcgggtcgactggatggacagctcatcatgctggcggaccaggctctgctggttgcggttatagctacgcaccagcataccgatctcgtcgtcatggtgcaggcgcggcagggtcagctgatggccaagacgctcctgctgggagagatcgttcagctcgcgggcgatacgccgcagagggcgaaccatcagccggttgatgcaccaggtgagcgccaccgtcagcatcagcaccagaagtaagtaagcagtcactaacgtagcaagggcgctcatgacgaatttatacatgcgataggagtcggcctgcagcaccagataggccagcggctgcgggttggccggccgctccagcgaataaatgggcagcgaaatctgcaccggcagctcaaacagccgggtgacggttaccggcaccggccgctcggggataaatcgcatccgcagcgcctggaactggttcggcaataccacatccgcccggctgacgatgccagcaggctggatacggcttaaaatggcttccgcttccggaatatcggctttcagaatagccgcagacagcggttcgcgaacggatcgcgcgatactttctaactgcgtggccgtggtaaagcgactctgttgcacaaagtgaaacagcaaaatagtgcaaaaaaccaatacaaaggccatggacacgctcgcgaccatcgccatctgtttgattgtaagtgaacggctgacgcgcaacggtgttctccactgatactgaatacatacccggtatcaatccttcaatcccggtcgtttcaggctgattatatacttaaatccttcgcccacgcccgcgagggatgaagtgacgggatatttccgcgcggtggcgcggacgccgggatacatccccgacggccaacggtgggcaacgcctcacgagtatacgcgaagcgcgtcgcggagtggcgctctgtaacgtaattcagcctattctgctaccagtcggcgtagggcaccagcggctggggcggcatatccagatccccctgccagccggccgccgagtagcggacgtaaagcagcgcatggctcggggtgtaatccttcgcctgctgaatatcgaccgcggcgccgacgaaccagttgctggtcacccgccgctccaccagcgctctggcggtgtaaccgaatccatggctgctgctcccctcctccgtcagctcgctggcgcgctgccggtagtcggacgggatcaggttcagcagcggatagcgggcttgcgtctgggtgcgcgaatgggaccatgacaccgacccgccgagctcccaggaccagttctcggtgcgctgacgccaggtcaccggcacggcgaacgagagatactcctgtgggctgtaatagccgccctggccgagggtgtagccgctgagatctttgtcgtagtgccagatcatattgttgaggccgacggtgacgcgacgattattctcgttgatgaccttgtagtagtacccggtcatccagcgcacgcgccagttatccgccacgtttttaccggtcagcgagtcggcgcccagcgaggaccagatgccgtgagcctccccgcgatcgtagctcaggctcaggccgccgccgtcggcgcggacgccgccccaggtggcgccggtatggctgctgctgtccttctgcccgccaaaggagagcagcgagctggagataggccgccggtggacgttgaccgtgtaccccaccggcccgacgtcgctgctgtagctcagcccccccaccacatcgacgacattgaagcccatcggcgtggtgccgatatccccgctccaggtgtcattcttccagccgaccgccacgctggccccgctgtcggtctgatttttactgccgctggtacaggcgatctccccgcaggtgccccagctgggcgagtagctcccgtcgctgtgggtggaaaaactgccggcatccatattgaccagatcggttcgaaagaacatccggccatccgccagcggagcatccacctgcagcatggtggtatgcgccttcaggtcggaatagccgccggtgccgctggaaccccagaagtcatgttccagggtgacgttcagatcctgctgacgataaaggtcggcggcatcgctgcggatcccgcgcttcagccagtcatcatggctgtcgttgcgcgtcagccgcgtaaaagtatcgttatcctgcggctgcgcgggggtaatgccggaggccaccatcgcttcccggtagtgcgtcagcgcctgctgcggcgccccgctctgggtggcaaagcgcgcggcatcgcgcagcaccagcgcgctctccatcgagggcggctgcgccttcgcctgcggcacaatctgattaaaaatccgttgcgcgtcagcggtatcgccaaggccagctcgcgccagcgccacccgccgctgcatgttcatggattcggtctctgcgcctttcagctgcatgacctgcgcccgggcggccggtttatcgccctcggccaggtagacttccgcaaggccgaggcgcgcatcgccgttgtcggcctcctgacgcagcacccgctgatagtcggcaatcgccgtctggctgtctccgcgctgctgcgcccagtcggccagcgtcagatcatagcgcaccgaggcgggctgccgtttgatgagggcgatcgcctgggcttcgttaccgctgtcgcgcagctggttggcctggcgcagcacccggtcgctttgcaggcgcgcttcgagttcacgaatgttatccgtccacgcgctgcgcggcagagcggcgatttgcgccagagccagatcgtcctggtcgttccccgacaggtagagtcccgaggcgtagacccgttcggcgtcctgcggctggcggttgaccatcgtccgcatcagcgcgtcggcctcctggcgttcgccggcgctgaccagatcccgcgccagacggtaggttatccagacgctgtccggatccagcgccaggcgccgacgctgaacttccgccgcctgcgcccagttgccctggctctccagagcctgcgcctgtttctccagccggtcgttagtcaggctgcgctcaatatcatcgatactccgccgctgagcgggagggaggccggcgatccaggcgctggcttcctccggcgattcggcgcgatagaggttggccaggccgcgcaccgccaggttattgccgcgatccaggcgcaacgcctgctggtaatagcgctccgccgccgccgcctctttgcgcgccgccgcgacgtcccccagccccagcacggcatagctgtcggtgcgatcgacccgctgcgcctgggcataatagttctgcgcctgcgaaagctggccggctttcagggcgttatccccctgctttatcagcagccagtagcggttagtttgcagcaggctgtcccacttgccgcggttcgggctgtcagggtccatggcaatcgctttactgagctgcgccactgcccgcgcgcggtcgccgcgctgggaataggcctggccgagagcgcccaccgcgtcgctgtcgcggctgtcggcctgaacggctttctgcagatccgcgaccgcctgcgtggtattcccggacctgaccgccgccagcccttccgagcgggcgcggaaagtcggatcctgcagctgcgcctgctgttggtcgagcagaacgcgggcgttcgccgccaccgagccggtgggaaactgcagaagaaattgctgcaacgcctgcacgctggccttgctcaccggcatgcttttcacctcactgaaccacatatcggcggcgataccgcgtcccgaggccgatcgggccatctccgccagataggcgaacccctcctgcggtttgttatcggcgaacatctgcttcgccagcgaagtcagcaggctgacgttgcccggcgcgctggcgttcagttttttcaactggctgacgccttcgctatggcgggacggcaggcgcgccaccagcgtccagtattcaatggcgacgtcaacgtcatccggcaccccgccgtacagtttttcataggcggcgatggcttcatcgaccttcccggccacgcccagcagtcgcgcctgctgcagcgcctggcggccctcgccggtgttgcttttcatctcattgcgcgacgccttcagctccggggagtccggcgccagcttcgtcagtcgttccagctctttttgcgccccggcggcatccccctgacgcagcagatagcgcatccgcgcggcaatcagctccgggttgttgggatcaatcagctccagacggtacagcgactggcgcaccaggtcttcacgattgctggcctcgccgaggcggacctgctccagcagatgctcctgggcaggcgtcgtcgccgcctgcgctaacggcagcagcgcaacgccgagggacagcgtgagtaaacttagtgagagcttgcgcattcctggttccagtcaggttgtaattcaccactcgccgtgaaacgaaaacggtgttgatcccaaccctggccgaacagcgtcagaactgcgctgtagtaggcatccgcgccgggatagttatcggcgacgcgctggcgttgcaccgaccgggcctcgtcgtcctgtaaaaacggcagcattgccgcggagaagcccactggcccctgaccgctggttttgccggtggcgatattcactttctccgggggtaccccctgcttcgtggtctgcgccgccatcggcgtgaagcgttgcagcagacgcgctttctgcttatcgccatcatggagcatgcccacccacaggtagacgcgaatcgcgtcatagctgccgatcggcggcttttcggttttcagctgccagcctttccctttctcatagcgcacccagtccggggtaaagcctttcggcgcggtctccagcagcaggcgcaggttactatcgcgcagagcgggccacggcgcgccaaaacgcacaaagtaggtggccagctgcggcggaagatagctggggttaaaccgccagccgctgtcatcggcaaaaccgacttttcccggcagcagcatcgtgccgaggcccggcaccgccaccgtctcttcagcgacaatccgcgccagcagggcttttccggtctcggtgtactgcggctgttgccacaggcgccccgcctccagcagcgcccaggctatccacagatccgagtcggacgccgagttgctgtccagcagggtccactgctcatcgtcctttttgccccacagccagcccggcaaatgttgtttcagatcgccttccgccaggttgttctgcgtccaggtcagcagtttgtcgaaccccgcgcgatcgttggccgccagggcgaaaaacaggccatagctctgcccttcggaggtggagattttgcgcgcatcgctggggtcaatcacccgtccctcggggctgacgtacgcttgtttaaactgctcccaggcgggccactggcaggcggcgcccacctggcccgccgccagcagcagcgccgagagcaccgcgccacaaagtactttcatcatggtttactcatcatccaggctaagacggcggcggctgatgatgcgcagcatgcgccacagcacccatgccagcagcacaatgctgatggcggcgaagatcgccagcagtatcgggtggttagagagcgcgaaccagatgcgctcgaaccagggcagatgacccacgtagtaaatatcccccacccgcagactgttgacgccggattcgcggatcaccgccaccgagccaaacatcgctgcccgcttaccgctgtcgttgagggcgttggtcagcagttcattaccgcgcgggctgtcggccagcagggccaccacgctgcgctgatcgttatacggcgactggaagccaatcaccgtcgccatcggcccggaagaggtaatgtcggtgcgggtattgggcgtgcgggcctcatcgtcgggataaatgctcgccaggtcatagtggcgcatcggcattttcacccagcttttggtcgcctcgaccagcaggttgattttggtgtcgtccttgagcgacgacgggatcgcgccgatcagcagcagatccgcgtctttattcttgatctggttgccatcgtcggtcatctgcagattaatcgccgccagaccggtctgcgagccgatgccccccagcgcctgcagcagcgtcgccacctggccctgggtcggcgccttcggcaccaccaccagcgtgtcggaaaggtccgccatacggctgtaagggaagcccgcattggcgaagacgcgcaggtccggcaaggcgataaagtgataatacttcgagaagtcgatggtcgaatcgtcgccaatcaccacatggttctgcaccggctggaaggtaatacagttgtcgatggagccgccgggcatcgggttcatatactggaagtcaaagcgcagctggttgaccgccccaagacgcagcgcggggatggtgacctccgatttgccgtccagcagcccctgcagcaccggcaggcgcaggatcagtttgttcacgtcctgggagctgttaaggctgaacgactgcaggaactggtcgttgaggctgatatccatccgcgagctgtccttcaccggcggcatggtgtagcggtatttcagatccatatcgatgccgttggcccgcagcagatagagatccggcggcaggttaagcgccacggtgatggcatccggcaccaggccgctggactgcagctgttgctcataggttttcagctcagcgaaggtgaccgagcggtcggtgcgcacccagttcggcgcgtcgtaaggctgacgcggctgcagggttttgatgccgtccacggtgacgctgctgccgcggaacagaatattgccctgagcaatccccttcgccgccagcagcaggtcgttatcatcgcggccgaaaatcaccagcagcttgacgtagggatcgttcgggttgtcgatcatttcgatggtcggcgccttgaccggcggatgatcgcgcaggaagtccggacgcttgtcgttggtggcgaagacaatggcgttacgatccggcagttcattgaaatagaccgggaactgctggccgcgccagccggccttgctgccgaaccaggaggcgactatcgccgccgcctgctgctgggtgaccgctggcgagcccgggaaaatcatcggcagcttcagcggacggttatcgcgcggatcgtagaacggcaccgggaagtgtgacagatcgttatttaccttcagcgactggtaggtgagatccagatagctttcgcgtccgacgtccagccacagcgtactgctggccgggttttcgcagacgtcgcggtagtggccgacaaactccagccgtacgcggttgaagtcggtgatgtacagcgggtcaatcggcagctgcgcgcggatctttttccccagctgctctttagtgacgggcaggacgcccatcagctcatcgttaagatagaccttcaactgcgactgcacgggcagcagcgagggcgatggggtgtattccagattgagcagcgcgttggcgaccagctcatcgctgcgcatgccgaattcgaccgacgcgtcaggccgtgagccgcgcagcacgatgctgccgggcggcggcgcgatggtggcaaagctcagcttcacctcccgctgcggcacgttctcggccaccgccgccggagcggtcggttcggcgagggtcgccgtcggctcgcccaccacgatcggcgcagccggggtcgcggcctgcggctgaacgccaggggcagcattcgccaccgcggccggcgccgcataagaggccagtggataccagctgcacatgcccaccgctactgcacacatccaggaaagttttcttttcatcgcattatcatcattgttgagccattgccgggtctgcggagagcgtcggcgcggcgcgttcagggcgtcggggtacaaacgacgctatccaggccaccagcgaagtgagcgcgcggaaaaccaccttcaccgacggcggcgaaaactccgccaggtgacgatagccacgaaagcccagcttgaggatatccagcaggctttccatcggcttatcttccgggaagctatcctgccaaagcgcccacgtatcagcgcgggcaaacgtacactgcacaaaatcgatatgctgctggttggttaacggcagcagctggagccccacttcgctgccgttgacccgcgcgaccctgaccgggaaggcatactcctgctgtccccgtttgagcagcagcctggcgttctggccttccagcacctgcgcgtcgccgttaattttgatccccagtccgccgtcggaatagtcgtggacggtgcaggagaacaggtgaccatcttcgcgggcgatagccgccggcatgctcatttcgacacggtgcgaacggcgaacctgcttgctttcaaccgagaccgccaccgcgccgccaagaataatcaggttgtagaatacccagacaatactcacccagacggtgaggatttcattttccgggccgtacatgaagcgccagatccccaccgcgacgccgaccagattgagcagcaccaggtagatatagggccgggagatcacccagtcgacatactcctcttccaccagcccgcccttcgcggtgacgttgaacttgcctttatgcgggttgatcagcgccacaaaagtgggcggcgcgatataccaggccagcaccgtctcgtaaatttcactccagaacgaatggcgatatttgccctgaatcttcgagttggtcaggctggcgtggatcatgtgcggcaacacgaatagcgcgatcatcagcgctggcgcataaatgatataggcatggagcagcaaaaaggccagcggcgccgtgagaaagatgaggcgcggaataccggagagaaagtgaagcatggcgttggcgtagcagacgcgctgcaccagcttcaggcctttgccaaacagcggattatcgaggcggaatatctgcaccatcccgcgcgcccagcggatgcgctggccgatatgcgcggataaactctccgtcgccagccccgccgcctgcggaatacgcatataggcggaggtatatccccgccggtgcagacgcagcgaggtgtgggcatcttcggtcaccgtttcgacggctatcccgccaatttcgtccagcgggccgcggcggataacggcgcaggagccgcagaagaaggtggcgtcccacatgtcgttcccgtcctgcaccaggccgtagaatagcgtcccttcgttcggcgttttgcgaaaacgaccaaggttgcgctcaaagggatcgggcgagaagaagtggtgcggggtctgcatcatcgccagctctttctctttcaggaaccagcccatggtcatctgcagaaacgagcgcgtcggcacatggtcgcagtcaaagatcgagacgaactcacctttggcatatttcagcgcattattgatgttgccggccttggcgtgttcgtggctggtgcgggcgatatagtgcaccccaacatctttggcaaactggcgaaacgcttcccgtccgccgtcgtcgaggatccagatgttcagcttgtccttcggccagtcgatgccctgcgaggcgtaaatggtgtttttcaccacgttgagatcttcgttataggtggggacgaagatgtccacggttggccacaaatccatgtcctccggcagcgacaccggctggcgattcagcggccagaccacctggaagtagcccagcaccagcaccacccaggcgtaggtctctgcgaacagcagaatgatcccgcacaccaggcttaccgggtcgttccagttcagcgtcgaggtatagcgccaccagatatagcggcacgacaccgtcagcgacagcacgatcagcatcagcgccgagaaacggcccgggatgcgtcgcaccagcagcgccacgccccacagcagcatcaggaagataaactgcgacagcgggttaaagggctgcgtaatacacatcagcgccagcaccagcgagcagaaggtcacccccccaaggatcgcccggcgcagtttaggattgaggtgcgccagctctttctgtttatccagatggccggtgcgggcgttcatctgctcaggcaatttttccagccactgcgtatagcgaccgtgcaccccttccagcgccgccagcgaacgccagttgacctttttctccggctccggcacgcgcgtcgtcagtaaccacagggattgcagcaggtagcgcagcggatccagcggacgcgggcgatgcggatttatgtggggaaaataggtttcatggcgggccagaatcgcctgccagcgcggcgtctccagcggcatcagcgcccagaccagcgatgcccacagacagccaagcgacgccgacagccacgaagcgccgtgctgccgatagtcatcatagcgcgcacgcagccgctcccccaccggcggggccagcagcagcgtactgaggcggatcatgccgctctcccggcggaatagtggatcaggcaccagttcgccagggtcagcacctcttccgccgccagcgaatcctgacgatactccccaagaggttgtttcgccgccaggcactcggccatcgcctcgtcgcggtgaatcgtcaccggcaggatgcgcggctggctctccagccacagctggtagagatcttcctgcagctggctgccgacccgcagatcgttaatcagaatatcgccgttggccgggaggggctgctggtgtagacggatatggctattggcgtcgggatgaaccaccaccagcgagcgatcgcaaagcgtcagcagctcgcgggtcaacggcgaataacccgccggcagatccagcagcagccagcggtactggccctgtagctgctgtactgcctccgctatcgcccccagggtgggctgcagctggtcgacattttctctttcgccggcgctgagctggccaaacggcagtagatcgatatgctgcgtatagcgcaagcccgcgtcacgccagtcccggccgtcgagcagcgcccgcgcccagccgtcctgatgatggatatcggtattaaagaaaaagcgcagcatattatccgggctggcgtcgatcgccagcacgctttcaccgagcaattgcagggcccaggcgagtgcagccgtaatggacgtgacgccagttcccccgcgcacgccctgtaatcccagaatagccatctccggcttccttattttttctctgcaaactctgccagcagcggccagcgcttcagcgccgcgttcagctgttcgcgcctggaaatatcatgataatcaatatccggcagggaaaatgcccggctaagcgccagaaaatcattttgaaaggtgtaccccagcgtggcgtccgtgggtaccgcaggatcttttgctggcatatctctgtccgttcgaaatttattattaaaccagaggacgtatacagctcatccttaaaagcaggtgtacatgctaaaactgatgacctttaatttcaatgttaggtttactctgtcggtttcgctagtaaacttattcagtgtcaatcagggcgcacgagggatgccgtggataatgtatttactttgggtatttcatcattatgggatgaagtgtgccatatgccggtcggcggagtatggtggctcaacgtcgaccgttatgccgatgccgtcagcctgtttaatcagacgctggccgcgcaggcgaaaaacagccacgttgccgcgctggttatgggaaacaaacccaaggatatcatttcattagatcatattcacggtccggataatatcgcgctgttcaccctgccgaatcgcccccaggcgctggaggaaatacaccgcgatttagtctgctccctcgaacctggcaattatttgtttattctgctatgcgctgaaaatgcctggcaaaatataaataatgaaaagttatgcgcctgggtagaaaagaccagccgctgggcgcaatatcaccgttgcgcgttcttagcgatcaattccgcgcaggatatcgatcggcagctgactcccttattacgtgagtaccgctccctttccggactggcaagtattcgttaccagggcgaccggcatatctttgatattgcctggtggggaagcgataagggtatcagcgcccaacagcagctgatggtgcaacatgatgacgccggctggcgattagcgcaggacgctgaaaccagcgtgcagccgcgcagcgacgaaaaagcgatcctcagccatgtgcgcgtgctggaaggcgccccgccgctgtcggaatactggacgctgtttgacaccaacgacgaggtcttcaacgccgggcgcaccgcgcaagcggcgacgatcctcttctccattacccaaaatacgcaaattgaacagctgggccgctatattcataccctgcgtcgccagcgcggtacggcgctgaaaatcatcgtccgtgaacaaaccccgagcctgcgcgcgaccgatgagcggctactgctcagcagcggcgccagcctggtgatccccagcagcgcatcgctctcccgctgcctgacgctaatcgaaagcgtacagaaccaaaagttctcccgccatatcccggaagattttgccaccctgctgacctggagccagccgttaaagctgcgcggctaccagaagtgggatgccttctgcgaagcggtgcacaacgtgatgaccaataccctgcttccacccgacagcaaaggcgtgatggtggccctgcgcccggcgccggggctgcgcgttgagcaggcgctgacgttatgcaaacctaaccggatgggcgacatcatgaccatcggcaataaccggctggtgctgtttttgtcgttttgccggatcaatgacctcgataccgcgctaaaccacattttcccgctgccgaccggcgatattttttctaaccgtatggtgtggtttgaagacaagcaaatcctctcggaaatcgtaatcatgcgcggcgtcgagccggcgcgctggaacacgccgctgcctctctcggtcggtaaaaacgagaccattaacgccacccacgatggacgccactggcgacgctaccccgaaccacaccggttaaccacccgcgaggagcaagcctgatgatgtctctcgccgatattctgcaactggtggtgctctgcgccctgctgttttttccgctgggctacctgacgcgccactatcagcgccggatccgcacgacgttaagactgatgttctttaaaccccgttacgtgaaaccggcaggggtattacgccggggaacaacggttaagcaaggcaaagcgaacaaatgacaaataaaaaaacgaccgcggcaccgcttccgctctggcagtactggcgcggccttggcggctggaacttctactttctggtcaagtttgccctgctgtgggccgggtatctcaatttccatccgatgctgaacctggtatttctcgcctttctgctggtgccgatcccgcgcgaaaagctacaccgtatccgccactggatcgctattccgctgggattcgcgctgttctggcacgatacctggctgcccgggccagagtcgatttttagccaggggtcgcaaatcgccggcttcagcgccagctatatctgggatctgattgtccgctttatcaactggagcatggttggcgccttctttgttttactggtgctatggttgtttatcagccagtggctgcgcgtcaccgtgtttgtctcggcaatgatcgtctggctggcggtcagcccgctgctgccggcctttaccctatggcccgccggtcagcccaccacggccgccgccacgaccgcacaggccaataccggggccaacgccgccgctggcgccgcgtccagccccgccaacagcgatattccgccgcagaccgagccgccgacctcagccaacctgaccaactggctgaacgctttctatgccgccgagcagaagcgcaagacgccgttcccggaccagctgccggcggatgcgcagccgtttgacctgctggtgatcaacatctgctccctctcctggtcggatattgaagccgccggtctgatggatcatccgctatggaagcactttgatattgtcttcaaaaactttaactccgcgacctcctacagcggcccggcggcggtgcgcctgctgcgcgccagctgcggccagctgtcgcatactaacctgtatcagccgtccggcgccgactgctacctgtttgaaaacctggcgaagctcggcttcaaccagcagctgatgctcggccataacggtctgttcggcgacttcctgaaagagctgcgttcgctgggcggcatgcagagcccgctgatggaccagaccggtctgccggtcagcctgcaggcgtttgacggctccccggtgtatgaggatctggcggtcctcaaccgctggctgaagaccgaagaggccagcagcaatccgcggaacgccaccttctataacaccctgccgctgcatgacggcaaccacttcccgggacaaagcaaaaccgcagactacaaagtgcgggcgcagaagctgtttgatgacctggataacttcttcaccgagctggagaaatcggggcggaaagtgatggtggtggtggtgccggaacacggcggcgcgctgaagggcgataagatgcaggtatctggcctgcgcgatattccaagcccgtcgatcactaacgtcccgacggcggtgaaattcttcggcatgaaggcgccgcatgaaggggcgccgattatcatcgatcagcccagcagttatctggcggtgtcggagctggtggtgcgcgccctcgacggcaaaatgttcagcgaggacagcgtcaactggcagcagtatgtcgccaacctgccgcagagcgcggcggtgtccgagaacgccaacgccatcgtcatccagtatcagggcaagccttatgtccagctgaatggcggtagctgggtgccttatccgcaataagcgacaaggccgcctatgttggcggccttacatcgtgagacgttcccattccaccttctcagcccgcaggcatacgggcggggaaggcggcaaatcaatcaccgtatttagcgctgatcctgtttcgccagccagaccaacagcttgaggctggcagagtaataatcatccttgtcgtcaatctgcggcgcctcctgcggttcacccagcgtcagatcgcgcaccgccagcaggccgccggccatataccagggggccacctcgttggtgctgacgttgatccacgccggggtttgcaggcgcgggtaactctgcatccaggccttccagggcgcgagcaaggcgctgtgcggatcggcccacgagagatacagcgggatacggatcgcatcgaaactcatccgcggcggccactctttggctggcagcatcttgccatccgcccgcagcgccacccagtcgctgggtagatgtgatttcccccagcccatctgccccagcagcgcctgtccgtcgctctgcaatgtccgccaggcggtgagatgcgtccgctccgcgaaggcgcgccaggccgggaagatgaaataggaagggttaaggttcaggtgatcattgaggttgaaccctttcacgcccgggagcatcacctggcgaccggcgaaagtcaccaccgtagacttcagcagggcggcggtgatggcgtcagaggcaatcgcatagcgcttatcctgccactgcttttgcgcgcgcagcagcgcccaggcgatcagggtatcgccatcggaggcgttgtttttatcggcgatagggtccggcgccaccgggttatagcgccagtaaaacaacccgttagacttgttgcgcagggtgttgtccgtccactgccacagcttgtcgaacgccggacgatcgttattcgccaccgccaggagcatggcgaagccctgaccttccgtatgcgacacattgccattggcggtatcaatgatacgaccatccggcatcataaaacgggccttatagcgctcccaggccgtatccgcccacgccctgggcaccagcatcactaccgttgtcactatcaccgccactaaagcacgcaggggcataaattcactctttatggatggtagtagagaaactgaacgtcagagacggagaacacccgctcacgctgcagtatcacgtgggcactgcctccctgactctgcagccagcgagaatataacccctcgagtatggcacagaacgcgttgcaccagcgcacgcgccccgcttcgtcgcggctgaccggcaacgcctgatggcgcaggcgcaggccgtcctcaccgacatcgatggtcaccacgccccagtgaaaatgagtcagcagccggttgatattggcctccagatcccccaccgtctccgacgccggcagcggatgggtctccgccagcgaggcgcccatctgacgcaggaagggctggctttccagctcgccggcattatttagcataccttcgatcataataatcaacagatcgaaccatccggcaggcgtctgctgctgctgaaaccaggtcatcaccaccgggttattgttctccgtcatcatcaatgatctcctaacatatagcgaatatagagcccggcggtgctttcgttataatccccgaaggtgtcatagccaatctggccccccagggtcatttgtttgttgaccttgtaatccgccccggcgcgcagggtataccctatgccgctcttcgaggtcgcggagtagtaggcttccttggcaaacccattgctcaccgccgtctccagggtctgttgccactccgaattggtcgggaaataggcgctcttatcctgactgtaagactgatagcccaccgagccgccgagcttcatggtccagttatcatatttctccgtcagactgaccggcagcgatacgctgacgtagttttgcggactaaagtagcccccctgaccataggtgaagtagctgaggtttttggagtaatccatatagctcatgctcaacccggcctgcagctggcggtattcgtcatggtagggacgaagatagaccccggcattggcgttgatactggtgttgctggcgacgttctgccccagatagctgtatccaccgccgccgacatagaagcccgcgtcgccgtcgtcatagctcagctgcagggtgccgccgtttttcgtcacctgcccccaggttttcccggaataggcgtctttcagacccacgtaggaaagcaggctgtcggttagcgagcggcgttcgccggtgaggatcagcgacagatagttggtcagcttgggcgaccatttcaccccgccgactacggtattaagatcctggcccaacggcgtgctgccgatatcgacccggtaatcgtcaccgcttaacgccagcgccagttcgacgccgttggccttctgcgaatcggtcgagccgctggtctggtcaacgttcggcttgcggctggacgaagagagatagctggccacctgccccgcatcatagctcccgagcttcgccaggttttccatcccgctgctggtggtcggattgaaatctgccgcgttcagggtgccgaggccgcttaacgcctcggcccctggattgctggcgaaataggccgtccgctccgcctcggtcatcgaggcgatcgccgcctgctcgctggtggcggtactcaccatgttggagaccgcgttagccagcgggttggcgccgtagcgacgccaggcgtcgccgctggcggtcccggcgttcaacgacaccggggtgacggtaaagtcaaagcgcgagtcgccaaacggcgaggatgaccaggtcagcggcgtccggagctccgtcagcttgctggtgcccgattcgccgtcgcgtccacgcacgtccattcccccctgcagccagctgccggttttctcctgcagcgactccatcatggtgtccacctgacgcagcatccgcgtctgggcggtgtccaccggcagatcggtgcgctggatccccggcagcgtggaaccgggcgcggcggccgactgggcaacctgccacggcatgtactgcccgtaggcggaggccgtccgcgtcggcgccgacgtttgcgacacgccgataaaggggttatccgccgccagcaccccgccgacggtcggcgtttcgctactgttggtgctttgcatgcccagcagtttgccgcgggcgctgcgcagataggtcatcgcctgctgatgatgtccctgggcctccgccactctcgccagcagcagcaggcgatccggggagttatcctggcgcaaaccgccggccagctgttcagcgcgatcgttgttccccgccgacagcgccacgtcgatggccccggcgcgcgcatcctggttcggcgtatcgcgcgtcatcaggtagtcatagaccaccccggcctctttgttcattttgccgctctggtacagccgcgccatggcgaacatcagatcggtattttgcggatcgctttgcatagcgcggatcagcttgtcatacgccgcggcgtaattgccctgctcgcgcaggcggtcggcttcgttgatcacatagccattgcgaatgctcgccagctgcgtcggcgtactgctggcctgcagctgcggattgctgatcaggttctgcgcctcgccggtcagcccggcctgattcaggacggcgatctgatcggcgtaatccccggcattgccggatacgccgctgctgatattgttgcgcaccagcgagaccgcggtggtcaggtcgccgctctcggccagcagacgcgccagcttgccggcgtccgccggggcttttggcggcgtggaggccatcgcccgcagggtattgctggcggcgatggtattgccctgcgccaggtagttttcggccgtcaccaactgcaggttgtagttcacccgctggcgcaaatcgcgcatgtcgctggtctggctgccgccgggaatgcgcgccagcagcgtctgcgcctgctgccaggcgccgttttcgctggcaaacagggcggcggcatacagcgcactgttgctggcgccggggcgataggccgccgacatcagcgaagaggcctcgctgccgttacccgatttttgcagcagccgggccaggtcgaggcgcagccagggatcgtccggatagcgggcgacgccttcgcgcagggtggcaatggcgccggctgggttaccgctgctgacctgcgcctgggcctgacggcgcagggcatcgcccggcataccggccaccacccgcggctgcagtttttgccgcaggctctgcgggagcgtctgcagcatcgcctgcgcctcggcggatttattctgctcgcgcagcacgtaatagaggttttcccgcgccgccgcgttctgcggatcgtcatttaacagtgagcgcagcgtttgctccgcctggggcaaatctttgttgtgccgcagcacatcggcgcggaacagcttcgccgaggcgccctgcgccccgctctgctgcgccaacggcgcggagagcgccagcgcctggctgatattgccctgcttataggcctgctgggcctgcgccagctggccgtagaacagcgcatcggccgcctgctgacgacgggtcgccgaggcgtcgccgccgaggtccgcggcccggctcaaatactgcgacgcggcctggtagtcgccactgcgctgcgcgatatagcccatgcccgccagcgcatcggcatcctgggggttggtctgcaatacctcttcaaactgctgcttcgcggcggcggtattgccgctgttgagattggcgtagccctggccgcgcgcctgaccgctgcgccgttcgcgaaagtaattctgaacttcgctgtcctggggatgccgctgcatccaggtgtcgtaatactgctcatccccggcctgcgggcccagccagagcagcgcctggcgcaagccgctgtccgcctctttattgccgctggccatcggctcgagcagggcgatcccttcccggcgagtctcttcccgccaggttaatgctttgcccaacgccacccgcggggcgttctcctgcggatgctgcgccacgtactggcgcagctcgctgatagcctgcggatagagcgatttgtcgctggccatggtcaggtaatattctgccgccagcccggcaggcggcgtattgccattgaacatgctgcgccaggtcgccagcgccccggggatattgcctccgcgcgcctgctggcgggccaggctgagctggccctgcggcacctgcgacatctttttggcgttgtccagatcctgtagtcccgggctgtcaggggccgctttcgccagccgcgcgcgccactgcgccgccgcctgcatatcgccgccctgctgcgaccagagcgccatcagatacagcgcctgggtgttgttggcatccaccgagagcaccttctgcagggactccatcgccagctcgtcatgagatttctcatgccagtagttggcctgagcgaacaacgcctgtagcgccgcatcgttccccgccgccagcgcgccgcccgaggcagcgagagtcaacgcgccggtgaggcagaacgtggtgagccgacgggtgtttttcatcgttattattatttttcttttcattggttatcccccgaacccagacgcttacgggcgtgacgtttaaacatcgcggtcagcgccagtcccattatcgaggtggcaatcagccccagcaccgccaggaaacctgagtgctggctggcataccagaccgccatcatgtaccacggcatctgaccgctggggaacggcgtactcacctggaagctgcgcaccccgttatcgctggtgatcaccgcggtatcgccgcggatcccggcgttaatgcgcggcgattccagatcggtcttcagtcgcgccagctggtcatcattgctggccagcgccaccaccaccaggcgggtggaattccacggcgagcgatagctgatgaacccgcgccaggcgctgctcgacgaaaagtagcgatcggcgtcgaggctggcggaagtccagtcgccggtgagccggcgctggactttttgccacaagtctggctcgcggacgctcagcacattatctaccgggcggtagggtgagtcggccagcaggctctggttaaaggcctgctgatcgagagcggtgaccgccagcacgtcacgttcacgcagcgactgcaaatcccccccgccggtgggcatcccgagcacgacgcggttattcgccagcgcggtgccggtcgcgttcccggagcgtgccgccagattcagcagggtcgccacctgggtttcagacgggtccgccggcagcagaagggtcgtctgcgaatagtccgccagccgcgagaaggggaacgaggcgccgacaaagtaggagagattgggcaacagcgagaagtgacgcgtcttgctcaaatcgatccaggagtcgtcagtgatccggctcttgatattgttattcagcagcaccgaacacggaacatcgtcctttggcaccacattgaagtacatcgacagctggttatcgccgtaaatcaggtagggcgccagcgggatggtaaagcgctcctggcgcgcatcgcctccgaggtagcgccagactttctccagcggcccctgcttgttcatcggcaggttgttgaggaaggtgccgttgagcgtgacgctcagcaaggacttgtcctcattaatccagctttccgacgggaagcggtagccaacctgtagcggaatggtttccccatcccacagatagagatcgggcgcggcgcggaaggcgatacgtaaaggttcgtgccagacgccgctgacggtcgggctttgatccttacgcagcagctcgctgagcttgaccggacgatcggtggggatccagcgcggggcatcatatgctttgccaaccgggatggtctgcggttcgacatccagcgtcgcggtttgcggcgcaaagttgccgcgggttaaccgccaggcggccatgcgcagcgccgtatcgtttttaccgacaatcagcagcagtttataggccggattggcggggttggcgatgatgcgcagcagcggcttatcggtttccggcagcatcatgccgcccacctgctcccccggatggccaatcacgatgccgtggcgttccggcagacggtcgcgcagagcgctgaaggcaatgccgcgatagtccgcctggatacccagccaggaggagatcagcgccgcggcgctgaagacgtccgccgacggcttgtccccataggcgaccgcaatgtccgccggggtcatctgcatgctgtcaaagaagggccgcgggaagtggctcaggtcgtcgctgatgttcagctgctggctttcccagctgaaatgcgacgtgggcagcaccgtcacccgcgacgtatcatgaatgtcacgctggcactgcagggtatcgccatcgttgatcttcacgctcaggttattgctggagaccatcagcgcgggcggaatatccagctgataatgggagacatcctcgccatcggcgcccagcggcagcgtgccgagcggttgaccgttgagcatcagctgcagggtggcgttgcggctcgccatctccggcgatacgcgaacggcaaggctgagctgagaatggatcaccacctgatcggcaggcagggtaaagctgaccccaccctgtcgctggccgccgctgaggataatcccgtccggcatccccatctgcgccagattcagatcgcctccccagaccggagcgacaggaatgacctccggcgcggccgtgccgctcaccggcgggggtaagtccggcataaccggcgcaggggccgtcgccgccgcatcgccggcggtggcgggggctgccggagaggcgccctcctccagcgaggcagccggaggttcgtcgcctggctcgctgtccgccgcgtcgttgagctgcgggaagctcagcggggcagcggagccggagcccggttcttcactgtgtagcgcaggcgcagagagcatccctgccagcagcgccagcgtggttaatcgcttcataacgtcccatcctcctgcgccgttttcgccactgttgcccgattgcgctggctgcgacgggttttccacgtcagccagaacagttcgaacacgcagcgtaaaatggtgaagaaggagcggaacgggttatcctgcgggcgcggcggattaatccacgcatccgcgcgggccagcaccacgcgcaccagttcacggcggcgcgaaagcggaatatcttcatcaaacttgaggcgcaggaagcgctcgtcagaggtgaccagctgggccggaatcgagatagccccggactgcaggatcagctcaatctcttcgatgtcatcctccagatggcgattatcaggcgcgaccacgcggcagccgcccatcgacaggtccgcggtatggctgcgcgagacgatgccgctggcgtaatggatcaccaccggaatatcgacatcgatacgaatggtttttcgcacctgccgcgtttcgcgcgccacggcaatcgccgccagcaggaagatcagactgtagatcccccacccgacgttgagggcgataacgttgggatccgagccaaagtagtcatggccaatcgcccggacgatgccgaccaccacccccagggccagcaggcaggccaccaccaggtgcgggcgcaccacggtgaaatcgaagtagccgacgtcaagcagcccccccttatcggtaacgttgaacttgccgcgtttggggaaaatcatcgtcaccagagtcggcagcaccaggtggaaggccagcacaatatcgtagatctccccccagaagctgtagcgatagcggccgttcattcgcgaaccgacgtaaatagcgaggaacaggtgcggcagggcataggagacgatcaggctcgccgacgagtaaataatattgaggttaaacagcaggtaagccagcggggcagtgacaaacaccaccctgggcagcgcgaactggtagtagagcatggcgctgagatagcacaagcgctgctgaaaagtcagcccgcggccaaacagcggattatcgacgcggaaaatctgcgtcatcccgcgcgcccagcgggtacgctggatgacgtgcaccaccaggcgttcagtagcgagacctgcggccagtgggatatcgagaaaggccgacttccaccccagacgctgaaacttcagtgccgtatgagcatcttcggtcaccgtttcgacggcgaaaccgccgatctgcgccagcgcctcgcgacggatcaccgcgcaggagccgcagaaaaaggtggcgttccagttgtcgttcccctgctgaatcgggccatagaacaacatcccttcgttgggaatgttgcgtccgacggagaggttacgttcaaacgggtccggggaatagaagtagtgcggcgtctgcaccagagccagcatcgggtctttcaggaaaccgccgacggtggcctgcaggaagacgcgcgtggcgacgtggtcgcagtcgaaaacgcagataagctccccctgagtcagggtcagcgcatggttaaggttccccgctttggcgtgcttgttgtcattgcgggtgatatagcccacgccgacgtcggcggcgaagacggcaaactcgctgcgcttaccgtcatccagaagatagattttcattttatcttttggataatcaatgcattgtgccgccaggacggtatcgcgcaccacctccagcggttcgttatagctcggaatatagatatcgaccgtcggccacttactcatatcatccggcagcggaacaatgccgcgcttcagcggccagaccgtctgcagatagttaagcagtagcatcacccagatatagacttccgccagaaagagtcccatgccgagaatagcttcaatggacgagttgaagtgcagggtctgcgtgaggcgaaaatacatgtaacgggtggacatcagcagcgacgtgacgaccataatgaccgatacgctgcggcgcttgctgaagcccatcagaaagagaataccgatacttaacagaccaaaaatatactgcttttggctgtccatcggcgtgatcaccaccagcacggcgacgggtgacagcaccagcgccagcaaccaaaaaagagattttttcattcagcagccctgcaaaaagttaacgccctgacatgcgtggctggctgtgcaccgtgccatcgccaatatgaatacccaacagcgaagatatttttttagccatgatttcaatatcgaaggccgctgccgaggaagcgttaaagtccaggatcgacttctgcgaggcattggcctccaccacgctttcatcacgatggatcacgccaagcagtcgctcgcccagtttctcttccatcaggctggtgacgtcccggctgacctggcgacggctatcgctttggttaatgacgaaatagtgcccgtgcttatgattcagcgccgcgccggtcaggcgctgcttttctacgtgcgccagggtcgacatcgaggcggtatccgccagcagcgggataagatgcaggtccgccagccccgtcagcgcctttagcgcgggcgaaggtccagggggcatatcggcgatggtgataagcccgggataattaagcagcgcggacagaccgcgctggaggaaatggtcattatgggtcagttgctcatcaaacgcctgacgctgcgcctcgctcacttcgccatatggcaggacgaaaatattactgccggcgctcaacacgcactggctccagtcgtgcagctccagcgccttcgccacatagccccgctcatcgttcagcggtacgccaaaatgcaaacgcagcgcgttctggacatcaaaatccagcgccagaactttgctgcccgtccgcgccagcgaataggctaaattggccgccagggtcgttttccctacgccgcctttcggtgaacagacgcaaatcaacggcatgtcgcgatcctttccagaagtgatttcaaaggctggtctttatttttcgccaccggctccgcgcttttcgcggcgaacaggtgggcatagttctcggcggcgggcgcgggtcggggggccattctcggcggcggcgccatggccggttccgacgccggaattgaaggcgcaggggtcggcgcaggctcctgcctgaccggctccggtgcggctgcggcggtctccactaccggctgggaagtagcaggcgcggccgaagcggcagacacaacaggatcagaggttggcgccgctgctacggccgcctctacctggcggaacagatccgcgggcaccgactgcggcaacggcgcggagaccgagcctcccagcgccagagaagagggtttctcggcgccgggatttagctgattgaggatcgcccagtcgccgtgttcccgcgtggcggcttgcgaagaaagatcctgaaagttgaggttttgcgtccgcgttttttcttgaaagcgctgcagatcatcataatggttcattgataacctcatgattttaaaaatttcatattaagtttgttgttattttctgggtatattaaaaatatcgtgacgcttctgggatggcagataacgcgccgatggtgacgtaccaatacacacgattgacagggttataatagtttagaatttgattttcgggatgattccacggcagaagtatcgctacactaacatttcccttgcagaagggtagccccattttttaggtatgcgtacatccttaacttcccgcaatcaccacgcttcccagtcgtttttatataaaagtattaggtcatgatgaaatcatagcgtcagatcagcgaaagaataaacctgaaccattttaatttctctttaattctataaaaatggactgaaaggcttattttttcggataatctacgaagaatgctctgagagcgtgacataaactgcggcaatatgcgtaagcgccaggttttatccacggcgggagagaagctcccggccatgggaccgggagcgcgccatcaggcgtgggacttttgcggattctcatcctggtcgacggcaaagcaggccaccagctggccgccgtaatccttcagctgcggctggagctgagtgcaggggccaaagcgacggcgacagcgcgcgttaaaggcgcagcccggtggcggatttagcgggctcggcagttcgccggtcagcttgatccgctcgcgccggtcgtctgggttcagacgcggcgtcgccgacagcagcgcctgggtgtacggatgacgcggattgttgaagatctggtctttggtgcccttctccacgcagcggccgagatacatcaccatcacttcatcggcgatgtgctcgacgaccgacaggtcgtgggagataaacacgtaggacagccctaaatcctgctgcagatccatcatcaggttcagcacctgggcgcgtaccgaaacgtccagcgcggagaccggctcatcggcaatcaccacatctggatccagcattagcccgcgagcaatagcgatacgctgacgctgaccgccggagaacatatgcgggtagcgatcgtaatgctcggttttcaggcccactttcgccatcatcgccagcgctttttcacgccgctgctctttgctcaggctgctgttaatcagcagcggctcctccagaatctgccccacttttttacgcgggttcagcgaaccataagggttctggaacacaatctggattttttgccgccgcagcttctgcgcctgcgggtcgtgcttaagcagatcctgcccctgataatagagctcgccgccggtggggatctcaatcatcgtcagcagacgaccgagggtcgatttgccgcagcccgactcccccactaccgccagcgttttaccgcgctcaagggtaaaggagacgccgtccagcgccttcaccagccgttccggggcgaataaccccttcttcaccggatagtgttttttcagatcaatggcctgcaacagcggttgtggcgtggcggccttttgcgtactcataatccaggcctcccggcatcatcgagtgggtagtgacatttagactggcggccgccggtcagatccgcgagcgccggctcttcgctacggcatttatccgtggcataggggcagcgcggattaagcaggcagccgttgggacggtcatatttccccggcaccacgcccggcagcgaggccagacgcgctttatcctgggcgaattccggcagcgcgcgcagcagcgcctgggtataaggatggcgcggcgcgcggaagatatctttcgcgtcaccggtctccaccacctgacccgcgtacataacgataattttatgcgcggcttccgccaccagcgccaggtcgtgggtgatcagcaccagcgccatattctcctgctgctgcagatccagcaggagctcaatgatttgcgcctgaatggtcacgtccagcgcggtggtcggttcatcggcaatcagtagttttggccgacaggcaatcgccatcgcgatcatcacgcgctggctcatgccgccggaaagctgatgcggatagacgtccagccgcgaggccggatcgggaatgcccaccaggttcagcaggtcgatggcccgctggcggcgggtttgcttattaccgccctgatggaccttaatcgcttccataatctggtagccgacggtgaagcacgggttgaggctggtcattggatcctggaagatcatcgccacttccgcccccaccagctggcgccgctctttttcagagatgcgctgcagatcgcggccgttaaattccagtttgtccgccatcacccggccgggatagtcaatcagccccataatcgccagcgagctgacggatttaccggagccggactccccgacgataccgaccacttcaccctgcttcacgctatagctgatgcggtctacggcgcggaacggcgcgttttcatcgccgaaatgcaccgataatttatctacattcaataacgccatctcgaacctcttactgcttcagtttgggatcgagcgcgtcacgcagaccgtcacccatcaggttaaatgccagcaccgtcagcaggatcgccacgcccgggaaggtgactacccaccaggcgctctgcgcgaactgcaacacgtcggaaagcatggtgccccactccggcgtcggcggctgcgcgcccatgccgaggaaccccagcgctgccatgtcgagaatggcgttggaaaagcccagcgacgcctgaacgatcagcggcgcgagacagttaggcagaatattaacgaacatctggcgcatcgcgccggcgcccgctacgcgggaggcggtcacgtagtcacggttgacctccaccagcaccgcggcgcgcgtgagacgcacatagtgcgggagcgccacgaaggttagcgccagcgaggcgttgacgatggagggcccgaagattgccaccagcaccagcgccagcagcagactcggcagcgccagcataatatcgacgacgcgcatgatgattgagtccaccactccgccgaaatagcccgccaccaggccgagcaccacgccgaggatcagcgacagaaccaccaccaggcagcccaccagcagcgacagtcgggcgccgtacatcaggcgcgacagaatatcgcggcccacgtcgtcggtgccgagcagatgcgccatgctgccgccgtcctgccagaacggcggcgccagcagcgaatcacggaactgatccgccgggttatagggggcgaggaagttggcgaataccgcgatgacgatcatcaccaccacgtataccagcccgacgactgcccctttgttgcgtttgaaatagtgccagaactcctgcagcggagtcatgggtaccggcgcagcgataactttattttcagtaacttgtgacatgatggccccttacttcttatgccggatacgcgggttcaccacgccgtacagcaggtcgaccagcaggttgacgaggataatcatcgtcgccaccagcagcaccccgccctgtaccaccggataatcgcgacgctgcagcgcgtcgatcagccagcgacctaaaccaggccatgagaaaatggtttccgtcaggatggcgcccgccagcagggtgcccacctgcagaccaatcaccgtgaccaccggcagcatcgcgttacgcagcgcgtggatcacgatcacccgcatccgggtcaggcctttggcgcgcgcggtacggatatagtcttcgccaagcacttccagcatcgacgaacgggtcatacgcacgatcaccgccagcgggatggtgccaagcacgatagcgggcaggatcatatgcattaaggcgtcaataaagtcgccctgctcgccccagatggcggtgtcgatcagcataaagccggtcagcggcagggtatcgtcaaggaacaccgtatcgctgatacgcccggagaccggcgtcaggtttagctgcaccgaaaccagcataatcagcatcatgccccaccagaagataggcattgagtagccggtcagcgccaggcccaccgcggtgtggtcaaagatggagccgcgttttaccgcagccagcacgcccaccggaatgccgacggcgacggcgaagatcatcgcgcagacgcccagctcaagggtggctttaaagcgtgggacaaactcctgccacacgggaatgcggcttttcagcgagatgcctaaatcgccgtgcagcacgccccagatatagtgggcatattgctgccacagcggcttatcaaggcccatttcggccagcagctgcgcgtgacgttcgggggaaataccacgttcgcccgccataatcatcaccggatcgccggggatcatatggacgaaggcaaaggtgagaagggtgataccgataaatgtcgggatgactagtcccagacgtcggagaataaactgcaacataacccggattctctctagtgacgccccgcctggcgacagggcgtctgtattgctcacaaaagcattccccggaatagcgggaatacgccccccgcctctcccacgcggggagagggggtcaggcatcgtgcttattattcgacagagacgttatcgaagtggtgtttgcccagcgggtccaccacatagcctttgacttctttacgcaccggctcatagacggtggagtgagcaatgatcagcgccggagcctggtcatgcatcactacctgagcctgtttgtacagttcaatacgcttgttgtggtcgtcggtagcgcgggccggctgaataagatcttcaaacggcttatagcaccagcgcgagtagttggagccgtctttcgccgcggcgcagctgaacagggtcgcgaagaagttatccggatccccgttgtcgccggtccagcccatcatcacgctctggtgctcgcccgctttcgcccgcttcagatactcgccccactcgtaggtgacgatcttggcctggacgccaatcttggcccagtcagcctgaatcatctccgccatgcggcgggcgttcgggttgtacggacgctgtaccggcatcgcccacagatcgatggtgaagcctttttccaggcccgcttctttcagcagctgcttcgccttctccggatcgtaggtgtagtccttaacgtcgtcgttatagccccacatggtcggcgggatcaggttcttcgccgcctggcctgcgccctggtaaaccgctttgatgatcgcttctttgttgaccgcgtaggtcagcgcctgacgtactttcacgtcgtccagcggtttcttctcggtgttaaaggagagataaccaacgttcagacccggctgttccagcagggtaatgttcttatcttccttcatgcgcgcgatgtccgccgggttcgggtacggcatcacctggcactcgtttttctgcagcttggcatagcgcacggaagcgtccggggtgatggagaagaccagacgatcgatcttcggcttggtaccccagtagcccgggaaggctttatacagaatgcgggaatctttctggtattgcagcagctggaatgggccggtaccgataggattgagatccactttttccggcgtgccggctttcagcatgttgtcagcatactctttcgaaagaatggaggcgaagtccatggccagatcagcgaggaacggcgcttccggacgggtcaggacgaactggacggtattatcgtccactttcttcacttcgctaatcaggtccggtaagcccatcccttcaaagtattcatagctgccgccagaaactttatggtacgggttattagtattcttctggcgatcgaaggagaacaccacgtcatcggcgttcaggtcacgggttggtttaaagtctttattatcctgccacttcacaccctgacggaggtggaaagtataggttttgccatccgcactgacttcccatttctcagcaagtcctggaataacttccgtcgtaccggttttaaattcgaccaggcggttatagatcggtacggagctggcatcataggtggtgccagaggtgaagagctgtgggttaaatccttccggcgagccttcagaacaataaaccagggttttcgcttgcacgctggcggcgacggtcatggcgaccaggctcagaccaagcttcagcatccctgatttcttcaaggaaatactcattattctgctccaaaattgtgatgttgtttgcatatatccgccggacctttatttattttttacccggtccggtcggtggtgcccgaaggcgtagagagagatggggattcctttcgcaaaaacgactgagttgcagtacggattctccatgaaatgcccctcatgccctacaatctgtcaacagaatggggaaacgtcaatacagccagccgggttttacatccagcgtgagaaacggcaggcaaagattaaaaaaacttcaggacgctattttcagcagagaaatttatgctactggcaattcagcagaataaagaccttattaatttgcaacacccagtgggaaacaatgccagcaaatgagaaaaatttcttgctgtgtgaccaatatgtgagcgattaatagcgtgaacgttaaaacgcacagcggaaaatgctgcattcagccataagcttcgcgaaaaaagatctgttcatcgataaaaaaatgcaatggaagatgtcacaaaatagcgaatagccggctgaaaacctgagtaaagacgtttattgtgattttggtggtatttttggccagtcgtgcactgatgatgcccggcggcgctgcgcttgcgcgggcctacgaaacgcgagtcgaacctcctgccaccggaggttctcatcctcgcaggctccagatgcaaaaaagcctgctcattgagcaggcttttcgaatttggtcggtgatagaggattcgaacctccgaccccttcgtcccgaacgaagtgcgctaccaggctgcgccaatcaccgaatgcggggcgcatcttactgctgggatgcctacccgtcaatgccttattttcaaaaaatcgctcaaccggcgagaaactcagcagcctgagcagcgaatcgccggttgctcaacgtttttagcggcagttgacctcaaacgttttgcgatactcggataccttacatgtcaccggctcgccgagataggttgcgcccgccggggtgaatgtaaactctcccagtagcatcgtcagctcccccagctccgggcaggattgctgatgacgcataatatccgggcgggtatcgttattcaccgcccgggcgatgtcgctgtatgccagcttgtcggcaaaggcattagcacaaaactgcagttcgctttgcgccatatgcgcggcctgccccttcagctcggcatgctgtgccagcagcagctggcgaacctcgccggcccggctgtagccaatcgccgtatagccggccttattgctgaggttgacgctggcgccagccgcaagcagcgcctcgacattggctttattattcattttgaccgccagcatcagcgggctgagatcgttggcggaaagctggtccacctttgcgccgcgctgcgccagcgccgcgatcaccgcaggcgccccctgccccgccgccacctgcagcgccgtgagtccttcacggttcggcttatccacttccaccccggaggccgacagcgccagcaccagatcgggatcatcccccgccgccgccagcatcagcggtgtggtgccggatttatccgccaggctggtgtccgccccggcgttggccaacgtcgtgatggtttccgccgatcgcgcgtgatcgacagcgaggaaaaaggccgattccccggacgcgttgacggccttcacgtccgcgccgtgcttgaggagcagcgccacgatctcgtcgacgttcttcttaaacgcgccgggcgccagttgtaacgccatgtcttcggtcatcagcgcgcgattgcccgtcgccagcgatttcgccgccgttgcgccaactatcttgtccagcgtactctcctcttcgacaggcgcatcgggctttttcatcgccagaatatgctgatagtcgtttctgacgtccccgccgtcggagatggcggacatcaatgccgtactcttgtcgatggaggtctgattcaccgacgctcccgcctggagaagatcgccgataatcgcggtatcgctgccacgcgccgccgccagcatcagcgccgtgacgccctggcgcgtctggaggttcggcttcgcccgacgcttaagcagcaattccaccacatcgcgacgattttccgcagcagcgaccatcaggccgcttaagccggttttatcctgaccatccacatcaatgccgttatccagcatggctgcgatcgtcgctggcgcatcgtatttacaggccagcaggaactggctggtctcttcctcagactggcagcccgcgagcatcatcaggcacagtaggaccaacccctttatcaccttcatcctttctctccatgaaaagttcatgcacaggggaagcgaggaaacaggggtaatcaaagaagaagaggtcacctgccagacacgtccactgtgcgaaaaaaatccctcgcgcggcgtcagccggcgagggattagcttatcctgggctcaggaaaggaaaacagacccgagaatctgaaaactatcgggccttactttttccaccggcaccagttgttgttctcattgatcccgccatccggcgaggtatagccgaggcagcccataatggtgtcgtacagctcgacgtgacggcgcggcaccttcatcgcagcctgctgctgcagatgggcaaacgcggcggcgtgatcgggattttccaggtacttatccgacatccacaccatcatcggcacgcggaactgctccggcggcgccatcttgcgcggcgtaccgtgcaggtgttcacgctcgttaatcgactccccgtggtcggcggcatagaacacaatcgctttcttatcccgcagctggtcgaggacgctgacgataaagtgatcgacataggtcacgctattgtcgtaggaattgatcagttccgctttcgagcacttgttgtcgacgccgacgcactccggtttccactgggcgaagctgcgcgggtagcgttgggtgtagttaaagtgggagcctttggtgtggagaatgatcagatgcttaccggaggcgttgccctgcgccataccgcgcttcatctcatccaccagcagcatatcgtcaacgctcttaccgcggttgcgcggctcggcgccaatctgctcgcggtaggcgatattgttggccatcgtgttgctgtagaaccacatctcgctctgcatggcgtacagattgccgctgaagcccagctgatgcagcacggcaaagacattctgctctttgagcgtccgctgtgggttatcttccgccccgccctcgcgcacaaacatgcagcgtaacgacagtttggtagcggtatcgcacgagtaaccgcggaaggcgacgagattcttctctttctccagctctggcgtggtattgcggctatagccgaggatgcccatatggtcccagcgggtcgtttcgccaatgataaacaccacgtaggtatcatccagaccttccggcgcgacgtaggtgaacttcttcgccgggttaatcagcgatttgttgtctgaggattcatccacctgcgcccaggcgtacagtcccagcgccgacaaccagttcgacggcaggtaagagttggcgatcaccccgccatagctcggcatatccacttccgaatggcgctccacatcatgctggcgcagctctagcaggcggatgggtccccagacaattagtccggccagcaccacgatcagcacgtttttaacccgctggcccggggtacgcagctggcgcagcagcgtatggcggcagcggttgctccagatgaacagcaacggcggcgcgctcaccgccaccagccagaggatcaggtgccagccgatgacctctttcgacaggtcgatatcggtggtcatcaccgaagcgataatcccgtagccaatcaccacattgaggaacgtcatgtagtaactcgccgcggcggaaaacaggacaatcagcgtcgccagaatgcgccagatacggcggccgaacagcgacagaagacgtaacaggaagaaggtgacaaataccgtggcaaccagttcaacaacaccggaaagccctttccagaaagtgaactcttgagcataaccatcgaaacgccggaaaaaaacggcgacgttcataaaccagccgatgtacagcgccagccaaaaactaagcttctgctgcgtcatcgttctaatatatttcatgcaagcaaacctggaaaaagaagaataaaacaccgcctgacgctgtggcacgagtcagtaggctaatagggtgcgttagggttggttatcagaaacctctacaaaccgcgataagtagaccacagggaacgagaaaagtatcaggagggaatgtgatccagccaaacatttacaaaacatttggctggattggcactatttgcttagggaaataaccaggggcacgtttcacgctgcaggtttcaggcgtgcgcctcgttatataccgtgcttttcggctgacgaatggtggtggataacgccagcgagaggatcagcagggcgaagatcacgcagaaggtcacgtagaaaccgccgaacagcgaagcgatgagagagccgcagatgctgccgataccgaagcccagataaatcacgccatagtttttcgccagattgttcagaccaaagaactcactcaccagcgacgggaagacggtaatggtgccgccgaagttaaaggcgacgcaggcgatggcggcgaagaaggtcaaggcattcagcggggcgaacagcagcgcggccatccccaccagcgacacgacctgaccgatggtaatcacgcgaatgcgggagattttatcagacaggatacctaacaccaggcgaccgctgaggttcgcaatcgagataaccgttaccgcgttggccgccgtggcgacatccaggtggaccattccctgggcaatatccttcgctacgccaattacgtacagaccgctcatgcaggccgtcaggaacatcaccgccagcatccagtactgcggtttacgcatcgattcggcgagggtgaagtcgttttccacgacgccgttggccgcggtggctgccgagtgatttggcgcatctttcatcagggtcgcgccaaagacgatcatcaccagcacgatagcgccccagataacgaaggttttttccaggccaacggtggccagcaggtgggaatcaatgaatttgaaccccaggctgccgagaccataggagccaatggagaaggcggagatcagccctttacgttccgggaaccatttcacgcagttcgacagggtcagcaggtaaccggcgccgtccgccagccccaccagcacacccgcgctcagccacagcatcatcaggctgctggagtgcgcggtcaggaagaagcccaggccgagcaggatcccggaggccatggtgacgcgcttcacgccaaagcgctcctgcagcttgccggcgaccgacgaagagagcgccagcccgaggctcagcagaccaaaggaaaaagccacctgactgaccggctcgcccagtttgtcagacagcgaactgttaaacaggctccaggtataaaccgaaccgagagcgaattgggtgatgatggtgccgatcagtgtcagccagcgggtcgattgacggtttgcagcgttcatagcagttgtcctgataaattaactgccgccacaatagcgaaggcccctcatccagtgggggaaaaaggcatgaactgccatcagcggggaatgaaatgcattaatgttggaatgaatggcattgcataacattcattccgtaaattacaggcaaaaagttagtgtgcgctatctcacagaaatgcgccattgctgagatttaacaataaccacatcgtttcaaatgcgtaacaattcccgattaaaaattggcgctgacccccatcaaatagagcgtattttcccctgacggcaggttatccgcctgcgacagcgttgcccatgccgccacgtgggatcccaaccgcatatcagcgcccagggtgacatcgctccagcctccctccctggcacgggtcatcggcgcccagacatcgctggcgagcgactggttatagctcacctgcgcccagggatgcacgccccacagcgcctgataatccatgcgccagccgagcgtgttaacgtagcccgcctcgcctgcgcttctcaccgtcggcgcggtgacgtcgctgcgcaggctggccaccggcccggaggttacgccgtttgccagcggataattccagccaacgctcaggccgcggccgctttccggcggcgccagcccctggtttaacgccagcccgccgggcgtctcagaggacttcatccgctcggcgagaatatcttcataacgtggttggtgatcgctatcccatgtatagcgttccgacgtattactttttgtatcgatagcgatatattcctgttgccaggcattcgctccagagacacatgacacccagacggatacgctcgccgggatcaagaacccccggaggccattgcatttctttattatcattaatgcgactccagaaaagagccgaatcggcaatattgctgtgtttttagtggggatacgatttccctgtattaactattatctttatctttcagccgtcaaggcgggcgtccacttttttagcgcagagggagaaacagctatgcagcgttgcggatgggtgagtcaggatccgttatacatcgagtatcacgataccgaatggggtgtggcgcaaaaagagggtcgccagctgtttgaaatgatctgccttgagggccagcaggccggtttatcgtggatcacggtgttaaaaaaacggcagaactaccgccaggcttttcaccagttcgatccggtgcgcgtggcggcgatgggtgatgacgatatcgagcgactcctgcaggataccggcatcattcgccatcggggaaaaatccaggccattatcggcaacgcccgcgcctatctggcgatggaagaaaatggcgagtcgttcactgattttgtctggtccttcgtcgacaatgcgccacaggtgacccgcgctgcgacgctggcggaaattcccgccacgacgccggcctccgatgcgctgtcgaaggcattgaaaaaacgcggctttaagtttgtcggctcgacaatctgttattcctttatgcaggcctgtgggctggtcaacgaccatgtcaccggctgcttctgtcaccctggaggtcaggatgatccgcaagtgggacactaaagataccgcgccgctgctggcgctgtggctggacagcacgattcatgcccatccttttatcagcgaaagctactggcgcgacagcgtcgcggtagtacgggatgtctatcttcccgccgccagcacttgggtctgggagcaggatggcgagttaaaaggctttgtcagcgtgctggactcccgtttcgtcggcgcgctgtttgtcgcgccgggcgccacccgccagggcattggccgggcgctgctggatgaagtcaaacagcactacgcctggctgagccttgaggtttatcagaagaacgaatcggcggtcagtttctaccatgcgcagggcttccggattgaagactgcgcatggcaggacgatactcagcacccgacgtggattatgcgttggccggcggatcaaatgccgtaagcggcagcgccgggccggtatatttctccagccacgccagggcggtgttcccggcacagccgttgcccagccgggatgtcggaatatctttggttaagacgttcaccgccccgtttttgcagatgccgacctgcggatccaggtcgggccacgctccttcatgcaggcaaatcacccccgggcggatcccctccgtcaccacggcgccggccagcacctgaccgcgggcgttccatacccgcaccagatcgccatcgacaatcccgcgcgcctgcgcatcctgcggatgaatagtcaccggttcgcgcccggcgacggcatagcgctcgcgcagcgcggtgtggttcagttgactgtgcagacggtgggccggatgggccgacagcagctgcagctgccccgcctctgcgttgccatgccactcgtcgggctccagccacatcggatgcggcggacagtcggcgtaaccaaaagcggcgatggtcggcgagtggatctctattttaccgctcgccgttttcagcgggttggcctggggatcggcgcggaaggcggcgaaacgcgcaaaacgggcattctccggctcctccggcatctcaatcagctggttagcctgccagaattcggcaaatggcggcagcgtcacctgctgctgggcgccgcgccgggcggccatctgatagaaagtctccagccactgcaaatcactcttcccttcggtgaagcgttcgcggccacccgcctcccagcgttcgctgaggtcggcaaagaccgcgaaatcgtcacgcgcttcatctcgcggggcaaccacctgcttcatcggcaccagatgctggttactgtagtccccggtcatggtcagatcgttgcgctcaaacgaggtggtcgccggcaggacgatatcggcatggcgcgcggcggcggtccagaagcattcggaaataacgataagctccggtttctgccacgcctgaatcagtcggttggtgtcctgatgatgagtaaagttggcgccgccggcccaccagataaagcgaatatcgggaaagcgccgcgccatgccgttgtgctgatactccgcccccggattctccagcgcctcgacaattcgtgcgaccgggatcttctccaccgcgtccacgcctccggccacgctcccctgcatcgagcccagcaccgccgcgcggcgggtcgggttgccgccgttggcaaaatggtaggaaagaccaaatccgccaccgggggtgccgatctgtcccagcatggcggccagagtgaccagcatccagtgtttctgctcgccatactgctgacgctgcatgccccagccggccatcagcatagtggtattttcgtggaaaagttgcgccagttcgcggattttatctgctttaacgccgcagatcgctgctgcccactcagcggttttcgctacgccgtcgctttcgccggtcagatagcgggcaaaaatatcgtagccgctggtgcagcgggtaagaaacgcatcatcctgccagtcattttccaccagcgtatgggcgatccccagcatcagcgcgacgtcggtgcccatatgcggcgcgatccactccatcgaatcgccaaagaaatcgacggtttccgatcgcatcggatcgatgcagatcagccgcttaacgctctggcgcagccgatcaaaccaccggatcccttgctcgtcggaggcattccaggcaattttcagcgtgttcagcgggttggcgctccacagcaccaccacttcgctgtgctcgagcaccaacggccaactggtctgctgctgatacacctcattgccgccaacgacgtaaggcatgatcgcctgcgccgcgccggtggagtaatcgccaagatggccggtatagccgcccgccaggctcatatagcgctgcagcagcgtcgccgccttatgcaatacgccgttagagcgccagccgtaggagccggcaaaaatggaggccggaccgtagctgtcgcggatccgccgatgctgggcatcgatcagatccagcgcctgctcccagctcacccgcacgaattcatcctgaccgcggaccccctggggcttgtccggtgaagcaaggaagcctttacgcaccattggatagcgcacgcgggttttgctgtgcacctgatcgcgcactgccgtttgcagcgagttggcaaacggtgtcgccagcgcgccgcgggaagagaggacgttttccccgtccgtttccaccagcatcggtccccagtgggcggcggttaagatggttttggttgcagatgaggttggcaagggcggctcctggtcagcgaatgcaggtgtcatgacggcgtgatgggcaaccgttcaatgttatttacaaaaagagatggtatccggggaattttctccgtaatcgcgcgtcataatcaaccgtcacgttcgctgtgacaaagaataaaaaggattaaggacattaaatgaaaaaacgcgtacttatgattgcggcgctggtcagcggcactctggccatttctggctgcaccaccaacccctataccggtgaacgtgaagcaggcaaatccggtattggcgcaggtattggctccttagtgggcgctggcgtcggcgcgctctcctcttccaaacatgaccgcggcaaaggcgcgctgattggcgcagcggccggcgcggcgctcggcggcggcattggttactacatggacgtgcaggaagcgaagctgcgcgacaaaatgcagggaaccggggtcagcgtgacgcgaaatggcgacaatatcgtgctgaacatgccgaataacgtcaccttcgacagcaatagcgccaacctgaagccggccggcgccaacaccctgaccggcgtggccatggtgctgaaagagtatgagaaaaccgccgttaacgtggtcggctacaccgacagcaccggcagcaaggatctgaatatgcgtctgtcgcaacagcgtgcggacagcgtcgccagcgcgctcatcacccagggcgtggcggccaatcgcattcgcaccaccggcatgggcccggcaaacccgatcgccagcaacagcacggcggaaggcaaagcgcagaaccgtcgcgtggaaatcaccctcagcccgctgcagtaagcgcaacctcatgtcgcccggcagccgttctgccgggcaaaatgcttgatatcgctatttttcgcgctaaggtgttggcagattttcagcaaaggaagccaccatggcgaaagcggcgcgtgcaactatcagcgatgtggcgaaagccgcaaagaccggcaaaaccagcatttcacgttatcttaacggcgagaagcatctgctttccgacgacctgttatcacgtattgaaaaagccattgccgaactcgactaccgccccagcctgatggcccgcggcctcaagcacggccgaacccgcctcatcggcctgatcatcgccgatatcaccaatccctactcggtcaacgtcatgagcggcattgaagcagcctgccgggaaaagggcttcaccctgctggtgtgtaataccaataacgagctcgatcaggagctgcactacctggacctgctgcgcagctaccaggtggaaggcatcgtggtcaacgcagtcggtatgcgggaggatggcctgaaccgcctgcagcagtcggccctgccgatggtgctgattgaccgtaaaatccccgacttcgcctgcgatgtggtcgggcttgataacgcccaggccgccaccaccgccaccgaacatctggtggaaaaaggattcgaggccatcctgtttctcagcgaaccgctgggctcggtgaatacccgtcgcgagcgcctgagcgcctttcgcgccacgcttgcccgccaccacggcgtggtggccgaaaacgccgaggtgcagcttaacgacggcgcgatgctggacaacgtcctgcgtcagttccatgcccgccaccgcgggatgcgcaaagcggtcatctccgccaacggcgcgctgacgctgcaggtagcccgcgccctaaagcgcgtcggcctgatctgggggagcgatatcggcctgctgggcttcgacgaactggagtgggcggagctggccggcgtcggtattaccaccctcaaacagccgacgtggcagatcggctacgcggcggtcgaacaggttattcggcgcattgccggcactaacgaccccatccgcgaacgggtattttccggcgagcttatcgtccgcggatcaacctcccgttaacgatccttcgtgatgccgatcataaattaaacatctcgccctttcttatggaaccgataccatctagcgtattaaggagattaagcaacaaacgccgggagtaagagcgcgatggccagaaaaattattgtcgttaccgctgcgtatggtaatgaccatgttaaatccttaggcgggcaggccgccgtcctgccgtttatcgccaacgccggcgcggacggcgtcgaaatccgccgcgagctgtgcagcgcggaagaactcaacgctctgccctcgctggcggccaccattgagcgccacggcctgctggcctgctactccgcgccgcaggcgctgttcaccgacaacggcgagcttaacccggatctcccgacgctgctcgcggaagcgcaaaccctgaacgctctgtggctgaagctctcccttggccatttcctccacaatcagcagttggatgagctgcgcgatatcctcagcgacagcggcatggcgttggtggtagagaatgaccagaccgactgcggccagctggcgccgatgcagcgcttcaaagccgcctgccgggtccatcagctgccgatcaccttaacgtttgatatgggcaactggctgtgggttggcgattcgccggaagaggcggcacgtcatcttgcgccggcagtcagctatattcatgttaaagcggcggagcctcatcatgagaaattccgcgctgtaccgccggatcaggccgccgaacgctggctggccctgctcgataatcttcccgccgacgcgccgcgtggaatcgagtttccgctgactggccatgacctgacggccgtgacccgccgctacgtcaacctgttacgcgaggattaagtcgtggaaaatttagatgtcatcaccatcggcgaagctatggccatgtttgtcgccaccgaaaccggggatctggccgaggtggagcatttcatgaaacgtgtcgccggcgccgagctgaacgtcgccaccggcctggcgcgcctgggtctgaaagtcggctgggtgagccgcgtcggcaacgacagctttggccgcttcgtactgcaatcgctggcgaaagaggggatcgatagccacgctgtggccatcgacaaccgcttcgctaccggtttccagatgaaatcgaaagtcgaaaatggaaccgatcccattgtggagtatttccgcaaaggatccgcagccagccatctttcgccggacgattttcgcgccgactacttcaccagcgcccgccatctgcacctaagcggcgtcgcggcggccctttctgagagctcttacgcgttgctggagcatgcggcgaaggtaatgaaagccgaaggaaaaaccctctctttcgaccccaatctgcgcccggtactgtggaaaagcgaagccgagatggtggagaaactcaaccgtctcgccttccaggctgactgggttttgccaggcttgaaagagggcgtgattcttaccggccagcagaccccggaagggattgccgatttctatctctcccgcggcgtcaaggcggtagtcattaaaaccggctgcgacggcgcctggttcaagagcgccagcggcgaacagggaacggtcgatgccattaaagtcgataacgtcgtcgataccgtcggcgccggcgacggctttgccgtcggggtgattagcgccctgctggaaggcaaaaccctgcttcaggcggtgaaccgcggcaataaaatcggttcgctggcgattcaggtccagggcgacagcgaggggctgcccactcgcgacgcgctgggcgagtaacttttctacgcaacgataacagccgtcctgtaccctacctgcagcgcggcacagcagcgtccgtttcgacggacgtatgtctcctcattgacagaggcaagcctatgaatagctcaacaaatgcaacgaaacgctggtggtacatcatgcctatcgtgtttatcacgtatagcctggcgtacctcgaccgcgccaacttcagcttcgcttccgcggcaggcattaccgaagacttgggcatcaccaaggggatctcctccctgctgggggcgctgttcttcctcggctacttcttcttccagatccccggcgctatctatgcggagcgccgcagcgttcgcaaactgatctttatctgcctgatcctgtggggcggttgcgcctccctgaccggtattgtgcataatatcccggcgctggcggcgatccgctttatcctcggcgtcgtcgaagccgcggtgatgccggcgatgcttatctatatcagcaactggttcaccaaatcagagcgctctcgcgccaacaccttcctgatcctcggtaacccggtgacggtcctgtggatgtcggtagtctccggctacctgattcaggccttcggctggcgggaaatgttcatcatcgaaggggtgccggcggtgatctgggccttctgctggtgggtgctggtgaaagataagccgtcgcaggtgtcctggctggcgcagagtgaaaaagcggcgctgcaggaacaactggatcgtgaacagcaaggcatcaaagcggtgcgtaactatggcgaagccttccgctcccgcaacgtgatcctgctctgcgcgcagtattttgcctggagtatcggcgtatacggctttgtactgtggctgccgtcgattatccgcagcggcggtgaaaatatggggatggtggaagtgggctggctctcttctgtcccgtacctggcggccaccatcgccatgatcgtcgtctcctgggcctcggataaactgcaaaaccgtaagctgttcgtctggccgctgctgctgattggcggactggccttcatcggctcctgggcggtcggcgccaaccacttctgggtctcctacaccctgctggtggtggccggggcggcaatgtatgcgccttacggccccttcttcgccattattccggaaatgctgccgcgcaacgtcgccgggggcgccatggcgctgatcaacagcatgggcgccctgggctccttctgcggctcgtggtttgtcggctacctgaacggcgccaccggcagccccgcagcgtcctatatttttatgggggtagcgcttttcgcctcagtatggctgactttgattgttaagcctgctaataatcaaaaccttccacttggcgctcatcacgcctgaacgactcatactacggagattcgcatgaagccgtctgtcattctctataaaacgcttcccgacgacctgctacagcgtctggaggagcacttttccgtcacacaggtgaaaaacctgcggccggagaccgtttcgcagcacgctgaggccttcgcccaggctgaaggcctgctgggctccagcgaaaaggttgacgccgcgctgctggagaagatgccgaagctgcgtgcgacctccaccgtttccgttggctatgacaacttcgacgtcgaggcgctgaacgcccgccgggtgctgctgatgcataccccgaccgtgctgaccgagaccgtcgccgatacggtcatggcgctggtgctgagtaccgcgcgtcgggtagtggaagtggcggagcgcgtcaaagcgggtgaatggacgaagagcattggtccggactggttcggcacggatgttcaccataaaaccttaggcatcgtcggcatgggccgcatcggtatggcgctggcgcagcgcgcccacttcgggttcggcatgccgatcctgtataacgcgcgtcgccagcatccgcaggcggaagaacgcttcaatgcccgctattgcgatctcgataccctgctgcaggaggctgactttgtctgcctgatcctgcccctgagcgaagagactcaccatctgttcggtcaggcgcagtttgccaaaatgaaatcttccgccatcttcattaacgccgggcgtggcccggtagtggacgagcaggcgctgatcgccgccctgcagaacggtgagatccacgctgccggtctcgatgtgttcgaacacgaaccgctggccaaggactcaccgctgctgagcctgccgaacgtcgtcgcgctgccgcatatcggctccgccacccatgagacgcgctacaatatggcggcctgtgcggtggacaacctgatcgacgccctgaacggcaacgtagagaaaaactgcgtcaatccgcaggtaaaataagccataaaaaaacccgggtaacggcggcaaccgccctccccgggttctttttgcatcctgtccatcatcctgcccgttcgccgcagccaacgtcagccagatgaagcattaacgggtggcgttcaccgccgccgtccatgcctgattaaacgcctgatgctgcgccgccagcggcccaatcagcgcattgtactggctggcctgctgggaggttgggaactgaatgccgttggcgacaaagctcacctgcgtcccctgctgagcgacaaaatccccaacctgaaccagctgctgggtaaagatctgcgcggccgggatcagcggctgcagcgcgtcggctggcgccgtcaccaccttggcgtaaacctgatcgaagaccggcttgagatcgtcagcctgcttcagcgcgccatgcgcggcatcggcctgcattttcgcattctgcagctgctggcttagcacgcccagcgcgccgttcgcctgacgcagcggctcacgctgggtcatataatcctgcgggacgcggatcgcattgacgctgtccactaccgggcgcagaccagcgtccatcgcctggctcacctgctgcgagtaaccgtagatcaccgcgtagtcagagacaaaaggcccaaactgttttttctgatcggcggtcagcgtcggcagacgttcaccgctacgcatcgccgtattctgcaggaagtcgataaacgctttgcgctgatcgccctctttatcaaaacacccactcaggctaaccaccatcaataaggccgccatagccgcaaaccagcgagagcaggactttcctgtcgccatttttttactcctttcagccaaaaaaagcgcacaacggcacacacgtgccagacgctgacaaggatagtccagctcggcctcgcaggataccctttcctgctaatcttacgcgggaaaaacaccattttgcacgccatcgtcgcgctgtagaacgtctgttatgcgcatcacaaatatggtcttaagaacaggtgggccagaatctcataagccattgatattaatataaataaaaagccacaacccggcactgcgccttaaagcggacgataatcgcacgctttggcacgcgtctggattgcctgcctcgcatttcaatgatttgatgaatgagcgattaacggcgacatgttcgattatcgcacaaatcaaactcaacgacgcgaaggcgacgataataataaacctctgtccctcgctcagtctgccaggaaagccgtatgactaagacaaccatcgacattcaggcctttatcaacgagcaccccttcacccgctaccagtggatgattcttgcgctctgctttatcaccgtcgcgatggacgggttcgataccgcaattatcgggttcatcgcctccgacctggtgcaagagtggggcgtggaaaaatcggccctcggcccggtgatgagcgccgcgctggtgggcctggcggtcggcgccttaaccgcagggccgctggctgaccgcatcggccgcaaaaaagtgctgatcatgtcgatcgtggtgttcggcggattcagcctgctcaccgccttcgccaccagccttaatcagctgacgctgctgcgcttcctgaccggtctgggccttggcgcggcgatgccgaatgccgcgacgctaatgagtgaatatgcgccggagcgccgtcgggcgctgctggtgaacctgatgtttgtcggctttccgatgggatcttcgctgggcggctttttatccgcctggatgatcccgcactatggctggcagagcgtgctggtgctgggcggcgtgatgcccctcctgctggcggtggcattaatattcctgctgccagagtccgtccgctatctggtagtgaagcagcacccggcgcagcgcattgctgctattctgcgccatatcgcgccgctgccgaagacagtggaatttgtactacgcgaagcaggccaggtgaaagagaaatccgcgatcggcgtcattttctctcctcgctacgcggtgggtaccgtgatgctgtgcctgacctactttatgggtctgctgattttctatctgctgaccagctggctgccgctgctcatccgtgaaaccggcgcctcgatgagtcaggcctcaattatcaccgccctgttcccgctcggcggcgggattggcgtgctgatcctcggcgccctgatggacaagatcaaccccaataaagtggtggccgtcggctggctgctgaccggcgtttttgtctgcctggtggggttctccaccagcagcctggcgctaatgggagtgatggtctttatcgccggcagcattatgaacggcgcccagtcgtcgatgccggcgctggcggctggcttctatccgacgcaggggcgcgccaccggcgtcgcctggatgctgggtatcggccgcttcggcggcatcctcggcgcgttcagcggcgccttcctgatgcaggctcagctctcctttgagaccattttcaccctgctggccatcccggcgttcctgtcagccattgcgctgctgatcaagtaccgggtcagtaaatccgtgccggcgacgacagatgaggcgagaagcctgcagaaagcctaaccctataagccggcgccccgcgccggctttgccgcttttttcttatccgtttacaaaaattttcgaagccacctcatcgcgttaataatcattcttttaggctacgctgccgtttggctgtcggggcagattcgatagcctgttggcaaataatcaccgacgttaccatcccttgcgccattttctgactattcttaatgagctatagaaaaatcttttccgctgtgtgataaaaggagttctcaatggaatataaagatcccgtgtttgaactgctgagcagcctggaacacatcgtttttaaggatgataatcagaaacttacctcaaaccgtaagtccactgtatttagtgaatttgaacagctgcgtaaaggcactggacttaagattgacgactttgccaacgtcatgggcgtgagcgtcgccatggtaagagagtgggagtcgagacgggtcagaccgtctcccaccgagctgaaattgatgcgcctgattcaggccaatccacagctttcacgacaattactcgattaatctcgcgcgcagcggcaaaggccagtaagggagcttttgccgctgcaccgtaaaaaaaagtttgctatcaggtgctgaacgtgcgttaatgctcgcaggtttgatgtacagaccacagagcagtcgaatagagcagtccttctaaggttatccaaagatacccccgtagtgaactttccctttatcgctttaaatctgtagtccagacccctacgccgcaaggctcacttatttttttaaaggtaattcactatgtccggtaaaatgactggtatcgtaaaatggttcaacgctgacaaaggcttcggcttcatcactcctgacgatggctctaaagacgtgttcgtacacttctctgctatccagaacgatggctacaaatccctggacgaaggtcagaaagtatccttcaccatcgaaagcggcgctaaaggcccagcagctggcaacgtaacttctctgtaagttcaagccgctaagaatcgagaatccctgcctgatggcggggattttttttatctgtcgccagtagccgccagcataagatggcggctaccgggcattcaaagcagggaaaagtgccagctcgtctcccgccacgccagactatgggtcagcttcagaccttgtaaaaacgcctcatcatgcgacaccaccagcatcgcgccgggaaacgccgccagcgcgctttcaatagcctgcgtcgatgctaaatcgagatggttggtcggctcatccaacaaaagcagctgggcaggctcgcgtcgccagagcacgcacgccagcgccgctttcaggcgctcgccgccgctgagcgccgacagcggcagagtgaccttatccgcgcccagctggagctgcgccaggcgggtgcgcaggaggccctcatccagtggggtatcttccaggctcaggtgcgccattaccgacagggataaatccagctgcgtcagatgttgatcgaggtaagcggcgctcaccgaaagccggacatcgcctgacgcggcctgctccagccccaacagcgttttcagcaaagtggttttgccacagccgtttggcccctttagcgcgatgcgcatcgggccatcgatacgccagttcagcggcgcagccggcgcatggtcgagctgtaatgactccaccaccagcacctgcttgccggcggccacttcgctacccggcagggtaaacatcactggggtctcttcctcaacccgctcccgcgcctgctgcacggcggcattcagactgctgttctgttcacgatgctgacggcgcagcgttcccgggcgctcttttgccgcgcctttgtacttcacgcgttcgaaggaggcgatatttagcgtatcaacggtacgcagcgtctgagccgagcgccgctgggcggcgtcatgctccttatgcattcgcgcgcgggtgcgccgtcggtcggtcacggcatgctccagcgccgcgcgcgcggcctgctgctccgccatacgctggcgctgatattcatcatagttgccgccgtagctgcgcagcgccgtcggcgtcagctcaattatcctcggcatccgcgtcagcagctcgcggtcgtggctggcgatcagagccccgccctgccagctttccagttggtgatagagccactcccgcccctggcggtccagatggttggtaggctcatccagcagcagataatcggcgcccgagacgaaggcgccgcacagcagagccttcatccgctcgccgccgctgagtgaaaatgcggggcgatcggcagagaacggcgggagatcggcttcacggaacgctaaactcaggcgatcggtgagatcccagtgaccatctaacagatcgaaatcgtcggccagcccttggccctgttcaaggcgagacaaggcggcaaaaaccgacgcatagcccagcagcgtagcgagggtggtctccggcgtgagcgtcggctgctgcgctacccaggcaacggcggcggcgcgctcaatatggccgccggcaggagaatcaaggcccgccagcagacgcagcagacgcgtcttgccgacgccgttccggccgaccaggccgcaaagggacggttccagcgagacgctgagcggaccaaacagggtctgtcccgtcgcaaactgacaggtgacctgatgtaaaacaaaagcggggatgcgggcgcaatgagccataagcactcctgaatgaaatcaatactcccctacccgcaaggtatgcgaggtaaggcgtgaaattcatcagtcgtgtttgttcatttgtggggcgcgctccggtgagacgagggattcgtcgggacataggatagccacactccggtatgcgttgcaagcctgttttattcaacgatcttgtaaaaataaaaaggcctcctgatatcaggaggcaaatgatttatttggtgaacaatgaaagggtgcattgagaatgcctgacaccgcaagcatggtggggatagatccccaccagatgctcttactgtttaatatcacaggctaagaatgccaccagctcaatatttccctgcctgcgctgtaattcacatagcgaatcacgaaccatccaggtcaataataaaatagtgaagcaaatcactactaagccaaacaacagatacttttgcggcattcctcgcctccagtgttgattttcaacaagtaagaggctactcttatggtgttcatgcataggggagcctcactttgattactatcaggtggggcttttctctgtctgtctcccgctgaatacctgagacacacagtctcaagcacccgccgccattctagcgtaaatacctctcagaattatgtttatatattcctaaaacgtttcttctcgatgaatgaaaataatgaagatatcaatgacagaattattaatggttcatctatttatatttcacgtataaaaaaacctgccctgaggcaggtctttattattaccgatacgcttactgcagcagagaaatatccgccacttgcaggaacagttcacgcagtttggacagcagcgtcagacggttgatgcgaacatctttgtcttcagcgttaaccatcacgttctcgaagaactcatccaccggctcgcgcagcgcggccagctcgatcagcgcatcctgataacggcctgcggcgaaatacggctgcagcttgtcgcgcagcaccaccagattacccgccagcttaatttccgccgcttctttcagcaccgaagcgtgaacgatgtcgttcagcgtctcatcggatttcgcgaggatgttagagacacgtttgtttgccgccgccagcgcggaggactcttccagagtacggaagtgcgataccgccttcatacgcgcatcgaaatccgccgggcgggttggacgacgcgccagtaccgcctggatcgtgtcgacgccgtagccttcgtcctgataccaggcacggaagcggcccagcataaagtcgatcacatcatcaaccacgttggcgttggtcagcttctcaccgtacagacgaaccgcttcttcggtcagcgtctgcagatcgagatccaggttcttctcaacgatgatacgcagcacgcccagcgcggcgcgacgcagcgcaaacgggtctttatcgcctttcggatgctgaccgataccaaagatacccgccagggtgtccatcttatcggcaatcgctaccgcgcaggccaccggattagatggcagcgcgtcgccagcaaatcgcggctgatactgctcgttcagcgccacggccacgtcttccgcttcgccgtcatggcgcgcgtagtgcatccccatcacgccctgggtgtcggtgaactcgaagaccatgttggtcatcaggtcgcacttggacagcaggcccgcgcgggttgcgtggttcacgtcagcgccaatcttttcggcaatccaacccgccagcgcctggatgcgatcggtcttgtcgcgcagagtcccaagttgctgttggaacagcacggtttccagacgcggcaggttatcttccagacgttttttacggtcggtattgaagaagaactcggcatcggccagacgcggacggaccaccttctcgttaccggagatgatctgctgcggatctttggactcgatgttggccacgaagataaagttcggcagcagtttgccggcgttgtcgtagaccgggaagtacttctggtcgcccttcatggtgtaaaccagcgcttcagacggcaccgcgaggaatttttcttcgaacttcgccgtcagcaccaccggccattccaccagcgaggtgacctcttccagcaggctttcgctcagatcggcttgaccgccaatcttacgcgccgcctcttgcgcatcagctttgattttggctttacgctgttcgtaatcggcgatgactttaccgcgctccagcaggatctgcgggtactggtcggcatggtcgatggtgaactccggctcgcccataaagcgatggccgcgaatcacgcgatcggacggaataccgaggatagtggccgggatcactttgtcacccagcagcaaagtcaccgtgtgtaccggacgcacgaagtggacgtcagacgcgccccagcgcatcagtttcgggatcggtagcttcgccagcgagctggcaatcatgttcggcagcagcgcttcggtgctttcgcccttcacatgggcgcgatacagcaaccactcgcctttgtccgtggtcagacgttcggcctgatcgacggtgataccgcagccgcgcgcccagccttcggccgctttgcttggcttgccttcggcatcgaacgcctgggcaatagccgggccgcgtttttccacttcgcgatcggcttgcgccgccgccaggttggccaccttcagcgccagacgacgcggggcggcaaaccattccactttaccgtgcgcaaggccagcgttatccagctccgcggtcacattcgcagcaaaagattccgccaggctgcgcagcgcttttggtggcagctcttcagtgccgatttccaccagaaaagtattctcagacatggccgcctcttatttattcttgttgcacatcgggaagccgagcgcttcacgggaagcgtagtacgcttccgccactgctttagtcagggtgcgaatgcgcaggatatagcgctgacgctcggtgacggagatggctttacgcgcatccagcaggttgaagctgtgagccgctttcagaatacgctcgtaggccggcagcggcagcggggtctccagcgccagcagctgctgggcctctttctcatactgttcgaagcaggtgaacaagaagtcgacgtcggcatattcgaagttataggtggactgctccacttcgttctggtggaacacgtcgccgtaggtggttttccccagcgggccatcgctccagaccaggtcatagacgctgtccacaccctggatgtacatcgccagacgctccagaccgtaggtgatctcgccggtcaccggcttacactcgaggccgccgacctgctggaagtaggtgaactgcgtcacttccatgccgttgagccacacttcccagcccagaccccaggcgcccagcgtcgggttttcccagttgtcttcgacaaagcgaatgtcgtggatagtcgggtccatacccagctctttcagcgacccgaggtacagctcctggatgttgtccggagagggtttaatcaccacctggaactgatagtagtgctgtaaacggttcgggttttcgccatagcggccatcggttggacgacgggaaggctgcacgtaggcggtcgccatcggctccggtcctaacgcgcgcaggcaggtcatcgggtgagaggtgccggcgccgacttccatgtccagtggttgaacaatggtgcagccctgacgagcccagtaatcctgtaaggtcaggatcaggccctggaaggtcctggtatcaaacttttgcatatgatttcgtgctggatacgtgtggatttaaaggaaggagtcagtatacccgctggctgcgagatatacagtacgaaacggcgttgtttcaggaaaacggacgaaatttacgccaggcggggtcgattcagcgcatcgaaagatgcataaactggccgtccgggtcaaaggaacagatgaaacgctcattcttgccggtacggccagaaagctcatagctcgcctggaattgttcaaagtggttcacgtcaacgagctgcgtttgcgtgttatagcggatagccgcctgatccttgcaaagctgcgccatattgagcgtggtttgcggcgtaatacgagcgcgctgcgctttttgcgtcggcggggagacggtctcgctgcagcccgcgaggagcagcaccagcatgacggaaacaacacctttcaccacgttctcctccaccgccttgttagcaagttgttatcctaaagattcagtattacaggtattttgcgaatatcatgaaactgcgacaagtctgtgaccgaaaactcagactaatctattgcgacaccgggaaaccgggcaggtcatatcttatttctccagcagacattgagggactgatgcaagaaaagatacactggatcaccaacctgcgcggcatcgcctgcatgatggtggtgatgatccacagcaccagctggtatatcactcacccccatgcgattaccctgctgcaatgggatatcgccaatctgctcaattccgcctcccgcgtcagcgtgccgctgttttttatgatctcgggctacctcttttttggggaacgcagcgcccagccgcgccatttctggcggattggcctgtgcattgcgttctatagcgcgctatctctgctgtatatcacgctgtttacccatatcaacgtcgagctgtcgttaaagaatttgctgcagaagcctgtcttctaccacctgtggtttttctttgctatcgccgtcatctacctgctctcgccgctgattcaggttaagtccaccagtagcacaatgctgctggcgctgatggcgatcctcggcattctggccaaccccaatatggtcagcgttaaagccgccggaattgagtggctgccagtcaacctttatatcaacggcgacaccttctactacgtgctctacggcgtgctgggcagagccattggcaccctggacaccgataaaaaatggctaacaccgctctgcgccgcgctgttcatcgccgccgtgtgggtcatttcccgcggcacgctgcatgagctgcgctggcgcggagacttcggcgacacctggtatctctactgcggaccggcggtgtttgtttgcgcggtcaccctgctgacgctggccaaaaactggcttaacgcgcgtcccctgcccggtatcgcctgcattgcgcgacattcgctggggatctacggctttcatgccctgatagtgcatgcgctgcgcgccagccatctggagctatcccgctggccgctgctggatattgtgtggatatttagcgccgccctgctcggcagcctgctgctgtcaggcctggtgcagcggattgatagccgccggctggtcagctaacggtccgccgcccggaggggcccgacttacgtctcaggcccctcttccgtcacgctgagaggttcccgtaagcgcgtcgggtcccagacatcacgcacgtttttctgtaccgcaacagcgccaaacaggctcaaaaaatacgccagcccatagaaccctttctcgctgagcagcagagtggcattccacagtccgataaccagcagacctacagcgataacgaagatcaccagacaggtggtgtagtacagcgcggtggtcggaatggcttcatacttatcgcgcaccgtcttttgataagatgccgcggcaaacagccccagtaccaggacggcaaaataatagcctttctcattcaactgcatatcggcattccacagccccaccagataggtgacgatgccgccgatcagggcaatccaggagatcaaatgaaacgcaggagaatacgtcgcgtgcttgttttccatcactttttaccttttacgcgcctcggggcggcgcttattccgttttttgcatcgcgcgggcgatgcgggtccgttcgggggttgccgatgcgccatataagcagacaaaccatgccgcgatatagacggctttttcatgccagtctgccggtacataccaggcgccgaccagcagcaggccgaccgatagcagcagcaccagccggcataaggcaataaaaccgtcgtcctgttcctgccactgactggcgcgctgatgggcgagaacagcaaacatccccatcaccagcacgccgagaaaataccctttgccgctgaacagcgggcaggtccgccagataccgagcagataaaccagcgatcctgtcgccatcatccccctggcaatattgcgttttgtgatcatctcacctccctggtcgacaggggctgattatgaccgactccctcggcgatgcctcagattacgtacgacaaagcggagatttcggaataaataaatacgcatttatggatggatgtagccgggacattcaggaagggaatccgcccggcgctgccggacggactgaggctaagacatcagcggtttcagttgctgataaatctggcggaaggtttcccgctgcggcgcatagtgggccacacggcgatcgtccgggcgatgggcttgttcaagcggcagcggcttcagcagcccggggcggtctgcctcgtcgtgaaccgccagctgcgccagcctggccgcccccagcgccgggccgacatcgcccccggtacggtaatcgagctgcaggccgctgatatccgccagcatttgccgccagtaagcgctgcgcgccccgccgccgataagcgtgatgctctgcggcttgatgccgcaggcgtgcaccacgtccataccatccgccagcgcatagcccaccccttccagcaccgcccgcgccagctctgccggcccatgctgatgcgtcaggccaaaaaagacgcccttggcctgcgggttgttgtgcggcgtgcgttcgcccgacagatagggcaggaaccacaccggaccggcgctttcatccgccgtctgcgccgccgcgatcagcgccggcacgctggcgagaccggttaattttgccgcccagtccagacaggaggccgcgctgagcatcaccgacatcaaatgccagcggcccggcagggcatggcagaagctgtgcaccgcgctttcgggtttgctaaggaacccttcactgacggcgaagtagacgcctgaggtgcccagcgacagcatcgcctgaccggcatcggccatgccgaccccgaccacgcccgcggcgttgtcgcccccgccgcccaccaccagcgccggcggcatattccacgcctgcgccacctcaggtcgcagttgcccggtgacgtcgctgccttcgaacagcgctggcatcgcatcccgactgagatcgcaggcggcgagcatctcgtcgctccagtcgcgccgggcgacgtccagccacatcgtgccggcggcgtcagacatatcgctggcgagctcgccggtcatgcgcaggcgcagataatccttgggcagcagcactttatcgacctggctgaacactgccgcctcgtggcgctgtacccataagagcttcggcgccgtaaagcccggcatcatcaggttgccggtgatctgcctggaagcgctgactttgtcttccagcagctggcactcttcggcgcagcggccgtcattccataaaatggccggacgcagcacctgtaacgatttatccagtagggtggcgccgtgcatctgcccggcaatgcccagcgccttcacgtcgcgcaggctatgctgcgcgcccagggctttcatcgccgtgtccgtcgccagccaccactgttcgggatcttgctccgaccacagcggatgcggacgcgagacggtgagtttttcggtatgcgatgccactacctcaccctgctcattgagcaggatggctttgacgcccgacgtccccagatcgatgccgatatacatactccctctccttaaacgcgcgccacggctgagcgtggcgcgaacagagcatcctggttgcggcgccggtcaccccgggcgccgccgcatgattacttgtcaaacagataatggttgaccaggttttccagttgttcctgctggccgctgcgatgctgcggcgccagctgatgctgagcggcatactgggcaatatcgctcagggtcatctgcccgttaaggatctgctgccccagctcaccgttccagccagcgtagcgtctggccacgcgcttatccagttcgccgtcctcgatcatccgcgccgcgaccttcagcgatagcgccatggtatccatcgcgccaatatgaccatagaacagatcgtatttgtcggtgctctgccggcgcactttcgcatcaaagttgagcccgccggtggtgaagccgcccgctttgaggatttcatacatcaccagcgcattctcttcgacgctgttcgggaactggtcggtatcccagcccagctgcggatcgccgcggttggcgtcaacggagccgaacagccccagcgcgatggccgtcgcaatctcatgatggaacgaatgaccagcgagcgtcgcgtggttagcttcaatattcagtttaatctctttttccagaccaaactgtttgaggaagccgtaaacggtagaggcatcatagtcatactgatgcttggtcggctcctgcggtttgggctcaatcagcagcgtgcctttaaagccgattttatgcttatgctccaccaccagctgcataaagcggccaatctgctcacgctcctggcgcaggtcggtattcagcagggtttcatagccctcgcgaccgccccacagcacatagttttcaccgcccagttgatgggtggcattcatggcggtgaccacctgggtggccgcccagctaaatacttccggatccgggttggtggccgcgccggcgccgtagcgcgggttggtaaagcagtttgcggtcccccacagaagcttcacgccgctctgctgctgtttctcagccagcacctcgaccatccgggcgaagttattgctgtactccttgagcgaagcgccttccggcgagacgtcaacgtcgtggaagcagtagtaaggcacgttgagtttatggaagaattcgaacgccacatcggctttgcgtttggccatctccagggcatcgccaggctgctgccagggacgatcaaaggagcccacgccaaacatatcggcgccattccagcagaaggtgtgccagtaacaggccgcaaaacgcagatgatcttccatccgtttgcccagcaccagttcatccgggttgtaatgacggaaagccagcgggttagtggatttcgggccttcgtaacgaacgcgatcgagttgatcgaaataggtctgcatagagaactccatattcagagatgcggcgaataaccaatcagataccctaaataattcgagttgcaggaaggcggcaggagcgcaagtccccggtaaccaggggcggagcaacgaatgtcaccaacccacctacaacttgaagtatgacgggtttaagccaatatagaatttcgctttcattttcctcaattacgttatttcacaccgccattgagagaatccacaaacgtgcgccagctcgcaaaaataatatccagtcgccgttgcgccgctctgtcagagacagtccagtgcaataataagagcgtgcatgaataaaatacgatcgccgtcataatttgcacattaaacgaaatttcataacggcaaaataagaaccggtaattgccagccctgctttccgcgttaagaatctgtaacgtatccgcaacctcatgtatcaaacattattttccgttcgtcttacctacccttacaaaaaaggtatcgttattatgaagataaagaacctttgccttacgctttgcgccagctccctcctgctcgccagcatggcggggatggcgaaagaagtgaagattggcatggccatcgacgatctgcgtctggagcgctggcagaaagaccgtgatattttcgtcaataaagcggaatccttaggcgccaaagtttttgtccagtccgctaatggcaatgaagaaacgcagatgtcgcaaattgaaaacatgatcaaccgcggcgtcgatgtgttagtcattattccttataacggccaggtactcagtaacgttattaaagaagccaagcaggaaggtattaaagtcctggcctatgaccgtatgattaataatgccgacattgatttctatatatctttcgataatgaaaaagttggtgaaatgcaggcgcaaagtctggtcgacaaagtgccgcagggtaattatttcctgatgggcggttcgccggtggataataacgctaaactgttccgcgccggacagatgaaggttctcaagccgtatgtcgatgatggcaaaattaagattgtcggcgatcagtgggttgacggctggctgccggagaacgcgctgaaaataatggaaaacgcgctaacggcgaataataacaagatcgatgccgtggtcgcctccaatgacgccaccgccggcggcgccatccaggccttaaccgcccaggggctggccggcaaagtggcgatctccggtcaggatgctgacctggcgggcgtgaagcgcattatttccggtacccagacgatgaccgtctataaaccgattaccaccctggccaccaacgccgctgaaatcgccgttgagctgggtaacgataagcagccgaaggccgataccacgctgaataacggcttaaaagacgtcccttcgcgcctgttaacgccaattgaggtgaataaagaaaatatcgacgccacggtgattaaagacggtttccataaaaagagtgaactgtaatggctgacgccccgctgcggggcgtcattttcatcccgccggatatcactgttgcggagtctttatgacctggctactcgaaatgaagaacatcaccaaaaccttcggcgctgttaaagccgtggataacgtcagcctgcgcctgaacgcaggcgaggtggtctcgttatgcggtgaaaatgggtcggggaaatcgacgctgatgaaggtgctgtgcggtatctatccgcacggaagctatgagggcgagattatttttgccggcgaaacgctgcaggcaaaccatattcgcgataccgaacgcaaaggcatcgccattattcatcaggagctggcgctggtgaaacatctcaccgtgctggagaatattttcctcggcgccgagatctcccgccatggtctgctggattatgaaaccatgacgctgcgctgtcagaaactgttggcgcaggtcaatctgcccatttcgcccgatacccgcgtcggcgacctcggccttggtcagcagcagttggtggagatcgccaaggcgctgaataaacaggttcgcctgctgatcctcgacgaaccgaccgcctccttaaccgaacaagaaaccgcgacgctgctggcgatcgttcgcgatctgcaaaaccacgatatcgcctgcatctatatctcgcataagctcaatgaggtcaaagcgatctccgatacgatctgcgtgatccgcgacggccagcacatcggcacccgcgatgccagcggcatgagcgaagacgatatcatcaccatgatggtcggccgcgagctcaccgcgctctatcccagcgagccgcacgcccacggcgaggagatcctgcgggttgaacatttaaccgcctggcacccggtaaaccgccatattaaacgggtcaatgacgtctcattttccctgcgtcgcggagaaatcctcggcatcgccgggctggtcggcgccggacgtaccgaggcggtacagtgcctgttcggcgtctggccggggcgctggcaaggggagatcgttattgatggccagccggtgagcatctctaactgccagcaggccattgcccacggcatcgccatggtgccggaagaccgcaaaaaagacggcatcgtgccggtgatggcggtgggcaaaaacattaccctcgcggcgctcaaccagttcaccggcgcaatgagcagcctggacgacgccgccgagcagcactgcattcagcagtccattcagcgtttgaaaattaaaacctcctcgccggagctggcgattggccgtctgagcggcggcaaccagcaaaaggcgattctggcgcgctgtctgctgctcaatccgcgcattctgatcctcgacgaacccacccgtggcatcgatatcggggcgaagtatgaaatttataaactgattaaccagctggtgcagcagggcatcgcggtcattgtcatttcatccgaactgcccgaggtgctcggtctcagcgatcgggtgctggtcatgcacgaaggcagactaaaagccaatttggttaatcaacatctgacccaggaacaggtgatggaagccgcgctgaggagcgaacgccatgtcgaagaacacgtcgtctgaaatcaaactcaccccaaccgcccccgcggccctgccggcgctgaaggggctgaatctccaggtcttcgtgatgatcgccgccatcgtcgtcattatgctgtttttcacctgggttaccgatggcgcctacctgagcgcacgcaatatctccaacctgctgcggcagacggccatcaccggcattctcgccgtcggcatggtgtttgtgattatttcggcagaaatcgacctctccgttggctcgatgatggggctgctgggcggcgctgcggcgatctttgacgtctggctcggctggccgctgccgctcaccattctggtgacgctggtgatgggcctgctgctcggggcgtggaacggatggtgggtagcctatcgcaaagtgccctcgtttatcgtcacccttgccgggatgctggcgtttcgcggcattctgatcggcatcaccaacgggaccaccgtctcgcccaccagtccggcgatgtcgcagatcggccaaagctacctgccagacggcatcggcttcggcatcggcgttgtcggcatggcggtgtttatcgtctggcagtggcgcgggcggatgcgccggcaggcattaggtctggcgacctcgtcctccaccgccgccgtcggccgccaggccattaccgcggtgattgtgctgggcgcaatctggctgctcaatgactatcgcggcgtaccgaccccggtgctgatcctcgccgccctgctgctggcgggcctgtttatggccacccgcaccgcctttggtcgccgcatctacgccatcggcggcaacctggaggcggcccgtctgtccgggattaacgtcgagcgtaccaagctggcggtgtttgccattaacggcctgatggtcgccattgccgggctaatcctcagctcacggctcggcgcggggtcgccttcggcgggcaatatcgccgaactggacgccatcgccgcctgcgtcatcggcggcaccagcctggcgggcggcatcggcagcgtcgccggggcggtaatgggggcgtttattatgtcggccctggataacggtatgagcatgatggacgtcgccaccttctggcaatatatcgttaaaggcgccattttgctgctggcggtgtggatggactctgccaccaagcggcgcgcataaggagagactctctgaagaatgtctgaattctttgcgctaccgccaaacttcgccataaggcgcttgaaatatctcgggcattagccggtagtgtatacccaacatcattcgggttgcagacggcgcccccggccgcgtaccggcgtacgtggccgggatgagtggtaagtcaggccatcggcaacatcttgaatgaaggggtatgaccggggttagagcaggaacattatctatgtttgaaaagcgtcaccgtattacgctgttatttaacgccaacaaagcttatgaccgccaggtagttgaaggtgtcggcgagtatctgcaggcctcccagttggaatgggatatctttattgaagaggactttcgggcacgcatcgaaaacatcaaagagtggttgggcgatggcgttatcgccgactatgacgatcccgaaatcgaaaagctgctggccgatgtccacgtgcccatcgtcggcgtcggcggatcttatcatcagccagagcagtacccgccggtccactatatcgccaccgacaacgccgcgctggtggaaagcgcttttctccatttgaaggaaaaaggggtgcaccgcttcgcgttttacggactccccacctccagcggtaaacgctgggcggtagagcgcgagtatgccttctgccagctggtcgcgaaggagaagtatcgcggcgtggtctaccaggggctggagacagcgccggagaactggcagcacgcgcaaaaccggctcgccgactggctgcaaaccctgccgccgcaaaccggcatcatcgccgtcaccgacgcccgcgcccgccacgtcctgcaggcctgcgagctgctgcatatcccggtgccagagaaactgtgcgttatcggcatcgataacgaggagctaacccgctatctctctcgcgtcgccctctcctctgtcgcccagggcacccgccagatgggttatcaggcggcaaaattactccaccggctgttgaataacgaggccctcccgctgcagcgccagctgatcccgccgatgcgcgtcgttgagcgacgctccaccgactaccggtcgttaaacgatccctccgtgatacaggcgatgcattacattcgcaacaatgcctgcaaaggcatcaaggtggaacaggtgctcgacgccgtgggcatctctcgctctaatctggaaaaacgcttcaaagaggaggtcggggagaccatccacacggtgatccacagcgaaaaactggaaaaggcgcgcagcctgctggtgtccactagtctgtcgatcaatgagatttcgcagatgtgcggctatccgtcgctgcaatatttctattcggtgtttaagaaggagtacgacgtgacgccgaaggagtaccgcgatcggcacagcgaggtgatgctgtagggtaaaaaaatgcccggcgacaaggccgggcatccggattacagatgagcggcgatgagccgctgattgtcctgatacatcgcgaagagatagttgttgtagctcgaccctttggtcgaataccccttcagcttatggatcatggtgctggcagttacttcctgatccgccttgcgcagctgcaggcgcgacttgcggaaagaagaataggccgggtgggtgttcaggtttgttacgtaagcctgcaccgactgctctaccgactcaaactgcgagtaacctttcatcgcgccgcggcagcgaccggcgccgcacttcatgccgaacaggttgttattctcgcgcgccagcctggaggtaccccagccactttccgccgccgccatggtcgccaccatgctgttcggaataatgtcgacacgctcaagcagcgcgttccagggcacatgacgcgtattgcctgaccacttcaccttataacgggaagcgatatccttcaggcgcgccttctcagtcggtgaccagcgagcatcgtactgcttggaaataagccagttacgatccgcagtaatcgcctgattctgcttggtaatataaggcatgaccgtccggagaaacgcttttttccttggtgttccggaagggtattttcgcaagtcaggaagtgaactgctctttacactattgcgagaatactcttgtttactgcttaccttagtactacttatcttctttaccgttggggctttatgactctttgtcgctgtgtgcgttgtcgccaacacactacctgaaaagatgcaggttagtaacataagtatggcggccccatatcgtcgtatgggattcgatatcatcaggtctcctggtcggatatatgcattccaacaccttgtttttcacaaaaaaacgatagctgaatcgctaatagtatcaaaaatacgcactgagggcatcaacagaaatagtccaattccgaattgctgtcatctgaaatcggtttctgcggcgcatcgccagcgcgaaaatgctagcttcgtctcatttttagcctattttttgagcggtgtcactcaccccttttcatcctcctggtaaaacgcgcgtcaggaggagttcacccgcgcggcgacaaggcacactagataaaaaccgctcacaggatctcgcaatgaaactcgctgcgcttgccacgttattcgtgcctgggatggcttttgccgcctggactaccaccgactttcctgcttttaccgaagaagggaccggccgattcatcagccagaaagtggttgagaagggtacacgtcccctgcagctaaattttgaccagcagtgctggcagccttccggcggcattaagctcaaccagatgctgtccatggagccctgtcgcggcacaccgccgcaatggcgcatcttccgccagggtctgtataccctggaggtggatacccgttccggcacgccaacgatgatgatttcgctggaggaaaaagagaccagcgccgcggcgccgcagatccgccagtgtccgaagtgggacggaaaaccgctgaccatcgacgtcagcaaaaccttcgccgagggcagcaaggtccgcgatttctacagcggcaatgtcgcgaccgtcagcggcggcaaaatcaccctgcagcccgccttcggcagcaatggactgctgctgcttgagcgcgccgagaccgccgccccggcgccgtttgactggcacaatgccaccgtctacttcgtcctgaccgatcgcttcgtaaacggtaacccggccaacgacaacagctatggtcgccataaagacggcatgcaggagatcggaaccttccacggcggcgacctgcagggattaaccagcaagctggattatctgcagcagatgggagttaacgccctgtggatcagctccccgctcgagcagatccacggctgggtcggcggcggcacgaagggcgatttccctcactacgcttatcacggctattacacccaggactggtcgaaactggacgccaacatggggaccgaagcggatctccgccgactggtggatgaagcgcataagcgcggaatacgtattctgttcgacgtggtgatgaaccatgccggctacgccaccctggccgacatgcaggagttccagttcggctccctgtatctgcaaggcgatgagctgaaaaaaactctcggcgagcgctggacggactggaagccgggcgcgggacagacctggcacagctttaacgactatatcaacttcagcgacaaagccgggtgggagaaatggtggggtaagaagtggatccgcaccgatatcggcgattacgacaatccgggctatgacgatctcaccatgtcgctggccttcctgccggacctgaaaaccgaatcgaaggaggtctcaggcctgccgaacttctatagccataaaccagacaccgcagcgaaagcgatcccgggctatacgccgcgcgactatctgacacactggctgagccagtgggtacgtgactacggcatcgatggcttccgcgtcgataccgccaaacatgtggagatggacgcctggcagcagttaaaaacccaggccaccgccgcgctggcggagtggaagaaagccaatccggataaagcgctggatgcggcgccgttctggatgaccggcgaagcctggggacatggagtgatgcagagcgattattatcgccacggttttgatgcgatgatcaatttcgactaccaggaccaggcggcgaaagcggcgacctgtatggccaatattgacctcacctggcagcaaatggcggacaagctgcagagctttaacgtcctgagctacctctcctcgcacgatacgcggctgttccgcgaaggcggcaccaccgcggcggagctactgctgctggcccctggcgccgtgcagattttctatggcgacgaatcatcgcgcccgttcggccccaccggctcggacccgctgcagggtacccgctcggagatgaactggcaggatgtcaacggcaaggcggcccgcagcgttacccactggcagaagatcggccagttccgcgctcgccatccggcaatcggcatgggcaaacagacaacgctgtcgatgtcgcgtggttatgggttcgtgcgtgagagcggtgaagacaaagtgatggtcatctgggccgggcagcagcagtaatccacatgtggctctccgccctgcggggagccaccattcagcacaaaatgctaacaaaatagcaatatacaggataaagataaaaatccgcctcctcccgccgatttgcaccatgccagcgctggcgttatggttagccactttccagaaccaccgatagactattcgcgatgacattttcccttttcggcgacaaattcacccgtcattcaggcatcacccgcttgatggaagaccttaatgacggtctgcgcacgccgggcgctattatgctgggcggcggcaaccccgctcagatcccggaaatgaatgactacttccagcagctgctggccgacatgctggataatggcaaagcccttgatgcgctttgtaattatgatggtccacagggcaaaagcgagctgctggctctgctggcgaacatgctgcgcgacgagctgggctgggagatcgaaccacagaatattgcgctaacaaacggcagtcagagcgcatttttctacttatttaatctgtttgcaggccgtcgggcagatggcaccacccgtaaggtactgttcccactgacgccggaatacatcggctacgccgatgccggtctggaagaggatctgttcgttgccacccggccgaacatcgaactgctgccggaaggccagtttaagtaccatgttgattttgagcatctgcaggtgacggaagagaccgggatgatctgcgtctcgcgccccaccaacccgaccggcaacgtcatcactgatgaagagctgatcaaactggatgcgctggcgaatcagcacggggtcccgctggtgattgataacgcctacggcgtgccgttcccgggcattatctttagcgacgcccgaccgctgtggaatccgaacatcgtgctgtgtatgagcctgtccaagctgggcctgccgggcagccgctgcgggattatcatcgccaacgaaaaaatcatcaccgccatcagcaacatgaacggcattatcagcctcgcccctggcggcatcgggccggcaatgatgtgcgaaatgattaaacgacaggatctgctgcgcctgtcagagacggtgatcaagcccttctattaccagcgggtgcaggaaaccatcgccattattcgccgctatctgccggaggagcgctgccttattcacaaaccggagggggcaatcttcctctggctgtggtttaaggatctgccgatctccaccgagctgctgtatcagcggctgaaaaagcgcggcgtgctgatggtgccgggggattacttcttccctggtctggataaaccgtggccgcacacccaccagtgtatgcgcatgaactatgtaccggacccgcaaaaaatcgaagccggagtgaaaatcctcgccgaagaggttgaatttgcctggcgcgaacaggaagcataatctctgacgccgcgggcgggtaacgttcgtcagcgaccccattcacgccagcgccagccgctggcgtttttgcgcgcatagcgcttccagctccgcgggaaccatcacccgcagcgcctgcgtcgggcaggcggccacgcaggccggtccttcggcgcggtgatggcatagatcgcatttcaacgcctgcgcctgctcgttcattaccgtaacggtcatcgcgccgtacgggcaggccaccatgcagcttttgcagccgatgcagcgccgctggtcgacccaccagacgtcattgtcgcgctgaatcgccccctgtgggcaaacgctggcgcagggcgcatcctcgcactgccgacaggccatcgccgtcgatatgtcaccgcttttcaccacccggatacgcggcgcgaaatggttcgtcgacagggcggcgacatcctgcgcctgctggtgcgccaccgcgcaggccacttcgcaggtacgacagccgatgcaccgctgggcattggcaataagaaactggttcatcctctgctccctggggataaaaccgcagggtgccagaatatcccctgcccgcgctttgatcctgaatggaatcagcgctgttttttgtcagatggccggcaggatgtggtcatttgcctgacgcttcacgcaccgtgaaacccagctcacgcgaaattgcttcggcggtctcacgtagtggttttaacaagttcttttcgccagctccccggcacgaagtccgccggggagccgacgttaatgattaccggaacaatgccttatcgcgcaggatatgatcgttgccgcgacggcgggtgaagccaatccgatcgaaatactccaggatctggatcgccagcttccgccctacgtttaaggtatcgcggaaatccgccgcgcaggttgaaccgcgcagccgatccagctcgcgcacccgctgggcgaattgcacaatgcgatcgttgcggtagtaacgatccttgacgatcgcggtaatcatcccctgctgcgccgcctggcgcagcaccgcgcgcatcagggactcttcaacatggacttcgcgcgcaagatcgcgcacccaccacggatcgtcgccgaacaaagtctccaccttctgccagaccgcctgctgctcgtcggtaaacccggctttatgctccggcaaatgcagccagccgtgatggctgtggactaagccgctctcgcgcatctgctcaatcagcagcagcaccagcgcttcatcttccatcggcagcgcgatgcggcgcaggcgctcccggccagggcccggctcgtctcgatgctgctcatggtagcgcgcaagggcatccagcaattttcgctgccagcgggcggcaagcggcgcgctaagcaggcgctgtccggcctgcagatagtccggtcgctggatcagggccgccatcccggcttcgctgagctgccgcgcccaggcgaagcgctcaagccggacggcatcccgctgcagatgcagctccagcgcctgcgcatcgtcagcgccgaccgccgccagggcgtgcagccactgcagatattccggtttacgtttgccgcgacgcggaggatccagcgtcaccacccgtgcgcccgccagcgtcaagcgagcggagatatcgcggagcaccagccggtcgttatccgccagccacagcggagtatccagcaccagctccgccaggttgccctcaagaagcgacacccggccggtaatgtggctggcagcatggtgaatatgcagcggctgccactggctgagcggcgtatggcactgcagctcgacaatcacccgttctgctggctccggcggtggtgaggagagcagccagtcgccgcggtgcactgcctctttttgcgcatcgccgacaatattcagcgcaatgcgctgtccggcgtgcgcctgctcaaccgcttgattctgggcatgcaggccgcggacgcgcatcggcgtgttgacgccggtaagccatagggtatccccgacccgtacttcgccggagagcgccgtcccggtgaccaccagccccgcgcctttgacggtaaaagcgcgatccagcgccaggcgaaaccgctgctgctgcgggcgggggcgctccgcaagctgcagcagatggctgcgcagttccgcaataccgatgttttccgccgccgcggtgggaaagaaagcgacggcgtcaaagcccagctcgcccagggtctgctcgacctctgcctgaacctccgccaccctggcggccgccacgcggtccgttttggtcagcgccacggtcagcgtcggctttccggtcagctgcaggatcgccaggtgttcgcgggtttgcgccatcaccccgtcatcgcaggctaccaccagcagcgcatggtcaataccgcccgcccccgccagcatgttggacaaaaacttttcgtgcccgggaacgtcaataaatcccagcacccgcccgtccggctgcggccagtaggcatagccgagatcgatcgtcattccccgcgctttctcttccggcagacgatcggcattcacgccggttatcgcctgcagcagcgtcgttttgccgtggtcaacatgtccagcggtggcaataatcatcgtaacaacatctccataaagcgggtttcatcttccagacagcgcaggtccaaccagagccgaccgtcataaatgcggccaatcaccggacacggcagcgcgcgccagcgggccgccagcgcctccagccggctaccgcggccgtcatgcggggtaaaggtcaacgccgcgctgggcaggcggtcgacgggtaacgaaccgctgccaatctgcgactggcaggctgccacgctgacggcaaagtcagcatagtgtgccgccaggtcaggcagcaggcgttcagccagccggcggatctcttccgccggacgggtgagcaagcgcagcgtcggtaatctctccgtcagcacctccgggtgctgatagaggcgcagcgtggcttccagcgccgcgagggtcattttatccgcgcgcagggcccgcttcagcggatggctttgcagccgggcaatcagcgcgcgtttgccgacgataattccggcctgcgggccgccgagcagcttgtcgccagagaaactgaccaggctcaccccggcggagatcatctcctgcggcatcggctccttcggcaggccatactggctgagatccaccagcgacccgctgcccaggtcggctaccaccggaacatccagttcgcggccaatggccgccagctccgcttcgtcgacggctttggtaaagccttcaatgctgtagttgctggtgtgaaccttcatcagcagcgcggtattgtcattcaccgcctgacgatagtctttggcatgggtgcggttggtggtacccacttcgtgcagctgacaacccgcctgacgcatcacatcaggaatgcgaaatgcgccgccgatctccaccagttcgccgcgggaaaccaccacttcgcggccgctggcggtggccgccagcatcagcagaacggccgccgcgttgttgttcacgatacaggcatcttccgcgccggtgatctggcacagcagatcggcaatggcgcgatcgcgatggccgcgcccggcgtcgtcgagatcatattcgagcgtcaccggcgcgcgcatcgcgctggcaaccgcctccacggccgactccgcctggatggcgcgccccagattggtatgcaataccgtaccggtgagattaaacaccggacgcagggcgctccgctggccggcggtgagccgctgctcacaggcgtgcagccagtcatggctccagtcaggcagtgtctgacactggcggatctgttcccgcgcctcgtccagcatctggcgcagctgcgtcaccacctgcgaatggccgtgctgcgccagcagggaggaaaaagcggggtcgcggagtaagcggtcaatggccggaagccgggtataaagcgcacgaatttcggtagtcatgaatgggcctggcggtaagttattttcccccctcccgacgggagagggagtcaacaatcagcggcgattgtaacgcctccttgcgcaaactgttacctgcctgggtcaagtccgcggcggttcagtgcgcgcaaagctggcgcgctggaacagcgcatccaccagcttcaccagctgcggccgggtggcgcaccagccgggcgcgacccggcgaaagttcagataagcaatggcgcaggccgtggaaatggtcgccagattaacctcgtcgccgcgcagcgttccgtctgccgcgcaggcttccagcctgtcgagaccgcgagccactttctcccgctggcggagcagttcttgctctgactgttgcgcacccgggcgagccttttcacgcaccagcgcctgggcggcctccatcacgccatccgccagcgcctctagctggcgcatcctgagagcggctctggggtcggcggggatcatcggcggcgctacgcccagcagctccagatactgggcgatgaccggggagtcaaaccagcactcaccgtcgtccgtcaccagcgccggtaccttgcccagcgggttatagcgcgccacaccgttgctttcgctgtagggggattcgttgacaaactcaaaagggatgcgcttttccagcaggatcaccgatattttgcgcacaaagggactggtgtagctgccgatcagtttcatagcctgctccttatcgccaacaaattatcgccaacaaagatatgagtatggctcagggcaggacaaaaggcaggtgagcgtccggctcaacctgccgccgatcgcattaatgatcgacatagaggtagtgcatccagctggtcatccgcagcagcactttacgcatcaccgagacgtgggtgaaatggtcggagtagagcgccacctgcgcgtagataccatcgggtaatgctgatagcccttgttcaagcgatcgcgttccgtcgacacgcgggtggtattggcctggcctcagagagctgcggcttggggacgttaatacagtacagcgtcgttaccaggttggcctgcaggcggtcgactcgcgcctgattgggcgccgggtcaatcgtaaatagcgcctcgcctttctcgacgcgctgagtggctctatcggttcggctttacgggattatttatatgattttattcacaatatactgatattcgccccgctattttgaggataattcacgcctttcatttatgccatccggcgtaaaaaagttattcggcaattaaggttgcttagttacagggtcatcccggcgtggaagcaaaaccgggccgagatcacagcggcgtaaacccctcgcgaaattctttgtgatcaaaatcacaaacaaacaacaaaaacacgaaacaaaaatgtgacaaatatcacacaaaaaggcagatcagcggctaaaaaggcgctgtgttgtttttttacacagtaattttgtgatcatcatcactacaaaaccctcttagccccctatattcatgtgatccaaatcacataaaagggcgctggctggacagctaaacgtttcagtgccagatttcgcactatcaatcagggcccggctacctctgccgccacattaacaacaaacctcgggctttaagcctgcgcgctacgcaaaacagaagaaggggtgttttatgtcatccgatatcaagatcaaagtgcaaagctttggtcgtttcctcagcaatatggtgatgccgaatatcggcgcgtttatcgcgtggggtatcatcaccgcgcttttcattccgacagggtggttgccaaacgaaacgctggcgaagctggtcggtccgatgatcacctacctgctgccgctgctgatcggttacaccggcggtaaattagtcggcggcgaacgtggcggcgtggtcggggcgatcaccaccatgggcgttatcgtcggcgcggatatgccgatgttcctcggctccatgattgccggcccgctgggcggctactgcatcaagaaattcgataactgggtagacggtaagatcaaatccggttttgaaatgctggtgaataacttctccgccggcatcatcgggatgatcctcgccattctggccttcctcggcatcggcccggcggtcgaagttctgtcgaaaattctggcggctggcgttaactttatggtggcgcacgacatgctgccgctggcgtctatcttcgtcgaaccggcaaaaatcctgttccttaacaacgccatcaaccacggtatcttctcgccgctgggtattcagcagtcccacgagctgggtaaatccatcttcttcctgattgaagctaacccgggtccagggatgggcgttctgctggcgtacatgttctttggccgcggcagcgcaaaacagtctgcaggcggggcggctatcatccacttcctgggtggtatccatgaaatctacttcccgtacgtactgatgaacccgcgcctgatcctggccgttatcctcggcgggatgaccggtgtcttcaccctgactatcctcaatggcggtctggtttccccggcttccccgggttccattctggcggtactggcgatgacgccgaaaggcgcctccttcgctaacatcgccgcgattatcgcagcgatggcggtctccttcgtggtctctgcggttctgctcaagaccagcaaagtcaaagaagaagacgatatcgaagccgcaacgcgtcgtatgcatgacatgaaagcggaatccaaaggcgccagcccgctggcggccggcaatgtcaccaacgacctgagccatgtgcgtaaaatcatcgtcgcctgcgacgccgggatgggttccagcgccatgggcgccggggtactgcgcaagaaagtgcaggatgccgggctgagcaacatctcggtcaccaacagcgcaatcaataacctgccgccggatgttgacctggtcatcacccaccgcgaccttaccgagcgcgccatgcgccaggtaccgcaggcgcagcatatttcgctgaccaacttcctcgacagcggtctgtacaccagcctgaccgagcgcctggtcgcggcccagcgccacatcgacaacgaagtcaaagtcaccgatagcctgaaagacagctttgacgatactaacaacaacctgttccagctgggcgcggataacatcttcctcggtcgcaaagcagccaccaaagaagaagccattcgcttcgccggtgagcagctggtgaaaggcggctacgtcgagccggaatatgtgcaggcgatgctggaccgcgaaaaactgacctcgacctatctcggcgagtccatcgcggtaccgcacggcaccatcgaagcgaaggaccgcgtgctgaaaaccggcgtcgtcttctgccagtacccggaaggcgtgcgcttcggtgaagaagaagatgaagtcgcgcgtctggtcatcggcatcgccgctcgtaataacgagcacattcaggttatcaccagtctgactaacgccctggatgacgaaaccgtgattgagcgcctggcgaaaaccaccagcgtcgacgaagttctggcgctgttaaataaataatcaacgctatccaaccctctcctttgggagagggttggggtgaggggaaaggcctcaccccagccctctcaggtgaaaacattaattgaaggttaatactatgaaagcattacattttggcgcaggtaatatcggacgtggctttatcggtaaattgctggccgacgcgggcatcgaactgacgtttgccgatgtcaatcagaccgtacttgatgccctgaatgcccgtcatagctatcaggttcacgtcgtcggtgagaatgagcaggtggacaccgtctccggcgtcaatgccgtcagcagcatcggcgatgaggttgtggacctgatcgctgaggtggatctggtcaccaccgccgtcggtcccgtcgtgctcgagcgcatcgcgccagcgatcgccaaagggctggcgcagcgcaaagcgcagggcaccgaacgcccgctgaacatcatcgcctgcgaaaatatggtgcgcggcaccacgcagttaaaaggccacgtgtttaacgcgctggcggaagaagataaagcgtgggtggaagcgcatatcggctttgtcgactctgccgttgaccgtattgtgccgccatcggcttccgccactcatgacccgctggaagtcaccgtggaaacctttagcgaatggattgtcgataagactcagttcaagggcgcgctgccgactatcccggggatggaattaactgataacctgatggcatttgtcgaacgcaagctcttcaccttgaacaccgggcatgctataaccgcctacctcggaaaactggcgggccatcagacgattcgcgacgcgatcctcgacaagaaaattcgtgccgtcgtgcagggcgcgatggaagagagcggcgcggtgctgatcaaacgttacgcctttgacccgcagaagcacgcggcttatatccagaaaatacttggccgtttcgagaacccgtacctgaaagacgatgttgagcgcgttggccgtcagccgctgcgcaaactgagcgctggcgaccgtttaattaagccgctgctgggtacactggaatacggtctgccgcaccgcaacctggtgaaagggattgcggcggcgatgcatttccgtagcgaagacgatccgcaggcgcaggagctggcggcactgatcgccgacaaggggccgcaggccgcgctggcgcagatttccggcctggatgccgcaagtgatgtcgtcgcggaggccgttaacgactacaacgcggaaaaatgatgcacaacctggcgcggccgacgtcgcgcccattacgactcctgtcagatatgcaggcaatgatggaagaaacacaagcatttgaaaaccgtgtgcttgagcgtctgaatgctggcaaaaccgtacgaagcttcctgatcgccaccgtcgagctgttaacggaagcggtcaatattctggtgcttcaggtgttccgtaaagacgactacgcggtgaaatacgccgtcgagcccttgctggagggcagcgggccgctcggcgatctctctgtacgcctgaagctgatttatggccttggggtgataagtcgtgccgaatatgaagacgctgagctgctgatggccctgcgcgaagagcttaaccacgacggcaatgagtacagctttaccgacgacgaaattatcggtccgttcggcgagctgcactgcgtcgccgccctgccgccaacgccgcaatttgatgacagcgatgccgaactgctggcaatgcagaaactgcgttaccagcagatggtgcgctcaacgatggtgctgtccctgactgagctgatttcacgaatcagcttaaaaaaagcctttcagaaatcaacgctctgattccggttccgtctggtcgcaggtcggccggtaaagctgacgataatattccagacgctgcaggaacaacgcttccttatcctgaggaatgtctcgcggtacatgctgcagacgcggagactttttcaaatactccataaacgcctgactggaagccataaaatcaaccgctttgtcgattaaacgtggtacgccgtcgccgatctttgccatcacgtcctccttttgggaataatctgattaagcattagccaattcaccagcgtgggttaaggaaaacgtgcttatctgccgacaggcttcacagaaatgaaattagaacgggtattaggcggaatattaataaaattcaaattattagcgataaatgatattgcattccgcgggcgacaaacggcgaatttttgataaatagctatcaacaatagcggtcacggcacatactataggcgaatgaagcccctttattaacagatcaaaccaccatgaaagaagtcgaaaagaatgaaatcaagcgtctgagcgatcgtctcgacgccatccgccaccagcaggccgagctgtcgctggtggaagccgccgataaatatgctgaactggaaaaagaaaaagccactctggaaacggagattgaacgtctgcgttccgtccagagccagaagctgagcaaagaggcgcagaagctgatgagcctgccgttccgccgcgcgattaccaaaaaagagcaggccgatatgggcaagctgaagaaaagcgttcgcggcctggtggttgtccatccgatgaccgccctgggccgggaaatgggtctgaaagagatgaccggtttcgcccgcagcgaattttgatacccagccctctccgtacggagagggctattctgtcttcactcccccacatttttaccttcagccgggtcgattggtccaaccaataatttcatccaccccctggcagttcacaaatccgtcaaaacccatcacaaacacgttgcttaagagtaacatctgattaaccattcattgtcatcaaccctgatacccttaattggacgggccaattttactttcggtgggatcggcaatgagcgcagactcagccctcctctcctggcggcccgatggagaccctgcatgaatctctggcaacaaaactacgatcccgccggtaatatctggctatccagtcttatcgcatcgctaccgattctgtttttcttttttgcgctgattaagctcaaactgaaaggctacatcgctgccacctggaccgtcgcaatcgcgctggtcgttgccttgctgttctataaaatgccggtggaccgcgccttagcctcggtggtctacggcttcttctacggcctgtggcctatcgcgtggattattatcgccgcggtcttcgtctataaaatctcggtgaagaccggacagttcgacatcatccgctcatcgattctgtcgattacgccggaccagcgcctgcagatgctgatcgtcggcttctcgttcggcgcctttctcgaaggggcggcgggtttcggcgcaccggtggcgattaccgccgcgctgctggttggtctcgggtttaatccgctgtatgcggctggcctgtgcctgatcgtcaacaccgcgccggtggccttcggtgcgatgggcatcccgattctggtcgccggccaggtgaccggtatcgatagcttcgccatcggccagatggtgggccgccagctgccgttcctgaccattatcgtgctgttctggatcatggcgattatggacggctggcgcggcattaaagagacctggccggcggtgatagtcgcaggcggttcgttcgctattgcccagtacctcagctcgaacttccttggcccggagctgccggatatcatctcgtcgctggtctccctggtctgtctgaccctgttcctcaaacgctggcagccggtacgcatcttccgcttcggcgatctcggcgcctcgcaggtggatatgacgctggcccgcacacgctacacggcgggacaagtgatccgcgcctggtcgccgttcctgttcctgaccgccaccgtgaccctgtggagcgtgccgccattcaaagcgctgttcgctcctggcggcgcgatgtatgacttcgttatcaatatttcggtaccattcctcgacaaaatggttgcccgtatgccgccggtggttagcgccgcaacgccctacgccgcggtatataaattcgactggctgtcggcaaccggcaccgccattctgttcgccgccctgctgtccatcgtctggctgcgcatgaagccgaaagatgcgctgaccaccttcgccgggacgctgaaggatctggcgctgccgatctactctatcggcatggtgctggcgttcgcctttatctctaactattccgggctgtcgtcgaccctggccctggcgctggcccataccggccacgcgtttaccttcttctcgccgttccttggctggctgggggtattcctgaccggttcggacacctcgtctaacgccctgttcgccgcgctacaggcaacggcggcgcagcagattggcgtctccgatattctgctggtcgcggccaataccaccggcggcgttaccggcaagatgatttccccgcagtcgatcgccatcgcctgcgccgcggtaggcctggtgggcaaagagtcggatctgttccgctttaccgtcaaacacagcctgatcttcacctgcatggtggggctgatcaccacgctgcaggcctacgttttaacctggatgatcccgtgatagtgatgcctaaacgcctggccgacgacgtggcgcgtcgcgtccgggcgctgattgaagaacaacagctggaggcgggcatgcgactgcccgccgagcgccagctcgccgcccagctcggcgtctcacgcaattccctgcgcgaagcgctggcgatgctggtcaatgaaggggtgctgttgagccgtcgcggcggcggcaccttcgtccgttttcagcatgagccgtggtcagagcaaaacatcgtccagccgctgaagacgctgctggccgatgacccggactacagcttcgatatcctcgaagcccgccacgccatcgaagccagcaccgcgtggcacgcggcgatgcgcgccaccgacgccgataaagaaaaaattcgtctgtgctttgaagcgacccagagtgaagacccggatatcgcctcgcaggcggatgtccgctttcacctggcgatcgccgaagcctcgcataacgtggtgctcctgcaaaccatgcgcggctttttcgacctgctgcactcctccgttaagcagagccgccagcgcatgtatcaggtgccgccggtgtttgcccgcctgaccgaacagcaccaggccgtcatggaggcgattgtcgccggcgacgccgaggcggcgcgccaggcgatgatgggccacttaggctttgtccacgccaccatcaaacgttttgatgaagaccaggcccgccaggcgcgaattacccgcctgcccggtgaccacaatgaaaattccagggagaactcgtgatgattatttccgccgccagcgactatcgcgccgccgcacagcgtatcctgccgccgtttctgttccactatattgacggcggcgcctacgccgaacataccctgcgccgcaacgtcgaggacctttccgatgtagccttgcgccagcgtattttgcgcaatatgtcggacctgagtctggaaacgacattattcaacgagaagctggcgatgccgacggcgttggcgccggtcgggctgtgcgggatgtacgcccgccgcggcgaagtgcaggccgccggcgcggcggacgacaaaggcattccgttcaccctctctaccgtttccgtctgcccgatcgaagaggtcgccccgaccatcaagcgcccgatgtggttccagctgtatgtcctgcgcgaccgcggctttatgcgcaatgcgctggagcgcgccaaagccgccggctgctcgacgctggtctttaccgtcgatatgccgactcccggcgcccgctaccgcgacgcccattccggcatgagcggcccgaacgccgccctgcgccgctactggcaggccgtcacccatccgcagtgggcgtgggacgtcggccttaacggtcgcccgcacgatctgggcaatatctccgcctatctcggcaaaccgaccgggcttgaggattacatcggctggctggcgaataacttcgatccgtcgatttcatggaaagacctggagtggatccgcgatttctgggacggtccgatggtgatcaaagggatcctcgatccggaggacgcccgcgacgcggtgcgcttcggcgctgacggcattgtcgtctccaaccacggcggccgccagctcgatggcgtgctctcctcggcccgcgccctgccggcaattgccgacgcggtgaaaggcgacatcactattctcgccgacagcggcatccgtaacgggctcgacgtggtgcggatgatcgccctgggcgccgacagcgtgctactgggccgcgcttacctgtacgccctggcgacccacggtaagcagggcgtggcgaatctgctgaacctcatcgagaaagagatgaaagtggcgatgaccctcaccggggcgaaaagcatccgtgaaatcagccgtgattcgctggtgcagaacgccgaagcgctgcagaccttcgatgcgctgaagcagaataacgccgcgtaattctccacgttttcccttacgccgcccctctccctcagggtgagggttcaacaaatatctgctattctgccccccgcaattaagggggcagtatgctgaacatcgtgttattcgaaccagagatcccgccgaacaccgggaatattatccgcctgtgcgccaacacgggcttcagtctgcatatcattgagccgatgggcttcacctgggacgataaacgcctgagacgcgccggactggactatcacgagttcactgccgtgcagcgctatgcggattacgcggcgtttgtcgccagcgcgcagccgcaacggttgttcgccctcacgactaaaggcacgcccgcccacagcgcggtaagctatcaggacggtgatttcttgatgtttggtccggaaacgcgcggcctgccggccagcatcctcgatgccctgccgccggagcaaaaaatccgtattccgatgatgccggacagccgcagcatgaacctgtcaaacgcggtgtcggtggtggtgtatgaagcctggcgccagctggggtatcctggcgcggtcttgcgcagctaacctgagcggttcccggattacggcgcgttgcgccttatccgggctacatttctgtgcttagcagcggcaaatggcaatacatcaaatcccgtcgccgtactcgaaggtgtggtggatgccgttgaaatgctgatccatatccatcgccggcttgtcgctctccggcttgccgacgatacgcgccggtacgcccgccgcggtggtgtgcggcggaaccggctgcaataccaccgaaccggcgccaatcttcgcgccacgcccgacttcaatattgccgaggatcttcgccccggcgccaatcatcacgccttcgcgaattttcggatgacggtcgccgctggttttaccggtcccgccgagggtgaccgactgcagaatagagacgtcatcttcaatcaccgccgtttcgccgaccacaatgccggtggcatggtcgagcatgatcccgcggccgattttcgccgccgggtggatatccacctggaaagagacggagacttgattttgcaggaaaatcgccagcgcgcgtcgcccctgagtccacagccagtggccgatacgataggcctgcagggcatggaaacccttcagatagagcaacggcgtggagtatttatccaccgccgggtcgcgcgtgcgcaccgcctgaatatcgcaggcggcggaggcgatcatttccggatcggcggcgtaggcctcttccaccacttcgcgaatggcgatcgccggcataatcggggaagccagcttgttggccagcatatagctcagcgcgctgccgagattttcatgcttgagtagcgttgcgtggtaaaaactggcgagcatcggctcacagtcagccaaagcccgggcttcggctttaatattattccagacgatatccagttcttcacacggcattgcatactccaggcgatatagtaatgacctgccagttctgcgctggcagggtcattcaggtgacaaaggaaagctaattgctactgcgctcgtccttgcgggcgcgacccaataaggtcaatgctgcctcgcgcgcaatttttccgcaatacaatacctgataaatttcctcggttattggcatttcgacacctaaacgctgtgccagaacgcgaacttccttggtattgcggtagccttcaaccacctggccaatcttgtcctgggcactctgcacgtccataccctggccgagcatcatgccgaagcgacggttacgggactggttgtcggtgcaggtgagcaccaggtcaccgaggccggccatgcccataaaggtttccggatcggcgcccagcgccgcgccgaggcgggacatttccaccagcccacgggtaatcagcgccgtacgcgcattggcgccgaagccgatgccatccgacatacctgccccgatggcaatgacgtttttcaccgcgccgccgagctgcacgccgataaagtccgggttgatgtagacgcggaagcttttgccgcagtgcagtaggcgctgaaggtcttccgcaaactgcggatccgtggccgccagcgaaatcgccgtcggcaggccggcggccagctctttggcgaaggttggccccgagatcaccgccagcggaatatcatcgcccagcgcttcacgcgccacgtcctgcagcagacggccggtttcggcctccaggcctttggtggcccacactagccgcgcgtcggaacgcatcagcggtttaatctggcgtaacacctgaccgaatacatggctcggcaccacgacaaggatgtcgcggctggcggccagcgcggtggccaggtcgctctcaagatgcagcgtatccgggaaaggcacatcgggaaggaacgcggcgttgcagcgatcgtgttgcagcgtcgcgatatgtttcgggtcatggccccacagcacaacgtggtggccatttcttgccagggtgatggcaagagcggtgccgtaagagccggcaccgatcacagtcattgcagcattaagtgcgttcatcaggcatcctgatgttgttcagcaccttcgccagcctgctgctgcagatagttcatgaacagcgcgtcgaagttcactggcgcaaggttaagttgcgggaaggtaccgcgggaaaccaggctggtgatgcactcgcgcgcgtacgggaacagaatgttcgggcagtatgcgccgaggcagtgcgccatctgggtgccttcgatgccgtcgatggagaaaataccgccctgctgtacttcacagaggaacgcggtttcttcgcccagcgcagcggtcacggtcacacgcagcaccacttcataaacgccttcagccagctgggtggaggcggtatccagatcaagtttaacttccggctgccagtctttctggaaaacttgcggcgcgttcggcgcttcaaaagagatatctttggtatagatacgctggatctggaaggtcatttcggtgctgttttgttctgacatagtaaaaccctttcgtgttgtccttaaatacgcgcttccgccagggaaagcgcgcaaaaattagcgcaagaggggatcaagtccaccacgtgaatcaagcgcatacaagtcgtcacagccgccaatgtgctgcgcatcaataaaaatctgcggaaccgtcgtccgtccgctgcgctggatcatctcctcacgcttcgcggcatcgccatcgatcggcaactcatggaacgttacgcctttgctgttcagcagcgctttcgcgcggatgcagaacgggcaggtcgctttggtgtagatctcaatattggccatgacttcactcctgttgttaccctgagggttttacgccgcagcctgtgttcccttcacgtcaggcgtgaaggagaaaacgcggcggcatcaccacgcgaggtaagttatttgccgcgtaccagagggaggttttcgccgctccagccagcaatgccctctttcagtacaaagactttttcaaacccggctttgttcagcgcgctggcgggctcttgcgcctgcatgccggaaccgtctaccacaataatgggttgcgatttgtgtttttccaactcgccgacgttattggctttgatatcgctgggcagcaggttaatagcgccggcaatatggcctttacggaaatcgtcacgctgacgcaggtcgaccaccaccgcatcttctttattgataagacgcgtcgcttcaccacgggtgatgactttaactttcgacatcagccccttgaaggtggtgaacactaccgcacccagcagcgcgatccacgcgatgctcaggaccgggtgacggccgatgaattgcataatttcttgcatggggggttacaactcccgactaagtgagaaaaaaaccaggaaaggagtatacctgtgccttgcggcaattacagccagtgagcgcgatgtaatgtattttctgcgggcggtggcgaaaaaaagccgctctcgctgacccggcgcggcccggccgctccctttctttgatctttcacggggatttaaacgattcagctgtagtaaaattacgcaaaatttctgtctttgagcatgaggttgtcgcaatgtcggtttctaaaaaacctatggtactggtgattctggatggctacggctatcgcgaagaccaacaggataacgccatttatagcgctaaaacgccggtaatggacgcgctgtgggccaaacgtccacataccctgatcgatgcatccggcctcgaagtcggcctgccggaccgtcagatggggaactccgaagtaggccacgtcaacctgggcgccggtcgtatcgtctatcaggacctgacccgtctcgatgtggaaattaaagaacgcaccttcttcgccaacccggtactgaccgccgcggtcgataaagcggttgccgccggcaaagcagtacatatcatgggcctgatgtcgccaggcggcgtccacagccacgaagatcacatcatggcgatggtggagctggcggcagagcgcggcgctgagaagatctacctgcacgccttcctcgacggccgtgatacgccgccgcgcagtgcggaaaaaacgctggcgacattcgaagccaaatttgccgcgctgggcaaaggtcgcatcgcgtcgctcatcggccgctattacgccatggaccgcgacaaccgctgggatcgcgtggaacaagcttatgatctgctgaccctggccaaaggcgaattccaggccgataccgccgtcgcgggtctgcaggccgcctacgcccgtgacgaaaacgacgaattcgtgaaagccaccgttatccgcgccgccggccaggccgatgccgcgatggaagacggcgacgcgctgatcttcatgaacttccgtgccgaccgcgcgcgtgaaatcacccgcgccttcgtcaacgccgacttcgacggctttgcgcgtaagaaagtggttaatctcgatttcgtgatgctcaccgaatacgccgccgacatcaaagtcgcctgcgcctacccgcccgcctcgctggccaataccttcggcgagtggatggcgaagcacgataaaacccagctgcgcatctccgaaactgaaaaatacgctcacgtcaccttcttcttcaacggcggcgtagaagagccgtttaaaggcgaagagcggatcctgattaactcgccgaaagtggcgacctacgatctgcagccggaaatgagctccgccgagctgactgagaaactggtcgacgccatcaaaggcggaaaatacgacaccatcatctgtaactacccgaacggcgatatggttggccataccggggtgatggaagcagccgtaaaagcggttgaagcgctggatcgctgcatcgaccaggtggctcaggcggtggaatccgttggcggccagctgctgatcaccgccgaccacggcaacgccgagcagatgcgcgacccggccaccggccaggcgcacaccgcccataccaatctgccggttccgctgatctacgtcggtaataaagcggtcaaagcggtcaacggcggcaaactttccgacatcgccccgaccatgctgtcgctgatgggaatggaaatcccgcaagagatgactggcaagccgctgttcatcgtggaataatccttccccatgaggggaaaggcgatgtattcaactacatggatcgcagcggcagttcgatccgtcctttacgccagcgcgctcagcgctggcgtattgctgtgcgcgtcatctgcgcatgccgacgatcgcgatcagctaaagtccatccaggccgacatcgccgccaggcagcgggcgattaagcaacagcagcagcagcgcgcaagcctgctcgcccagctcaaagcgcaggaagaggcgatcgccgccgcggcccgcaaactgcgcgaaacccaggatagcctgaaccagctcaataagcagattgacgagatgaacgccgctctcgcgaagctggagcgccagcgcgcgtctcaggagcggaacctcgccgcgcagctcgatgccgctttccgccaggggccgcataccggcatccagatggtgctcagcggtgaagagggccagcgcaatcagcggatgcaggtctatttcagctatttcaaccaggcccgccaggagactatcgcggagttgaagaaaacgcgcgaagagatggcggtgcaaaagtcgatgctcgaagaaaaacagagccagcagcaaacgctggtctacgagcaaaaggcccagcaggcgaagctggagcaggcgcgtaacgaacggaaaaagaccctttccggcctggagtcttccattcagcagggtcagcaacaattaagtgaattacgggctaacgaatcgcgcctacgcggtcgtatcgcccaggcggaagctgccgccaaagcccgcgccgatcgggaagcacgcgacgcgcaggcggtgcgcgaccgccagcaggaagcatcgcgcaaaggcaccacctataaaccaacggaaagtgagcgttcgctgatgtcacgcaccggcgggctgggctcgccgcgcggtcaggcgttctggccggttcgcggtccgctccttcatcgatatggcgaacagctgcaaggtgaactacgttggaaagggatggttatcgccgcgtctgaaggcaccgaagtcagagccattgccgatggtcgggtcattctggccgactggctgcagggctatggtctggtggtggtggtcgaacatggcaaaggcgacatgagcctgtatggctataaccaaagcgcgctggtcagcgttggtacccaggtgcgtgccggccagcctatcgcgctcgtaggcagcagcggcggtcagggccgtccgtcgctctatttcgaaattcgccgccagggtcaggcggtcaatccacagccgtggttgggaagataagttttgcttcaatttcgcgcaattgctcttgccgtagccggttcgctggctctggcggcgccagcgttcgctggcaaactctccatcgttattgacgattttggctaccgcccgcagaccgagaatcaggtgctggcgctgccggcaactatctccgtcgccgtgctgccgaacgcgccgcacgcccgggaaatggccactaaagcgcataatcagggccatgaagtgctcatccacctgccaatggcgccgctcagcaaacagccgctggaaaaagacaccctgcgtcccgaaatgagcagcgaggagatcgagcgcattattcgcgaggcttacggcaaagtcccttacgccgtcgggctgaataaccatatgggcagcgcgatgacctccaacctgtttggcatgcagaaggtgatgcaggccctggagcgctacaatctctattttctcgacagcgtcaccatcggcaacacccaggccatgcgcgccgcgcagggtaccggcgtgaaggtgattaagcgcaaggtgtttctcgacgatacgcagaatgaagccgatatccgcaaccagttcaatcgcgccatcgccctggcgcggcgcaacggttcggcgatagccattggccatccgcatccgacgacggtgcgggtgctgcagcagacggtctataacctgccgccggatatcacgctggtgcgcccgagcagcctgctgaacgagccgcaggtcgacaactcgacgccaaactacgcccagccgcccgcgcaacaaacgcagcagaagccgcgtaatccgttccatggcgtgaagtcttgcaaaccgaagcgcccgctggagcctgtgaacgccagccgcttcttcactatcctcagcgatagcatcagccagagcgcgctgatccagtactatcgcctcaaatggcagggctgggacaaccccggcaactagaccactcaggggtccgttcgcttttgcgcgacgggcgcctggttatcttcgtgggcgtaccacgccttaaaatatttcagaaagctgtaaaacgtcgcgtacaggccggtcaccacgccgaccttgccatagcgccacgccccgctaaacagataccacttaaagaaagcgccaatggcgctgacgatcccccgcgtcagcgaaggtttgatctgctggtacttcaccagccgggtggtatagctgttcagcttattaaacacttcatgcagcgaataaaaggtatcgtggcgaacgaagcccggcagcctgacggagctcgcgtgtccgaccacctggtcatccaccggccgatcgttaaaccgcgcctgctggcggttaaagaggcgcaccggataatccggtgaggaaatggggtagatagtccgtacctgtttgcctagcacaaaccagtagcgcggcagacgccaggcgcaggtcgggtcaggctcctcccccgcttttagcgcctgaatggccgtcaccacgtcattatcaagaatttcgtcgctgtccatgcacagcacccagtcatggctggccagcccgatggcatagttcatttgcgcgccgtgggctttataggcatggtgatggacggtgagaccaaactgctggcaaatagcgacggtttcgtcggtactgccggagtcgacgacgatacattcatcggccaccttcagcagaggcggcagcacctccatcagcaggcgcgcagagttacaggtcagtaagcatacggagagtttaagcatgatagttacaaagttaaactgcgactaaacacactgtataagcgaataaccgtaaaatcgatgtagaaattgtgcgcttaatattaagcaggctaaaaatgttatccaaatctaaattaaggcgcccgcaggcgccttttttgctgatttttacgccagcatgggggattagtcccagctcaaaaccactttaccggactggccggagcgcatcgcgtcaaaacctttctggaagtcatcaatgccgaagcggtgggtgatgatcggtgagagatccagaccagactggatcagcgccgccatcttgtaccaggtttcgaacatttcgcgaccatagatacctttgataaacagccctttgaagatgaccttggtccagtcgatggacatatccgacggcgggatacccagcatcgcgatacggccgccgtggttcatggtatccagcatgctgcgaaaagccggcggcgcgccggacatctccagacccacatcgaaaccttcggtcatccccagctcggccatcacgtcattaaggttctctttggccacgttcaccgcgcgggtaacgcccattttgcgcgccagctcaagacggtactcgttgacgtcggtgatcaccacgttacgcgcgccgacgtgtttcgctaccgccgccgccatcacgccaatcggaccggcgccggaaaccagcacgtcttccccgaccagatcgaaggagagcgcggtgtgcaccgcgttgccgaacgggtcgaagatagacgccaggtcatcagagatattgtcggggattttaaaggcgttaaaggccgggatcaccagatactcagcaaagcagcccgggcggttgacgcccacgccgatggtgttgcggcacagatgggtgcggcccgcgcggcagttacggcagtggccgcaggtgatatgcccctcgccggagacgcggtcgccaatcttaaaaccacgcacttcctgaccaatccccaccacttcgccgacatattcgtgaccgaccaccatcggcaccggaatggtcttctgcgaccactcatcccagttgtagatgtgcacgtcggtcccgcaaatggcggtcttgcggattttaatcagcagatcgttatggccgacttccggttccggtacgtcggtcatccagatgccttcttccgctttcagtttggataacgctttcatctcatacccttattaggcgatgacgcccagttgtttgccgatgcgggtaaaggcttccaccgcacgctcaatttgttcaggggtatgcgccgccgacatctgggtgcgaatacgcgcctggcctttcggtaccaccggatagaagaagccggtgacatagatcccttctttctgcagctcgcgggcaaagttctgcgccaccaccgcctcacccagcatcaccggaatgatggcgtggtcggcgccggccagcgtgaagcctgccgcggtcattttttcgcggaacagacgcgcgttagcccacaggcgatcgcgcaggtctgccccctcttcaaccatctccagcactttgatggaggcggccacgatggccggcgccagagagttggagaacagatacggacgggagcgctggcgcagccactcaaccacctctttgcgcgcggcggtgtagccgccggaggcgccgcccagcgctttacccaacgtgccggtgatgatatcgacgcgccccatcacatcgcagtattcgtgggagccgcggccgttttcgccgacgaagccgacggcgtgggagtcatcgaccatcaccagcgcatcgtatttatccgccaggtcgcaaacgccttgcaggttggcgatcacgccatccatcgagaacacgccgtcggtggcgatcagcacgtgacgcgcgccggcctcgcgagcttctttcagacgcgcctccagctcttgcatatcgttgttggcatagcggaagcgcttcgctttacacagacgcacgccgtcgatgatcgaggcatggttcagggcgtcggagataatggcgtcttccgggccgagcagcgtttcaaacaggccgccgttggcgtcgaaacaggaggagtagaggatcgcgtcttccataccgaggaaatcggccagcttcttctccagctgcttatgcgtatcctgggtgccgcagatgaagcgtaccgaggccatcccgaaaccgtggctgtccatgccggatttcgccgcggcaatcagttccgggtggttcgccagacccagatagttattggcgcagaagttaatcacgtggctgtcgccgacggtaatgtccgcctgctgcgccgaggtgatgatgcgctcttctttgaacaacccttcggcccgagcggtctccagattgctagttaactgtttgtagaaatcaccacgcattgcaactctccagattcggcaaaatttggcacatattacccaaagctatacgctgatacgagatgatgcaggcctgaatgaattatttgcagcataaatcacgtcagcccagcaccttattctgcgaatggctgtaggcttgctcatgtggtgatatgataagagcattcatgtccggattgtctccgggctctcaacttcaaaggtacagttatgatcatcgttaccggcggcgcaggctttatcggcagcaacatcgttaaagcgctgaatgacaaaggcatcaccgacattctggttgtcgacaatctgaaagacggcaccaagtttgtaaacctggttgacctgaacatcgctgactacatggataaagaagactttctgatccagattatggcgggtgaagagttcggtgaaatcgaagcaatcttccacgaaggcgcgtgctcttccactaccgagtgggatggcaagtacatgatggacaacaactatcagtactccaaagagctgctgcactactgcctggagcgcgaaatcccgttcctgtacgcctcctccgcggccacctatggcggacgcaccagcgacttcatcgagtcccgcgagtacgaacagccgctgaacgtttacggctactccaaattcctgttcgacgaatacgtccgccagatcctgccggaagccaattcgcagatcgtcggcttccgctacttcaacgtctacgggccgcgcgaaggccacaaaggcagcatggcgagcgtcgctttccacctcaatacccagctgaataatggcgaaagcccgaaactgttcgaaggcagcgacggcttcaagcgcgacttcgtctacgtgggcgacgtggctgacgtcaacctgtggttctgggaaaacggcgtttccggcatctttaacctcggcaccggccgtgcggaatccttccaggccgtcgccgatgcgaccctggcataccacaaaaaaggcagcatcgagtacatcccgttcccggacaaactgaaaggccgctaccaggcgttcactcaggcggatctgactaacctgcgcaaagcgggctatgacaaaccgttcaaaaccgttgccgaaggcgtaacggaatatatggcctggctaaaccgcgacgcgtaagaaacaagcatgaaaatattggtggtaggcccgtcttgggtgggcgacatgatgatgtcgcaaagtctttatcgtacgctcagggcgcgctatccccaggcgattatcgacgtgatggcgccagcctggtgccgtccgttgctttcgcgcatgccggaagtgaacgaagcgatcccgatgccgctgggtcacggcgcgctggctatcggcgaacgccgtaagctcggccacagcctgcgcgaacgtcgctacgatcgcgcttacgtgctgccgaactcgtttaaatcggcattagtccctttctttgccaatatcccgctgcgcaccggctggcgcggcgagatgcgctacggactgctcaacgacgcccgggtactggacaaagacgcctggccgctgatggtggaacgctacgtggcgctggcctacgacaacggcgtgatgcgctgcgccaaagatctgccgcagccgctgctgtggccgcagctgcaggtcaacgaaggggaaaagtcgcaggcctgcagcgcctttaacctgtccaacgatcggccgatcgtcggcttctgccccggcgcggagttcggcccggccaaacgctggccgcactatcattatgctgcgctggcgaaaaagcttatcgacgatggctatcagattgcgcttttcggctcggcgaaagataacgaggccggcaaagagatcatcgccgccctcagcagcgagcagcaggcctggtgctgtaatctggcgggtgaaacccagctggagcaggcggtcattctgatcgccgcctgtaaagctgtagtgactaacgattcggggctgatgcacgtcgccgcagcgctggaccgcccgctggtggcgctgtatggcccgagcagtccggactttaccccgccgctgtcgcataaagcgcgggttatccgtctgattaccggctaccacaaggtgcgcaaaggcgatgccgccgaaggctatcatcagagcctgatcgacatcaccccagaacgcgtcctgcaagagctgaacgaactgttagcggaaaaaaccgagcacgaggaagcgtaacggatgcgggtattgatcgttaaaacctcctccatgggcgacgtgctgcacacgctgcccgcgctaaccgacgccgcgcaggctatccccggcatccgcttcgactgggtggttgaagagggtttcgcgcagatcccctcctggcataaaagcgtcgagcgggtgatcccggtggcgatccgccgctggcgcaaagcctggttctccgcgccgatcaaagccgagcgtcaaacctttcgcgaggccgttcaggcggtaaagtatgacgccatcatcgacgcccaggggctggtgaaaagcgccgcgctggttactcgcctggcgcacggcgtcaagcacggtatggactggcaaacggcccgcgagccgctggcgagcctgttttacaaccgccgccaccatatcgcgaaacagcagcacgcggtggagcgtacccgtgagctgttcgccaaaagccttggctacgcgaaaccccagacccagggggattacgccattgcgcgccatttcctgcagcacgaggctagcgctgccgcgccctatctggtgtttctgcacgctaccacccgcgacgataagcactggccggaaacccgctggcaggagcttctcgatctgctggccgacagcggcgtccacattaagctgccgtggggggccccgcacgaagaggcgcgggcgaagcggctggcggaaggccgggagtatgttgaagtgctgccgcgcatgagccttgagcaggtggcgcaggttctggccggcgcccgggccgtcgtctcggtcgataccgggctgagccatctgaccgccgcgctggataaaccgaactttacgctctacggcccgaccgacccggggctgattggcggatacggtaaaaaccagcatatcgtgcggccggaaaacagcgccagcaccggcgatattgcggccagccggattcatcttctcctgcaaaatcaggggctgctctgatgggatccctgtttaagcagatctaccgctatacgcgccctcgcgcgtatcgccacaatgaaaatctgtggccttttacccgtattgcgcgtgcgccaagcggcgaaatcagcgcgttacgctataaagggaaaacggtgccgctggtcagcctgagcgcgctgaaaaacagtatgcagggcgaagtcctgctgaccgccaccggcccctcaacccgcaatatcgatttttccctgttgtcgaaaacgatcccggtgatgggcgtcaatggcgcctggcatcttgccgaccggctgcacttttcgctctataccatcgtcgacatggaatttttcgataagaagccggacattatccgcgccattgtcagccagccggatattttgctgttcaccaccatgcacgggatcgccaaaatcgtcgatcgctatggggacgcgctgcgctgccgtttggcgttgattgaggacggttgctataagatttaccagccgaaagtcgccagcgaagcgataaagcgcacttaccagcagaatgcggcgatgtgctttcatcctcagcgcccggatatctgttttagcaccgatattcgccagggcatctttgatgccggcacggtggtctactgggcgctgcaaattctcgcctggctgggcttcaatactatcctggtgagcggcctggatatgaccaactttaaccagccgcgattctacgaaacacaacaagaaaaattgccttcttacctggcaacaaaagtggataccctcgtcatgccctcctttgcgcatgccgcgcaggtactgcagcaacgccagattcgggtgattaatttttccccagaaagcgctgtgccggatactatcttcgaaaaggttgcgtttaatgagtactttaaaagtgagtaacttcgccagacagggttactcgattgtctttcctttgtttttatttttcagcgcgattttttgcatgtccacccggaccaataatctgctgcatttatcgatcctgctgctattgctgtcgctggtacgccaggaaaaccgccaggcgctggccggggtgttacgcgagcagtggcagacctggacgctgctggcggctttctttatctattacgccctcagtaatgtgtggggccatacgccgcagcatattgactcgccgatcacccacggcgtgtatctgaccgggtatctgttgctgatgacgatgctgctcagggacggacgaacccgccgactggcgatgctggcggtggtcggtgggatcaccgtgctctccctgtggacgctgattatcgaccatacgctggttctcaccgaacgagcggtctcccccgagaaccccggaccaacgaacgttatcgaccttgccggttactgcggcatcggcattttaatctgcggcatgctactgaaagaaaaagccagccactggctctatctgccggtggtcatcatgctggtgatgctgctgctcacccaaagccgcgggccgatcatcgccctggtgctggcggtcggctgtacgctgcacctgcacgtcttcacccgccgcaacctgctgatcgccgcggcgctggccgtgctggtagcgctgcttttggtcatgacgccggtgggcgacatgctgctcgcccgtttcgaggagctgggcacccaaagcgggctgcgcctgagcatctggcaccatacgctgtcggagatggccagccagccgtggctggggcgcggtttcagctatgaactggatttcatcaactacagcggcgagcacatcaccaccacccacagcgtgtatatgggcgccctgctgaaaggcggcatcgtggggttactgctgctgttggcgatcattgcctgcgggctatggcaggcgtggcgcaagcgccataccgacagccgctacagtctggcgatcctgttttacgcgctggtgtttatggcctcgcaggggatgtttatcatcagcaatccccgggaaacctgggtgctgttctggctgccgctgggcattgcgctcagcaaagggttggcggaaaaacgctaacaaaaagggccgtcagcggccctttttatattaactttttaaattaactgcgggcggcgaccagccggtcggcctgctctttaatcacgggccacaccgactcaatcgccacatcggcgacattcgcttcttcacagactatctgcttcgccttgtcatagcccggcgcccagatgtgatagccgggcagcccggtattcttgagtttgcgtttgttatagaccgccaccatcggcttatcgaaagcccgggcaatatgcacgatcgaggtgtccggcgtaatgactaaatcacagctgcggatcacttctacggcggagttgatggtgctgtcggcgatgtacagcgccatatccagccccagctggcggattttttcactgcgccccaccatcacgatacagacccggtaaggcagagcatgtagccgctcgaccagggtcgccacctggtgacgacagaagtctttatcctcggaggcggtaaaagggttaatggcgatacgcagttcgacctctccggcctgagaaagcaagcgggccactttctcccgctcatggcggcagccggggagatgatagtgatacgggcggtcgtcaacgatgccaaacagcttcaccacctgcttatagcgcagggaaatatggctgttgccgtcaaaaaaagcgattgagtgatcgtaaagtttatagggctctttattaaaaccaatcacgctggtcgcccgtaaatcggcgagtaatttaaagcgttcatagctggtcacgtcatcaaaatcgataaccgcatcaaaacccgccgcccgcaacgtatttaaggacatgcggggccgatataaatatacttgctgaatgaattctgagcctgctaatatttcgctgcatattggtccggttaacaccgaaacctgatatccccgttcggccagtattctggcgcagccggtcgtgaccaccatatcaccgactttatcatccagacgcaatagcagcacgcggcgcacagccgctgggtcgaaggctttacgcgccggcttatttctgtatcgatagttaattaaattaaatttaatgccgcggaaaaaagcattctttttccgcgttaattgtttaaggatacgcatacggtaccttgagctgtgttagcgctgtgtaattttccgctggtaatattctgccaacgtcatgcccttcacctgcggcgccagccagctaaaaaaggcttcgaggtcagcgtataaacgctcaatatcccgttcattctggaacgtggggctgccgccgggcatatactctgaagagtggagcatatattccacgtagtcattgccctgcgtcaacgtttgttcgacgacttttttcatcgtctccacattgccgcccatcggtcgcagccagtgtacggagggggaacgcactttgccgcgcaggcggtcgtagccctgcttcacgctgttcatccacgctgagtgcttgtactggatgctcatcggcacttccagcagcggcgagtggccctcgcggctgatgtcattttcatcgaggaaataggcatgctgcggaaagcggcgataatcggtcccgccatcgccctgcggcgcccccttggcggtcttccagttcacccgcggggtcaccgagcaatccacctgatacccgtactctaccagcagacgcgcatagcgctcgtcaaaagcccagcgcccggcgcgatggctaaccattttggtctggaaggtatcctccagcagacgcgtcatatagtcgaccttctcacgcatcatagcgtcgctgtattcaataagataaggcttatggcgccagtcatctgcggtcagcggctcggtcggcgggctgttccacgcatgcagatgcatgccgacttccgcggtgccgcgggcaatcacgtctctggcgaattcgatataaaaggggtcgatggccatttcatagttggtcaaatagaccggtttaaagccatacttttcgcaaagctgctgaaaacgcggaagataacgcgcattctcggtggtgatgctgtcatgtttttgccagaggttatcgccctctgtatcaatcgtgatgagaaatgcgggattgtgcacgaaaacgtcctcaggccatacgtatcgggtcatggtagagcaatacaacgcttctctcaatctgtctgatcccctagaatcggaacccttatcctggatgaagaacagagtatgacgcctgaaaccctctcccgcggcccgttgaacccggcgcggatcctggtcattaagctgcgccatcatggcgacatgctgctgatcacgccgcttattcacgcgctgaaacagcagtaccccgccgccagcgtggatgtcctgttgtatgaagagacccgggatatgctcgcagccaaccccgatatccaccatatttatggtctcgatcgccgctggaaaaagcagggaaaaaggtatcagctgaagatgcaatggcagctcattcagacgctgcgccagcagcggtacgatatggtgcttaacctggccgaccagtggccgagcgcggttatcagcaaactgaccggcgccgcgacgcggattggttttgattttccgaagcgccgccacccggtctggcgctattgccacaccgcgctggcctccacccaacagcacaaccagctgcatacggtacagcagaatctctctattctcgctccgctcggtctccagttgaacgatgcgccggcgcggatgggctacagcgaagcagactgggccgccagccgcgccctgctgccggaggacttccgggaacactacatcgtcatccagccgacgtcgcgctggttctttaaatgctggcgcgaagatcgcatgagcgccctgatcaacgcgctgtccgccgaaggatacgcggtggtgctcacctccggccccgatgctagagagaagaagatggtggataccatcatcgccggctgcccgcaggcgcgactacactctttagccggccagttaacgttgcgccagctggcggcggtgatcgatcatgcccggttgtttatcggcgtcgactcggtgccgatgcatatggctgcagcccttggcactccgctggtcgccctgttcggcccctcgaagctgaccttctggcgtccgtggcaggcgaaaggcgaggtgatctgggccggcgacttcggtccgctgcccgatccggacgctatcaacaccaacaccgacgaacgttatcttgatttaattcctaccgacgccgtgatcgcggcggcgaaaaaggtactagcatgagtaaattcaggctggctctggtgcggcagaagtaccgcccggacggcggcgcagaacggtttgtctcccgcgcgctggaagccctcgacagcagtcatttgcaactgaacgtcatcacccgcgaatggcaggggccggtgaaaccggactggcagatccatatctgtaacccacgtaaatgggggcgcatcagccgcgagcgcggctttgccaacgccgcgcgcgagctctggcagcgcgagtccttcgacctggtgcagagccatgaacgtattcccggctgcgatctctaccgcgctggcgatggcgttcatcgccgctggctgcagcagcgctcgcgcattttaccggcctggaaaagccgcctgctgttcgccgaccgttaccaccgctacgtcatgcaggcggaacgcgagatgtatgaagactcacacctgcgcggggtgatctgcaacgccgagatgatcaagcgcgagattatcgaagactttggcctgccggcggagaagatccacgttatttacaacgccattgacaaccagcgcttcctgccgccagacgaagagacctttgccgccttacgcgccaaatggcagctgccgctgcaggcgacctgcctgatctacgtcggctccggctttgaacgtaaagggctggcggcggcgattcgcgccatcgcccctaccgatcgctacctgctggtggtcggcaaagataaggatcagcctcgctatcaggcgctggcgaagagcctgaactgtgaagcgcgggtgcgcttcttcggcatgcagtcggagacattgcccttctatcaaatggccgatggtctgctgctgccgaccctctacgatccgttccccaacgtcatcctcgaggcaatggcctgcggtctgccggtgatcaccaccaccggctgcggcggggcggagtttatcgtcgacggccacaatggttacgtctgcgacgctctggatatcccggcgctacagcaggcggtaatggccctgcccgcgcgcgcgctgggctccgcggaaggcggtcacgcccgcgagcgcattatggcctgcaccagcgagcgactctcaacccagctgctttctctttatcaggatctggtgaaataacgatgcgcatcttatttgtgattgacggtttacccggcggtggcgcggaaaaagtggtcctgaccctggcggcacagttcctgcgcgacggcgatcgggtgtcgctcatttcgctgcgcgatgtctgcgagtacccattgcccgaggggctcgactaccaggtagttgccgatcgctgccgtaaaccgtggcgcaagctgaccgagctgtcccgccgcgcccgccagctggatgccgcggtcgtgcgggccgaacagcaggggcaatttgaccttgtgctctccaacctgcacaaaaccgaccgcatcgtcgcccgcagccgggcgctgcgcgagcgtaacgtctggttctgtctgcacggcgtattctctgcctcctatctcgggcaccgcaccggctttgaccgctggatgaagcagcagaaaattaagcgaatttatcagggtcgcaacgtggtgacggtttccgacgcggtggggcgagatctggtggaagagtttgccctgcgcccggcacagctgaaaaccatctacaatcccttcgatatcactgccctgcgcgccgaggcggaagccgatagcgagcgcccggacggtgactacctgattcacgtcggtcgcttccatccgggcaaacgccatgaccgcctgcttgaagcctatgcgcagagcggcatcgacgcaccgctggtgctgctaggccagggaaaaccggagcaagagcagcgcctgcgccagctggcaaaaacgctgcacattgacgatcgggtgtggttcaaaggttttcagaaaaaccccttaccgtggatcaaaggcgcacggatgctggttttgagctccgatagcgaaggattcggcaatgtggtggtggaggcgctgctgttacatacccctgtcgccagcacccgctgccccggcggcgtcaccgagatcctcaccggcgaacttgcccgcggtctggcggatctgaccagtccggcgctggctcagacgatgcaaagcatttaccataacccgccggccatcgacgatgccgcgctggaaaaattcagcgtcgtatccatttgtcagcagtaccgtcagctgcagcgcacctgacgccgttagttaaccaggatcgaagatttatgagtcaaacgcctttattgagcatcgtggctgccgtctacaacggtgagaaatttctagcgcaattctttgagtgcattgaacagcagcagctggacagctatgaactgatcctggtgaacgatggttcgacagacaacagcctggcggtgatcgccgaatggcaggagcggctgcagaacgtccaggtgctggagcaggaaaaccagggcgtctcggtcgcgcgcaataccggcctcgccgccgccagcggcaaatatctcgcgtttccggatatcgacgacaaactctatccgggcatgtatcgcacgctgctggagatggccgagaaagaacatctcgatatcgccacctgcaacggcacctatgtgtacgaaaagcgccgcgagagccacccgatcttcccactggatcgcctgccctcgacgggtgtgctgccgggccatgtctggcttaagcaggccttggactcgcggaagtttctgcacgtcacctggcttaatatttatcgtcacgactttatccgccagcatcacttccatttcgagcctggcctgcgccatcaggatatcccatggaccacagaagccctgctggccgcggagcgcgtgcagtacaccagtcagcagttctatgattactacattcactctgagtcggtgtcgcataagccggacaacgacgacacgctgatgcgttcggcgcgccactatatgaagattctggagatgctggaggcgattaaccagcgctacccggataaagtacgccatatcgccgcctgtcgctggcagatcgccaaagaaggcctggggatcatccataccttcgatagcatgaaagatgagtccaaaaagcatgttattattaacgaattcttcgaccgcggtatctggcggttaatctggaaaaacgcctgtactttccgtttacgctggcgcctgggacgccgttatctgcgtattaagcgttatcgccacgcgggatagaccaaaaacccgctgtttccgccaaagagatagctttacgcgggctaaatgcttagaatttgcccgccaaaacagagaacggataaatagtttggaattgctttataccaccctactttaccttattcagccgctggtgtggctgcggctgctgctgcgcagtcgtaaggctcctgcctatcgcaaacgctgggcggaacgctatggcttctgtcagaacaaggtagagccggatggcattctgctgcactccgtttccgtcggcgagaccttagccgccattccgctggtccgcgccctgcgccaccgctacccttctctgccgatcaccgtcaccaccatgacgccgaccggctccgagcgcgccatgtcggcgtttggcaaagatgttcatcacgtctatctgccctacgatctgcccggcgccatgaaccgcttcctgaacaccgttcagccgaagctggtgatcgttatggagaccgagctgtggccgaatatggtggccgcgctgcataagcgtaagatcccgctggtgatcgccaacgcgcgcctgtccgaacgttccgccaaaggctatgccaaactgggcggctttatgcgccgcctgttgagccgcattacgcttatcgccgcgcagaatgaagaagatggtaaccgcttcctctctctggggctgaagcgcaaccagctggcggtcaccggcagcctgaaattcgatatctccgtcacgccagagctggcggcccgggcggtgacgctgcgtcggcaatgggcaccgcaccgcaaggtctggattgccaccagcacccacgacggtgaagaacaaatcatcctccaggcgcataaaaaactgctggagactttcccgaacctgctgctgatccttgttccccgccatccggagcgcttccctgacgcccgtgagatggtacaaaaggctgggatgagctttactctgcgcagcaccggcgagatcccctcctccagtacccaggtagtcattggcgataccatgggcgagctgatgctgctctacggcattgccgacctcgctttcgtcggcggcagcctggtggagcgcggcggccataacccgctcgagccggcggcgcacgccattccggtgctgatgggaccgcataccttcaatttcaaagatatctgcgccaagctgcagcaggacgatggcctgatcaccgtcaccgacgcgaactcgctggtcagggaggtgtccacgctcctgaccgatgaagattaccgcctgtggtatggccgtcacgcggtggaagtgctgcaccagaaccagggcgcgctgtcgcgtctgctacagttactgcaaccttacctgccgcagcggagtcattaatgtctaaccggctttccgtggtgatgatcgccaaaaacgcagcggacctgctgccggattgtctggactccgttagctgggcggatgaaattatcgtcctcgactccggcagtactgacagcaccgtcgagctggcccgccgcctcggcgcccaggtctatacccataccgactggcgaggctatggcattcagcgccagcgcgcgcaggattacgccaccggcgactgggtgttgatgatcgataccgatgagcgcgtcacgccagaactcaggcaggctattcttaaggtactggacgccccccagcgcggcgccatctacagcatcgcccgccgtaactattttctcggacgctttatgcgccacagcggttggtatcccgatcgcgtcctgcgcctgtacgaacgcgcccgttaccgctataacgataatctggtccatgaatcgctggatagcctgggcgccgaggttattccgctgaccggcgatctcctgcacctgacctgccgcgacttcgctggtttccagcaaaaacagctggcgtatgccgccgcgtgggcgcttgagcgtcaccagaagggcaagaagacctcgatggcagggattttcagccatacgctgggcgcgttcctcaagacgttgctattgcgcggtggggtgctggacggtaaacagggatggttactggcgatggtcaacgcgcagtatacgtttacgaaatataccgagctgtgggcgctgagccacggctactcggagaaagagtcatcatgagcacaaaagcgatctatccgggtaccttcgaccccatcaccaacggtcatatcgatattgtcacccgcgcggcaagtatgttcgataaagtggtgctggctatcgccgccagcccgagtaaaaagccgatgttcagccttgatgagcgcattgcgctggcagagcaggcgacggcccacctggtgaacgtggaggttatcggcttcagtgatttaatggccaatttcgcgcgcgcgcagcaggccaatatcctgatccgcggcctgcgggcggtggcggatttcgagtatgagatgcagctggctcatatgaaccgccacctgatgcccacccttgagagcgtgtttctgatgccgtgcaaagagtggtcgtttatctcttcctcactggtgaaggaagtggcgcgccaccagggcgacgtttctcactttctgccagctaatgtgcatcaggcgctgttgaataagctgaagtaacgcatctgccgggacatgagccacgtcggctggcgcagcactgcgccgctgggtcattcacaccggctctgtcccggtctttgtgccagatggcgctacgctgacctggcctacaaacgcccccggcccaccagatgcgcacccgcaggcccgctgacctggccgacaaacattcctgttcctgagaactacttctggcactgacggcaataaaaggtcgcccgctgggcatgtttggtcccgacgaccggcgtgccgcagatccggcagggttcgcccttgcggccatagacctgtagctcctgggcgaaatagcccggcttgccatcgctttgcaggaaatcctttaacgtggtgccgccctgctctatcgaacgcagcaggaccagcttaatcaccttcaccagctgctcacactcttcccgcgacagcgaggacgccagccggtcaggatggatcccggcggagaacagcgattcactggcgtagatattccccacgcccaccaccagcttgttatccatcagccagggtttgatcgcggttttcttcttcgcgcatttttgctggagatagtcggcgttgaacgcgtcgctgagcggctccgggccaagatgggccagtaccggatggccttccagcgttctggtccacaaccaggcgccaaagcggcgtggatcggtgtagcgcaacaccttgccgttactcatgaccaggtcaacgtgatcgtgtttttcagcaggcagctcttcgctcaggatgcgcaggctccccgacatcccaagatggacgatgatccagccgtccggcagctccagaagcaggtatttggcgcggcgacgcacgctgagaaccggaacgtcgctcaggcgatagatctcttcggaaaccggccagcgcagccgtccgttgcgcacgacggcgtgcagaatggttgcgccaaccaggtgcggctcgatgccgcgacggctggtttcaacctctggtaattcaggcatgattttcctccgtttacccgacgtattgtgcttcacggacagatgactgaaaagggagtatgtgaaagcaatatgggggagttttaaaaacaaaaaaccccgccgaagcggggtttttatacaaggaggctaaaattatttaattttagcttctttgtagataacgtgctgacgtacaaccggatcgtactttttcagttccattttttccggtttggtacgtttgttcttcgtggtggtgtagaagtgaccagtaccagcggaagaaaccagcttgattttctcacgaatacctttagccatgatttatttcctctaagtacttagtacttttcgccacgggcacgcagttcagccagaactgtatcgatgcctttcttatcgattacacgcatacctttagcagatacgcgcagggtgacaaaacgcttctcgctctcaacccagaaacggtgagagtgcaggttcggcaggaaacggcgtttagtcgcgttcagtgcgtgggaacggttgttaccggtcaccggacgcttgccagtaacttggcagactcgggacatgtctattctccaaaaatcaaattagctcgagcttcgtatggggtattggcgcctcgtcaggctttacagcctggtcatcgcagttcaatgtgaactctcgactgccaggcccaaatgccaaacccgagattctcaaaggtggcgtagtatacgctgactcggcgatgtgctcaagtcccgaacagacaaagatcccgaaggatcgccagttcggggctaaatccagccacgttcggcaaaagatacatacgcaccgcggccgataaccagatgatcaagcacgcgtatctccatgaatctacaacattttatcaccctttcggtaatcagtctgtcggcctgacttggctccgggctaccggagggatgattatgcgcaaggatcacggcggcggcgttcactttgatggcttcgcgtacaatttctcgcggatgcacctcaacgtggctaagagtaccagaaaaaagacgactatgtttcaacacccggttctgattatctaaaaagatcaccataaagatctcgcgctcctcttccgtcagctggctttgtaaaaactcgcgcgtcatcgagggggtgaccagcgcggcctcctcgaccagctgcgagctaaaatagcgtcgcgccagctcggcaatgcccttcagttgggcatatttcgccagccccagtccgtctacagcaatcagttgcgctttatcagcggaaagcagagcgtagagtgagccaaaacgctgcagtaacgcctgggcatagctgagcacatcctgacgacgcgtgccgacgcgcagaaacagcgccagcagctcaacatccgttagcgtttcgatgccgtattgcagcatcttctcccgtggcatcagattttccattccgtccatgcgccctcctgggtgaatcagcctatcctggcacagcctgacggcgctgccgacccgccgattttcaccctgcgtagccgctcgcaaagtgaatgcccggcagaggcacgacggcggcaggattgtgataagatgcgcggattctggtctacggcaacaggaagacatcatgatgactctggcgggtaaaaaaatcgtcctgggcgtcagcggcggcatcgcggcgtataaaaccccggaactggtgcgccggctgcgtgaacgcggcgcggaagtgcgtgtcgcgatgacggaggcggcaaaagcgttcatcaccccactcagcctgcaggcggtatccggctatccggtttccgacagcctgctcgatccggcggcggaagcggcaatgggccatattgagctcggtaaatgggccgacctggtgatcctcgccccagcgaccgccgatttaatcgctcgcgtggcggccggcatggccaacgatctggtgtcgacgatctgtcttgccaccccatccccggttgccgtggtgcccgccatgaaccagcagatgtatcgcgcgcaggccacccagcataatctgcagacgctcgctacccgcgggctgctgctatggggaccagacagcggtagccaggcctgcggcgacgtcggcccggggagaatgctcgatccgctaactatcgtagacatggccgcgcagcatttcgcctcccctgtcaaagatttgcaacatctcaacctcatgattaccgcgggcccgacccgtgagccattggatccggtgcgttatatcaccaaccacagctctggcaagatgggcttcgcgattgccgccgccgcagcgcagcggggcgcgaacgtgaccttgatcagcgggccggtatcgctaccgaccccgccgtttgtgcagcgcattgatgtcactaccgcgctggagatggaagcggccgtccaggctggcgcccagcagcagcacatttttattggctgcgccgcggtagcggattaccgcgccgccgtcatcgccgaagataaaataaaaaaacaaggtgatgaattaacaataaaaatggttaaaaacccggatatcgtggccggggtcgcggcgctaaaatcacatcgcccctacgtcgttgggtttgccgccgaaacgaataatgtggaagaatatgcgcggcaaaaacgtgcccgcaagaacctcgacctgatttgcgccaacgatgtttcccagcctaatcagggctttaacagcgacagcaacgcactacaccttttctggcaggatggggaaaagcgcttaccacttgagcgcaaggaactcctgggccaattattactcgacgagatcgtgacccgttatgatgaaaaaaatcgacgttaagattctggacccgcgtgtcggccagcaatttccgctgccgacctatgccacctccggctccgccggacttgacctgcgagcctgtctcgacgacgccgtagagctggcgccgggcgcaaccacgctgttgccgaccggccttgcgattcatatcgccgatccctctctggcggcggtgatcctgccgcgctccggcctgggtcataagcatggcgtagtcctgggcaacctggtgggccttatcgactccgattaccaggggcagctgatggtgtccgtctggaaccgcggtcagcagagctttattatcgagccgggcgaacgtatcgcacagatggtctttgtgccggtcgttcaggcggaatttaacctggtggaatccttcgatgccaccgaccgcggcgaaggcggcttcggtcactcagggcgtaaataagcccagcaacacggaatctgcatcccaacgcgcataacgcaataacattaccgcaagccctggtttgcggtcgcgttgtggatgtctgcctgacaagtgcttattttcaggggtattttaaaacatggcagaaaagcaaactgcgaaacggaatcgtcgcgaagaaatacttcaatctctggcgctgatgctggaatccagcgatggtagtcagcgtattaccaccgcgaaactggcggcttccgtcggcgtctctgaagccgcgctgtatcgccattttcccagcaaaacccgcatgtttgacagcctgatcgagttcattgaagacagtctgattacgcgcatcaatttgattttgaaagatgaaaaggacaccaccgcgcgcctgcgcctgatcgttctgttgattcttggctttggcgagcgtaatcctgggctgacgcgtatcctcaccgggcacgcgctgatgttcgaacaggaccggcttcagggtcgcatcaaccagctttttgagcgcatcgaagcgcagctacgccaggtgatgcgcgagaaaaaaatgcgcgaaggcgaaggctacaccctcgacgaaaccctgctggccagccagctgctggctttctgcgagggcatgctgtcgcgctttgtgcgcagcgagttcaaatatcgtccgacggatgatttcgacgcccgctggccgctggtcgccgcacagctgcagtaaatcctcacatgcagccgccaggctgcatgattctcctcgcaatctgcgtaagtttgtcgcaaatcccagggccattggttgaattgcccaatgcgcgtttccgctttcctttcctactatccagcttgctgaacatttcaccctcccccaacaccacccgacaaggagagatttgatggcgacgtcacggcgggatttactgaagataggcgggttggcaaccgcatcgctactggtcagtcaaaaaagcttcgcagcatgggccccctctgaacgctatccggacccacgcatcgtggccgtcgatgatagctttcgtcgctatatgcttgccagcgcaaaggtcgaacgcatcgccagcggcttccgctgggcggaaggcccggtctggttcggcgacatgcgaatgctgctgtggagcgacattccgaataacgccatcatgcgctgggatgaagtcagcggagaaaccagcgtctttcgctacccggccaattatagcaatggtcacgcccgcgacagacaggggcgcttaatcagttgcgagcacgacacccgccgcattacgcgtaccgaatacgatgggtctgttaccgtactggccgatagctaccagggtcatcgcctcaattctccaaacgatatcgttgtgaagtcagacggcaccatctggtttaccgatccgccatttggcatcagtggtttttacgaaggccacaaagcaacatcagaattgccgcaaaacgtctattgtctggagccggaaagccgcaaactgagcgtggtactgggcgacgtaaaagggccaaatggtttgtgtttctcgccggacgaaaagaccttatacgtggtggaaagccgggcgacaccgaaccgcttaattctggcgtgggatgtggaaggcaatacgctgaaaaataaacgggtatatctcgactgtgggaacggtaccgccgatgggatcgcctgcgacgcagacggcaatctgtggtgcggatggggaagcggaaacgaagaactcgacggcgtgcggatcttcaacccacagggtaagcatatcggcaccattaaactgccagagcgctgcgcgaacttgtgctttggcggcgaacagcgcaatcgtctgtttatggcgtccagcacgtcaatctattcgctgtacgtcaatgcgcagggcgctaagctgatatagcggaaatccggcagccgaggctgccgggcgcatcatcagacgccgtaggcttcacgataggcgcgaactgacgccaggtgttccgccatctcgggtttctcttccagataagtaatcagctctttcagagtgatgattgagataacctggcagccgtaatcccgctccacttcctgaatggcggagatctcgccgcggccgcgttcctgacgatccagggagatcagaacgcccgccagctgcgcgccctgggcctggataatctccatggattcgcgaatcgccgtaccggcggtgatcacgtcatccaccagcattacccggccctgcagcgggctaccgaccagattgccgccttcgccatgggtttttgcctctttgcggttaaagcagtaaggcagatcgcggtcatgatgctcggctaacgccaccgcggtggtggtggcgattgggattcctttgtaggccgggccaaacagcaggtcaaactcaattccggaatccaccagcgcctcggcataaaaacggcccagcagagccagatcgcgcccggtgttaaacaggccggcgttgaagaaataggggctcttgcgcccggatttcagcgtgaattcgccaaacttaagaacctgcttgctaagcgcaaactcaataaactggcgctgatacggcttcatggattcgctcctttggtacttttcatcattgtcagactgcgcgctccccttcgcaggtgtgatgaaggataaagcgcaaaaaaaaggcgacttctcagtcgccttaatcattaattttctaacgccgccttctgcgtcgtgataatggactcgatcccccctcgggctaacgccaggagagtgaggagttcttcatgggtaaacggctcaccttccgcagtgccctgcacctcaataatacggccatcttcggtcatcaccacgttcatgtcggtctccgcggcggagtcttcgatgtactccagatcgcagatggcttcgccatttacgataccgacggagaccgcggccaccatccctttcatcggattggttttcagcttgccggcggcgaccagcttattcagcgcatcggccagcgccacgcaggcaccggtaatggaggcagtgcgggtgccgccgtcggcctgcagtacatcgcagtcgagagtaatcgtgaattcgcccagcgctttcaggtcaaccgctgcgcgcagcgcgcgggcaatcaggcgctgaatttccatcgtccggccgccctgcttgccttttgccgcttcacgcgcgttacgcgtgtgcgtagaacgcggcagcatgccgtattcagcggtgatccagccctggccctggcctttcaggaaacgcggaacgccttcgtcaatagaggcagtgcacagcactttggtatcaccgaattcgaccagcacggagccttcagcgtgttttgtgtaattacgggtcagggtgacgggacgcacctgattagcgctacggcctgctggacgcatgatagaaatctccggcttgaaacgaatgtgagggcgcattatacgaatttcatggcaaaaagcctatgcccactccagccggacgcgccgataatgtcagtccagcgttttacgataagatttcaaccccacgccaatgacaatcaccgccaggcctatcagcggcaagaggtcaggcaacaatgccgttgctgaatagcctttcagcataatgcccttaaccaggcggatgaagtaggtcagcggtaaacaggagccaatggctttcgcccagtctggcatactaataaaggggctgacaaatccggacagcataagtgaagggatgaaataaaatgacgacatttgcagcgcctgcagctggttttgtgctaagccagaaataccgataccaattgacagacaaagaaagacataaattaacagcacaaaaaatagtaggaagacgctaccgtgaagggggatatcgaacaacaaaacggcggcaatcaggattaacgtcgcctgaaacagaccaatgataacaaaaggcgttattttcccaataatgacctcaagcccggacaacggagagaccagtaaattttctaacgccccgttttctcgctcgcgggtaatagacagggcggtcatcaggattaacgttgtactgagtatagaccccataataccgggaatagtattaaactgggttatcccctcagggttaaacatgcgatgaatgataagctcgaaatcatcctctttttgcaccacacgcatgtcgcccggcaaatcgtgctgaaacatcgacttcgccacctgcacaagggcgctgagcgcattccccgtggtgatcggatcgatggcatccccctgaattaatagttgtggcttttctccacgcagtaacttgcgcgtaaacccttcagggatcgtcacgataaaagtgacatccccccgcacaaaggctttctgcgccgcctcttctgaatcgacaggaatcatcgaaaaatacccggtattttgcgcttccgtcacaaagatttgactcatgcgttcggtatcataatttagtaaggcggtcggaagattatgcggatccatattgatggcatagccaagaatgatcagctgaaaaagaggtgtcaggagcaccatactgatgctgactttatcacggcgtagctcgtgaatttccttaataaccacgccaatccaccgcgtaatggagaagctaaaattaatttttttcacaattatttttcatcaagtaggtaaatgcatcttccagattggtatccaccttacagaactcataaccctgttgcgtaaaggcaaaaagcgcggattttaacttcgcttcatctctggatgtaatataaagctgattgccaaaaatgaccgtttgctcaatatccggcaagcgctgtagctggctttcaagcagcgtcagaccggcgccgctggttcgcatggtgatcaaattctgggaggcgataatcgacgcaatagtgccattcgccagcagccgaccataagatagataggcaaccttatggcagcgctcagcctcatccatataatgcgtgctcaccagtatcgagatcccccggtcagagagctggtgcagcatttgccagaactctcgccgcgccttgggatccacgccagcagtcggctcatccagaaatagcaaaacaggttcatgcaacatacaggcggcgagggccattctttgcttccagcccccagaaagctccttagccagctggtgctgtcgggcagtgaggcctaactcagaaagcgcacgttcaacccgatctctacgccgatcgaggctatataatcgcgcaataaaaagtaagttttcccgaatagttaaatttccccacattgagaaatactgggtcatgtagcctatctttttctttatcttttcccgctgcgtaaagatatccatacccagacaagtaccttcaccggaatccggcgtaatcaaaccacacatcattcgaatcgatgtcgtttttccgctaccgttcggaccgagaaaaccatagatctcgccttttgctacctgtaaagagaaatcctttacgacgtgatgctcgccaaaatgtttattgagattttttacatcaatacaaagattattcatcgccaataatctccacatcaaacggttggccgattttcatccgccctgcctgctgcagcgcagggatagcctccgccataaaaatgagcttctcacgacgtttcgtactataaataactggaggcgtaaactcggcctcagggctgatatagttaataacgccagcaatgggctcagcgcaaccatcgcatataagttttaccttagatccgattttaaatttaccgagcttcgcttcgggtataaagaagcgtacttttatattctcaggaggtaacagactgattattggtttaccagcagaagggcgctccccggcacgataaataatatcgaagactttagcattgaccggagaaacaatcgtcgtttgctggacatcccacagcgccttatcccgttcgagttttgccgcggccaccattgagcgctgcttgctaatctcatcctgccgggcagggagttgccgtgctttgagttgattaattaactcttcaacctgtgcgcctttttgagttaattcatcccggatatcctcccattccgcaagcgatatggcatgattggcgtaaagattacgatatcgcccaagctgccgctttacctgggattctgccgattgtgctttttttatctgcgaacgtataatatccaactcttcaggccgttcgccagattccagatttcgtaatagagcgctctctgctgatagcttttcctcagcgcgcaggaaaatattttgcgcatcgaaggactcaatcttcactaactcctgtcctgcggcgacgttatctcctttattgatcaagatccgttctattttttcgttaccagaatatgaaaggtatacaaattctccatgtgaataaccggataacatgttatctgatttgttatcacatccggtgagtatcagcaccgatatcaatataataaatatatttattggctttcgcattaaaacgcatccatacgcatatcatttcccttatcactacggtctggattaaggcacgctcgctccaggaccgtacagtcatcgtcagtttaatcttttaaataatgcttaacgtagctttcattcaatttatctatagagctcagatttaacccagctatcgaattaaaagaatcatcttttgtgaatgcaagaatcgacgatccgcccggggagaaccatttagcactctgtttaaaaggccagggaagttcataaccttcttctctcagcaggtgattaagcatgctccagtctgctctaaaatcttcgccacaaaatggagtatcatcctgtacattttcggcagtgaacaatgctatcggcgtacaaaaatcagttgtcgaggaaaagtatatattatagaaactgatgatgagtttctgtactttttcaggaaaagttccaggaatggtcagcacacccagcaagtatttatagtccggatatctttttataaagtcaaatatcccttgccataaataatcaagcaccttacttttttgataaggtttctgaataaagccgcggccaatttccacacacttctctaaacaggaataggcattatcatggtatttaaacaagctgttgctatagaggcctgttacaccatgttgggccagctgctcgccaacgggcataacacgatatgctcccaggatttccacatcagaaggatcccacaaaatgatatgataataactttcatcaaaaacatcgttatctcggtcgttaccagttccggcaccaatatcgcgataacagcgttcgcgtaagcgccctaactcatcaataataggtgaggttcggttagtattacagcgatatatcactagttttctaccgtcttcaaactgccttaatatttcgcactcctctattgcgctaattagctcctctttacctggttctaattcttgcggcgcaatcgtatctaacatagccgggccattcttcgctatactctggaggtgcgtcaaacatacatttgccgcggcagaaagatctttattgtattctttaaacgaggataaggctatttgctgtcctatattgattttcatggtcttgccatgatggcggagagcttcacgaataaccatcatgttcgacagttgccgccagaatgttgcagtaagataataaatcttactgtttgctcccgtaatatgaattggtaccaatgctgcattatttctcatagcaagctgtaaaaaaccggggttccacttatgctcctgtaacccggaaagagaccagttagccagcttacccgcaggacatataatcaatacgcctccttttcgcaggtgatcgttcatctcgcggaattttttatggctcatcttaccggccatattctcaattccaatggtaagttccgatacctgggggaatataattggcaaaacgtgattggctattatttttatatcactcctgactcgagagaccgtatgtattaagctaagtccatcgattaccgtcggatgatttgaaataacaaccgtagccccatgcccaggtatgttgttaagttggtggcgttcgctttcacatttcaactcaaggagttcaacaactgcattaacccactcgaccccatttttattaacgagtcgctcgttatatattaagcgagaaaataccttattgccaaatgccgtcctgaatagccattttttccaaaaaggtatggttgtatttggaaaaaattcccttacgactctgtcaaagatagcgtccatattaaaatcctttttatagaactcatcgtaaacgactatactagcgttctttcagtcggacaataccgcataaaacttaaaaaggccaaaacaaaacaattagatataattaatacaacagtattctcaccataaatacaatcaccaaagttttaataaatttatagtaatcaatgcaaaaaaaacatacataatgcttaaaggtaataccctatctcatttctggtggttatacttcctaaaactcacagaatagcttttctggcggtatatgcatttgtacaaaggcatccgaattccatgcccgtatctaatatcagaaaatattaaccatggattcccataatatataaccccacctacagcccctggtgaaaataactttgcggcgatatcccttaaaacaatcgtccttgaagtatttcatcactattcctgttaagtcaccgcccgcacggctataatccttgcattcattattacgaaaacaggaacgcctatgatccgcagtatgaccgcctatgcccgccgtgaaatcaagggtgactggggtagcgccgcatgggagctgcgctcggtaaaccagcgctatctggaaacgtacttccgcctgccggagcagttccgtagtctggagcccgtggtacgcgagcgcattcgcgcccgcctgactcgcggtaaagtcgaatgcaccttgcgttttgaacaagatcccagcgctcagggtgaactcatcctcaacgaaaagctggctaaacagctggtaaacgctgccaactgggtgaaaatgcagagcgatgaaggggaaatcaacccggttgatatcctgcgctggccgggcgtgatggccgccaaagagcaggatctcgacgccatcgccgccgacattctggccgctcttgacggcgcgctggacgacttcatcgtcgcccgcgaaacggaaggccaggccctgaaagcgcttatcgagcaacggcttgaaggcgtgagcggcgaagtggcgaaagttcgcgctcatatgccggaaattctccagtggcagcgcgagcgcctggtcgccaagctggaagatgcggaagtacagctggaaaataaccgccttgagcaagagctggtgctgatggcgcagcgtatcgacgttgccgaagaactggaccgtctcgaagcgcacgttaaagagacctataacattctgaagaagaaagaagctgtgggtcgccgtctcgactttatgatgcaggagttcaaccgtgaatcgaacaccctggcgtcaaaatcgattaacgccgaggtgaccaactccgcgattgagctgaaggtactcatcgagcaaatgcgcgagcagatccagaatatcgagtaagtatttaagcgctatcacaaagacgcacgaaaccagcaaagcccgcacatcgccgggcttttttgttatcatgggctatcataaaaacgcaacaaagagcatgattgccgtgtacacctaggtgtaccaacggcgttaggtgtactcatctaggtgtacaccccttattaaaagtttggaatagtttggatattcgcaaaatgccaaaactcacagacatgcagatccgcgcatggataaaggccggggagcgattcgagggacgctctgacggtaacgggctttatctttcataccgcgaaaactaccagacacccgtctggcgcttccgctataaattcgctgggaaaccccgcgcaatgatgatcggttcatatgccgagctatcactatcaaaggccagagagacagccaaagagctatcggctcgcgttgcgctgggctatgacgttgcgggagagaagcaggagcggaaggccgaagcgctggcgaagatggaagcagagaaaaacgccatgcgcgtttcagagcttgccgctgaatactttgagcgtcagatcctgccccgctggaagcaccccgacattctccgccgccggatagacaaggatataaatccccacatcgggcgcatgaaggtagaggacgtaaagccgcgccatattgatgacatgctcaaggcgatagtagaccgtggagcgcctaccatagcaacggacgttctacgctggacgcgccgcatattcgactacggaatcaaacggcacgcgctggagattaacccctgttcagcctttgaggtggcagacgctggagggaaggaggttagccgtgaccgctggttaacccgcgatgagttaatccagctattcaaagccatgcgcacggctaagggtttcagtcgccagaatgaaatcacgttcaaattactgttagcgttatgcgtccgcaaaatggagttatgcgccgcacgctgggaggagttcgaccttgatcaagctgtctggcgcttgccagaggaacgcagcaaaaacggcgacgctatagacatcccattagcaccgccagccgtcgaatggctgagagagcttaaaacgttctcatgcaacagcgcctgggtactgccagccagaaagatgcaaaaccgcatgatcccccatattcaggaaagcaccctgcccgttgcgctggcgaaggttcgcgctgaaatgccggacgtgccgagcttcactattcacgacttccggcgcacggcccgcacccatttagccgcgctgggcgtggatccggtagtcgcagaaagatgccttaaccacaaaattaaaggtgtggagggtatctataaccgccaccaatactttgatgaacgccgggccgcgttaacacagtgggcgggcttgctggtggcactggaacgcggcgaagaatacaacgttacaccgctgagaaaggcgaagtaaccaagatatgtaaagaataagaggacagattgagcctagcccgacggggtgaaaagcgggaagccttaccgcctggctcaatcactttaaaggcatggcgtaaaaggtaacgttatggcacatggcaaattaattaatatctgggaaaaaaataccatccctccattaccgtggtgctcactaaacagagcagcaacactattgaagtgcgaattatcagacttctcagcatggatgaatcatctaaatcctatgattgaatttaaacaaagttcagtggaaggtactctgacggttacattgaataactatgataacccatatgagtatggggatatttcaaaagaatatattgaccttatacctgtggcatcacgaggcggattgactccaacttcgccaatgatagataccgcattcaccattgataaaaataaaaaaacactggattttgtgggctactttgatggcatggcatccgttttggaagggatgtatttaattgaaaatgatgaactaattgtccttccgcaagatttgttctgtgagattcctattgcaaaactaggcgctccttatgttggtgaagactgcccggtactgtcagtagatgatattttaattagacctgtttatgcgtattgctacgatgctcagccaattgttttgagtatgaatgatgtttatctaagcagggaggatatagagctaatttacaattgcggagtccaaggtatagatttaccagaagatagattgaccgtgcctgaatcaattaaggctaagccaaaaattagggaaacggcaaagcaatctagatttattgcttatctaataaatgctttaggcgtgaagcaagacgaactaaaaacactttccatcaaaaatattatggatagattaagccatatggcaaatgagattaaatttcctgatgtaacggatgactctttacgggattggttggaaaaagccggttataggtaattatggttagttttcgccaatgaagatgtgccgttagtttcaagcaaacaatctcataactcggaggaattttctaaaactcggcgagattgtgaactgctattgatagcctttccatcaccagctatcacaggagttacgggacatatgacagcctctcaaaccgcacaatcagcacttcccactactggatacatccgccgctttcgaatgccggcgttgttaggggtgtcaatgccaaccattgatcgatgggttaaaaacggcacattgccacgcccggtgaaactcaccaataacgtgactgcctttgatgcggtagagattaacaaatggctggcagaacggcgcgggaaggtggcctgatgaaaaaagaaaaccgcccattacaggcggctaacatagatattcgcggatctgatgttacgccactagcctacaccgttcaagcctcaaagcgcattccgaagaaacaccgcgcccgcacctacatgctgcgttgtggggctggtgggtggacagaaaacgatatcctgcgcaattgccggctctcatctggccgcaactatgcgagcgaacttgagcgtgagcttgatatctgcctggaacgccttgaagagaaaaatcctgatggtatcggggcgcacatgcgctaccggtttgcgtgccgtggtgacgtgctgaaggtgattcagttcgttaaccgcatggccgcagtcaaccaacactacgggctttctaagcaggatatcgccgacattctgaacctctacccggacaacttcaccgccgcataacggagccgaaaaatgaaaatcgaaaaaagcagattcaattctgaggccgcccctcaacccaacgttaacccgggcgtaactaacggcaatgactttgccgccatcgttcccgttattcccggccaaattggcgggcgcgaaaccaatattgcgagcgccagagatttgcataaagcgctgggtgtgggccgcgactttaccaactggattaaaggccgcatcgaccagtacggatttgtggccgggactgactacatccgtgttgaaaatttgagctcaccaaaacgggcgagcgcaaaatttcgccagcaaatcgagcatgattaccttctctcgctggatatggctaaagaagtggcaatggttgagcgcaatgaacaggggcgcgccgtccgccgctatttcatccagtgcgaggaagcgctacagctgagtgcgccggaaatcgccgcgaagtatcgccggcacctcaaagcccgcattggtgctgctaacctcttcaagccgatgtgcgccgctctggatgctgcccgagcagaacaggggaaagagacgcaagcccggcactacagcaatgaaagcaacatgatcgcccgtattgtgctgggtggcatgaccgctaagcagtgggcgcaggtgaacggtatcgacggcgaaccgcgcgatagcatgagcgccgcccaactggaacacctcagctacctggagggtacaaacatcacgctgatcgatatgggcatggagtacggccagcgtaaagcggaattaacccgcctctctcagcgttggctggctaaacgtctgggggctaacgatgaataagcccaccagcacaccgctgccaaaccactcctatcgcgacgctcacggccagatggtgagcgtgaccgctgtagcgcataaccgcgtgacgttctatcgcgaggggtatcagttcccgtgcgtacagcccattgagcgcttcatgaaggagtacacggaggtgaagcaatgattacctccgcccagggtaaaagcctctctctggctggcctgatgtatgcaaaagttaacgatcttcgggcggtgtgtcaccgcaggagcctgtcaaaacctgtcattctgtgggccaatagtggctctgttgaagtttatttcgaggcaggtacgcgcgcgggtaagcgttcggaaactgactatctggaagatagcgcgtccggcgccggcggtggatgtggagcacatcacaccgccagctataaattgccgcaccgtgacaaaaaggacttgcggtctgaaggtatcccagtctatggtaatagcgcaccagcaaaatctggtgccgggattggcgtcctggtaattcgaatggcgacacatgacgcgcctagcgtctttttttgtgccgttagtctgactcaccctttttttgagcgttgggatataatccagcgcctcgcaagagcaatggtggctcaggcaggggcttcttcggaagcgccggtatccattcgagccggttacgccaaccctgcttgggctaccaccagtgaaattggcgtttccggtggtagcgttacccgctatcgaatggaggctgccgcatggctactaccctcacccaaattccgcaatttatctggattatcgccgctgttcgccgcgatatgccgacaattaccgcaaaaattcaccatatcgccgcacctactgagcgcgaagcccgccgttctctggttcgggatcacgtctgctttttcgctggccgtatccgtctggaggtggctcatgcttaaaacctacgatgtgcctgttaatccaactgaacgcacccaccacctgatttctctggcggagctgatgcgtgatgtattggacagtaaagctgattctcgcgaggactatctggaggcattgattgccatgctggagatgtctttgcgcgatctgcatggtctgctggaaggtaatgaactgccggaggtgcgccatgcgtaactatttccgcatcaccggctacgccgttaataagcgcggtttaacggtagggatcggctatcaactcacatccagcgacactaaaacagcaactgcccacgcagtgcttcaggcgcagcgtgaaggtttcagccatgtacgcattacacgcgttcaggaggtggcagcatgagcaccgcgattaccaccgtccccaacgaaatcactaccccccccgaagttatccactcaggagatgcggcggcggtagtcatttacgccagtgagcttctggaactgtggaatttgcaccttgataagccactgcgtgccgccaacccgctttttgccgcgcggcttgggacgctaatagttgaaatgcgatgcgcagccattagaaccgagcgcaaagttaatcgcctggctgatgaactaacgaagatgcgtgagtaccgggagggcggcgcatgagcaagttatccctgattgattcagcctgccgtatcaagcaagcgcagcaagttctttctctttggcttgaagcaccgattaaaaaagatagcggcacggatcatcttattggcgcagtcattacccttctggatggtatccccgagctgatggattcagtagaaggcgagttagttgatatggatctaagtttgggcggtaaagcatgagcaacgcacagaaattcagaccgggaagtgccgacttattacacgtcgaggccacgccagacggtatcaacattctgacgctgaacgatgacggcctttggcagcattcgcggatgctgggctactccgctgcgattcgccagcttgatagcggcggctatgaccgtgatttgaccgcagggatgcaggttatttccgggatctgggaagccgagaggaaaggctacctcacagaaagtagcgagcaaatggcgattgtctggcgctggctggtggcctgtctgttcattctggagcagcaggaacgcaacggcacggtagatatagccaacgacgagggcggctatgatcgtgccgtgaagtacgtcggtagacatggcggaataagcatttacccggctacggaacgcttttcactggcgaaccacgtcgaggcgctggcaattgagaaatatggcgcagatacaggattgctgatggctgttcatatgtaccagagcatgacggagacagtgccggggaaagggatgaaattgtctgctgtggggcgtgaattgctggaaggatcgcacgacagctttatccagatgctgaataccgaaggtatgccagcagcgccaacagcgcactgagggggtaacaatgcgtaatatcgaccttatccgcgaagtgaccaccaccgccgcgaacaactggcctcatgtgctggctggcctgtctatcgacgtgcctgattcatcacgccgtcatgccccctgccctgcatgtggtggaaaagaccgtttcaggttcgacgataacgggcgcggtagctttatctgcaaccagtgcggcgctggcgacggcttagacctgattaagctggtgaaccactgcgacaccaccgaagcggcacagcttgccgctgacgtgctgggtattgattaccgggctgcggaaacaaaccagaaagcagccagccagagaagggagcagatggaagctgaccgccagcagcgggagcaggagcgccagaaacaggcagcggaggacgcagagcagcgccgggctacgtttgcccgtctgtatggtgaaatgcgccagagcgccacagagggtgaatctgattacctgaaatcaaaagggctgaccgggtttaattaccccattctgcccgatggctcgctattgctggcgctggtggacggatccggcgcagtcaacgccgcgcagaccatcaccccacagggagaaaaacggcttctgaccggttcggcaaagcgcggggcatatcacgccgtaaacgcaccagaaacgccgcagagcgttttaattgccgaggggctggcaacggccctttcagttcacctgatgcgcccggacgcgctggcagtggcagcaattgacgcgggcaacctgctacccgttgccgaagtgatgcgccgtaaacacccgaaggcgcaaattattatcgccgcagacaacgaccaccaccaaaacggagaagccaatacaggctgggaggccgcagagaaagccgccttatccgtggctggctgggtatcacttccaccgactgactataaagccgactggaacgacttccaccagcaaaacgggctggaagtcgctacggctgcgtttaacgattcgatgtaccagattcagggggaagccgtgaaaccacggttgcaggccattgagggcggtaaagctgaccagccagagaaagacccgctaaagccccgcattgagagccgcaaagatggcgttttctgggtaacgcctaaagtggacaaggaaagcggggagatcatcaacaatgaaagctggctggcctcaccgatggacgttatcggaaccgggcgcgacgacaaagaccagtatttgataatcagatgggcggcttttggcgcagataccgcaacgaccgcagctatcccgctggctgatattggtgagcgcgagggctggcgcaccatgaaagcgggcgggattaacgtcacgaccaaaagcagcctacgggcgatcctggctgactggctacagcgcagcggctcgcgtgaactatggcgcgttgctcatgctacgggctggcaatgcggggcgtacatcatgccggacggggaaatcatcggcacacctgagcggcctgttttgttcagcgggcgcagttcagccgctgccgggtataccgtagcaggaacgtcggaaagctggcgtaacagtgttgcacggctggcatacggcaactacgcgatgatgacaggcatcgccgcagcactggcagcgccattaatcggggtggcagagcgtgacggattcgggattcatttttatgaacaatcgagcgccgggaaaacaaccgcgcagaacgtggcgggcagtctatacggaaaccctgatgccttgcgcctgacgtggtacgggacggcgctggggctgataaacgaggccgccgcccacaatgacggactgatgccgctggatgaagtcggacagggcgcagacccgataagcgtttctcagtctgcctatgccctgtttaacggcgtggggaaattgcagggcgcaaaggaaggaggcaaccgggatctgaaacgctggcgcaccgtggcaatcagcaccggggaaatggatttagaaacgttcatcgccaccgcaggacgcaagacaaaagcggggcaactggtgcgactgctgaatatcccgctgagtaaggcggtgcgctttcatgagtaccagacagggagagaccacgccgacgcgctgaaagacgcttaccagcaccatcatggcgctgccgggcgggagtggattagatggctttcagaccaccagcagcaggcgattgatgccgttcgtgagtgcgaggcccgctggcgcagtcttattcctgccgactatggcgaacaggttcaccgtgtaggggcaaggttcgccattctggaggccgctttactgctgggtggcgtggttactggttgggatgctcaaacgtgccgggatgcgatacagcacacctataacgcatggctgaaagagttcggcacggggaacaaagagcaccagcagatcatcgagcagacggaggcgtttttaaatgcctatgggctgagtcgattcgcgccgctgggttatgacccgcgcgatttacccatccgtgatttagccgggtacaggaagaaggggaaccacgacggcgacccgataattttctacaccttcccggcagcgtttgagcaggagattgcaaagggcttcaataccaaacagtttgccgaagttctaaagaatgcaggaatgcttacacccccaacgagcgggcgaggttatcaggggcgggtaagggaaggagggcggcaaattcgcgtttatgtgctcaacttcatggatgaggaaagcagccagccagaagaataatcttttttcacatacgtagttttagtgttgtctcagttgtctttgttgtctcattttgtaatctgcattgatttataaggattttattttaatttctgagacaacatcgagacaacatttagccattttgagacaacatggcgaacgtgtgttttttaatctggcaggcagtgagacaacatttactcagggtgagacaacactaaattgcaaatgttgtctcactaaaatccagatgtggcgcggcctgtagagccgtgagacaacaaagacaactgagacaatactatttttgtttatatgcaaaaaaatctggcgaaggtgtcccacaataagacggcgccgggtaattttcattagcaaaactaataatcagaggtattcgcaaaatgacagcacagatatcagcatacgggcggctggtggcagatccccagaccagaacgacgaacagcggaacgagcatggcaatggcgcggctggcggtggcgctgccgtgcaatgcggcagataacggagaagctactttctggctgggcgttatcgcctttggtaaacaggccgacgcgctggcagggcacgttaaaggcgatttagtcagtgttgccggagcgatgcaggtcaatcagtggacgggcaaggatggcggtacacagcagggctatcagatagtggctgacagcgtgatcagtgcaaagacggtaaggccgggcgggaagcgtagcactgcgggaatgaataccagccagccggcgagccgaccgcagcagatcgcgccgggctgggaggtgtacgacactcctgatgactttgatcaacgccagccgtttgatgatgggttttaagctggaggacaagcagcatgatacgcgacaaaaaggccgaagaactggaggctaaagggttgttccgcagggcggcggcgcggtggcttgacgttatggcggcgtgtaccgaggatgccgacagggagcaggcgaagcggaaccgtgaaagatgccttgaaggcgtaaagcgcccacgctttaagctggaggaatttgcagaccttcacagagcggcaaaagccaccactaaccgcatggggatagcgcagaacaacggggaggctttcagattgccagccagcagaaaacgagcacgtaaggcgcgcaatgatggcgcataattccggtgccctggctgcgtgggagtttgagcatcacatgtagaatcatactgccccatgaaaatgcccatatcttatttataggcagaaacggtgtgttctggctatgtatggcagaaatggtgtgttctgcctataagggcagaaagcgctcgaaagtggtcgttgagaacgcgctgtagcgggagatagttaagcgcccaccagcccgcgcagaagttcacaaggcagcgaaagagacacagcgccgcatgggaatagctcagccgaatggtgaggcgttcaggttaaaaacaagacgatgaaagtgattgtattggattaatcttcttcgatgttacgataatactttatttacttttggggataagttgatgtcagtatggaacatcattgttttgatattcgctattatcatttatgttcttcccggcgttatagccagttcaagggagcataaaaacgctacggcaatatgggtgctaaatattgtcctgggctggagcttcttgggttggatagccgcgcttgtctggtctttcacaaaccccggagtggttaagcttgaaccacaggtgtttggcgcggattctgctggtggcggtttagtagacgatactaaaaaatgtccgtattgcgccgaaacaataaaaaaagaagcaatattgtgccgattttgtggcaaagatttataaatcgacatcgtcaagcaagggtggcatcaatgaaaattattatggtattaatttcatcacttttatttctcacggcatgtaagcctacagaagagaaagccatagagttggctaaaagcgagatatcgcacgacatgaaagatccatcatctacccagtttagagatgttgtgtcaaaaaaagttggtgaaaaggacgatggctctatcgcaatgcttgtctgtggtgaggtgaactcaaagaacagctttggggcatattcagggtactcgccttttgtcatcgcgctaacgatgaaatcaaagggttttttctcctccggcgtggtgtatgcagtcgaagggaaaacagttgatgaccgtccaacacgcaagaatagtgcaaatacgatcaacccctgcaagtaacaccacaccaaacccgtgaccacgggtttttttacgccacatcatttcacaaagcgcaatgcttgccatttatgttgcataaactacaatataaattgactgtataaatatcaggggtaagcagatgaaccgatcacaaatcacggtagcactttgccgggaacatcttcagtccattcgtgaaattcaggaagaggagcgcaagcgttctccgattggtgtagcaccaacggtaaacgctattgcccgcgcattggtcgctaagggccttgaatctgttaagcggggtgggtgatggaacaactacagaggctggctgaagtaattgccgagacctatattcgcgatctgcgccgggaaactggctccaacgttcttagcattgatggtgtaagtggcaacgttgaaaaacacctgctcgccgcggggcttgtcgataacacaatatatgccgctaaagatgaatatggcgcgacatttgaacgagaagcctatcgcatgttaatgaattttatatcatttgatggtccggaatatcgccttaccgaacatggtcgattagtcataactcttctgaacaccaacgctctgaaaaaaaacaaagtaagaaccctacactgaggcgctcatgacaactgattttggcaaatacaccattgagattgaagccgatgcggccaaactgctggcgggtcaggcgagcgcagattcagctttaaagcaaattgaaaactcagtcaaaaaaacagctaactctgctgacaagctagataaaagcctggataacttgggcggaggtttttcgcgccttgctgtggccgtgaaaggatacatatcaattcaggcgttgatgaagctccaacagctgtctgaggaattcacgctacttcaggcgcgagtaacgcgtttatcttcaagttcagaggaaggtgcgcggagctttcagcagcttgtgggtattgcttcggcaaccggtgccagccttggggataccgtcaacctctggcagcaactgaccgctacactaaaaactgtaggcgccactaacagtgatgttaaccggctagtgatgaccctgcagaagatcggcgctatcggtggctcatcggctcaggaaatggctaacgctctcaggcaatttatgcagtcggttgcgtccggcagaattcaggcggaagagtttaactcagtgctggaacagatgccggaactggcgaggcagatcgccgatggtatggggattccgtttaacgagctccgtcagttgatgctggcaggcaagttagatattggtgaggtgctagcggcaatcgaaaagaggtctgacgaaatcaatcagcagtttgaaactatgccgcgtactgtatcgcaggcaacaaatgctttgatcactcagttcggggtagctatctccaaaattgatgatgctattggggcgtcgcgctatttggcaaaacttctcgaccaaactgctctttcaatctccgtagccaccggaaatgtagatcctattgttgcgatagatgcgcagttggattcgctgaataaaaaattagctgtaactgaagcggcttacaataccgtttccaaagcttctatctacactgacgcaggcactaaaacacaaatagatgctatcaaaggtcaaatagcggccctagaacgagcaaaatccctttattccgatgttggcaaggcggcatcgggttctgtagacggatctaagccagcctatatcaccaatctcgaaaagaaaactgcagagaacaacgccaattcgatcattaaatctggtcaaacagtagttgataagctcacccagcagcgtgaacagctaagcaaagacaaggccaaagggctaatcgatgataagaaatatgctgaagctgctgctgttctggataagcaaattgccgacgccagaaaaaaacaggataaaacgccgaagaatgcctttgcccgcggcgatgactcaatagacaacttgcagcggcagattgccgttttgacaatgcgctatgacgagaacaccagagaggctgcgcagtttaatgccgtggccgctctcggagctaaggccaccgacacgcaaaaagagcgggtgcgcgaactggctggacagttatttgacgcccagcagcgccagaaagaccttaacgacgcgatcagcaatgaccctgtgcgtaaggaaaataaaacctattcagacggtcgagaccagctaaagcgccagctagacggccagatgattgaccagaaaacctataaccagcaatcagagttgatggagcagcagcatcaagtcaatctggcaaaaatacgcgctcaggagcaaacagcaaacccgatagcagccgcccgcgctgaaattgacccggtacagcaactggtcaatgaaaacaaccagaagctggccctcatgcagcagtaccagcagcaggaacaggcaatactccagcagagctatcagcagggaaaaatcagttacgatcagttcatcgctgccaaatcagctacggatgctcagtatctggcgctgagaacggcgcaggagaatcagttcaacgagcagatgacggcggcgcagtggcagttgttgagccagcagggacttggctggcagactttgaccagcgccgtggatgctttctccggcagcgcgtccaacgccattaccggaatgctgactggctcaatgagcgcgtctgaggcgatgaaatcgcttggaacgaccatcctcaacagtgttgttaactcgctggtgcaggcggcaattcaggcagctattgttaagccattgctggaagcgtttggtttatctgccgaaagcacgcttggggcaagtacggcatcggcggcagagtcctacgctgcatgggcgccagcggcaatagcggcttccattgccacgctgggcagtgcggcaggcgttggctttgctgcatattctggtgctacgttggctggcaaggctcttggcggacgtaaaaatggcgggccggtatcagctggtaatatctaccctgtaggtgaaggaaacctaccggaactcatgcagaccagcaaaggactgttcatgatccccggtgatggaggaaaggtattcagtaacaaggatgtgaatagcggctctccgactatacagaaggcatcaacagggaaagaatatctcccgacatcctccgcatcatccagccaggcagaaagccgcactgaacgaccgatacaggtcaacataacccttatcgaccagaccaccggcaatcagcacaacatcactggcactgaagctttccagcaaggtgacattgtgacagttactggatggctgaatgacgtagataccgccggcccaatgtctacagcattcgcagatgctcacggactaagaaggcaggcaaggggggctttttaaagttgacccgagggggagggttaatcgcctccccttttgttacgcgggactgctttatgaatggcattttcacaggacagaaataagaactttttttcgtgtaaacgcagccagtaaacaacctaccccatgagagggtgacaaaagttgacatcgaaaggcgatcccgtgactaacgacgaaaagcgaaaactataccgcgcgtgggctgatgatatcggcggcggaacatctttcccggacgcctgcagggatatgacgtgcggagcgacgaccaggaaagggacaccctgcaaaatgacggcgctgtatgcttctggccgctgtaagttacacggaggcatgagcaccggagcaaagacaccagagggtaaggcacggcagttagagggattccggcgctggctggagaaaaggcagcagaccaccagccagagtgatagtacgcagtaaagtttgcgtcgatggtgcgcagtacgcagagaggtacgcagcaaaaagaaggttttttcagtgcgtacttgtttaagcgtgttttgcgcgtggctctgtaagtcaatgattaggcttaattatagcgaagcgcgataatcgggggagcgaatatgggtattaaaggcaggggcatgaacaacattcgccgcaacatcaatgcgctggtgagggacatcacagggcggcgcttaccgcgtgcaatgacagccgccttgcatgaaggtgggctcgtagcagcaatctatacgccagttgataccagcaccctgattaactcgcagtttaaagaggttatcaccaacggaacgcgcatcactggccgaatcggatactctgcgaattatgcaatttatgttcaggatccgaacatcccgcagaaatttaccctccccagggccagaaaagagtttttgcagcatggtgttgctgatgctaaaccgcagatggaggcagctttcctgcgagaattatcaaaacgctgattgcggagaaaacgaaactgcttaccccatgagtggttaacaattgttaaggttatagcaacgattattaggccgtactcgaagtaaccaattgtgcagaactcatataatttcgtattcattagcgggtttttttagcggagatctgaactaatgagagagcagacgcgggtttacacctctgcgctaccacgaattaacctccagtttctggcagatatgcaaagaaagctggtggactcgagcccgaaaacacagattttttgtgataccaagagcggaagggtgtgtttctctctggttcctggcggctacagtgcgacaatcaacggggtaacgcgagttattggcatcacgattacccgggcagggtttggttaccggcgatggtacatttgcccgcattgtggtggccgggttgcgaaattattcattggccggaaggacgtagggtgtcgtaaatgctggagccttcactatgccagccagagtgaagatgaggtcgctcgcttacggcggagtgtgtggaagcagaggcatgacctatggggggatgattacccgcccgcgggcagcctgctaaatagcccgctcaagtttccgaagcctgccggcatgagatgggataccttcgagcaaaagcgctctcgactgctaaagactgaatcagcttactggcggttgaaagaaccgagggatgctaaagggttcgccagcgtaatgcgcagagctgaggcgtcaatgcgctcatttgaacgggcatcgaaaaaggctaccccatgagcgccctactattaccctaatgcctaccccataagcacagcaagactacggcaaggttaattccggttctgagccggaattagctaaaaacagccggttacctgccatatcaggagcgacaacgatgttagaccgcataacactggagttagccatacaggagatagccaggcagagcggtgaaacacttgataaccacgcccgctacaccattcgaaacggcgtggcgcaggtgctacaagccaaagaaagccaccgccgcaggatggtagcgccagcctaccagtggaagaagcccaccgcgccgcgcagataacattacagcgccgccgataacttctcagcattgcgcccctgatgcttccaggcgctgtaaatgtctttatcccacgccttacccgccttagtctgataacccgcctcattgagcctctcagcgataatgcgcccgttatcgaaaccctcccggatagtgtccgcgataatcccgatcaccgccgtttcattgtacggggtaggcgggatcccctgcttacctccggctagcgccgctgccgctacttccattcgctccaccagcgccagcatacgggactgagggttactctctggctggcttagtttgctgcgcagggcatcgactagccacgctgttctatcgccgcctgatgccgctacagcctgattaaatgcgtcctgcaattcagccggaacgcggaatgctaccagattggatttgctcatgagggccgccatatcagtgttttctgtctgtacagtatatcactgtataacgctgttatacggttgggttgctggctggtttgtcatttttgatgtccacgctaacttttgacgcgccgtgctggtggtcatgaattttggaatgctttggaaatttgaaaactaccgacaaccaaaagagccgctagagtgatggtttaaggctgaatacttagcggaggcatccaaaaagatgagtgctaaatttgtactgtttgatacggatttggattgtgctgattggcaaacatgcgtcgtggttggcgctgcatactttaggggcgatcgggtgtattaaatttgccaggccgtacatgcgggggaatctcggatgtaagaggtagggacaaagtaacggtgagctactcagttgctggattaaagggcagaattctgcccttagtgctgagtggtagcgttatgggttaaccaagccgcacacactcgcctgatatcgaattatcagcgccgcatgtatcacgtattagccggcatgttcccggcaggccataacgcgtgacattacaccagacgccgggagaatccgcgctactctgcgtggtgttttgccgttgctcgtataccgtcaccctttccagcaggccaccagctaccatgttttcgagagtgcgccgggttgattcgagctggtggcgcttgtcgaacgactccatgccatgaagcagataagccacgccggacacatcgagagggggcgcaccaatctcacccgtcacccattctaggttatccggctcaaagtagctgagtatcttttttttacggctggtcattctcatggctggctgattccttattgtgggatagaggtatcatacaataagagcgacggggcaaggttgctgcaagggtgaaaaccgaccaaaagaccgagcgcctcaaaaaaccgtgtacacatgggtgtacataatgagaatcagcattacaagaaactcagtaacggcgcggcattgagccacctactcaataaacagatccaatatcgagtaacgctttctcgtttgttaatgtatttcggtatccagggccatgataaatcatggcctttttatttatctctctcacgggcgaatgataagaatctacttataaaaaatagtcgtccagttttcggttgtggcaaataagcacaacgcggcacagtcaggaaaacactaccgcgagagaaaagaatggactttaatgcgcttcaccagcaacaccaacctttgttgcttgccaatgtctgggatgccagcagcgctcaggctgctcagcaggctggttatcaggcgctgggatcctccagcgctgctatcgccgcaatgttagggtatgaagatggcgaagagatgagttttgacgagctgttttatgtcgtctcacgcatcaaaaccgttagcgaactgccgttaagcgtcgatttagagacgggctacggcgcgacaaccagccacatcattgacaatatccggcgtctggcgcatctcggcgtgagtggaataaatctcgaggatagtcatgtggtggatggtacgcgtcgtcttgacgatgcggagcgctttgccgtcaaactgcaggaaataacccgcgcctgtcccggtctgtttgttaatgtccgcaccgatacctttcttctcaacgtacaagatgcgctggttcagacgctctatcgcggtcaactctacgccaaacacggcgcatgcggtttttttgtgccttgcgtcacccgcgcggaggatattatcgccatcgttcaccacgtgcgtttacccttaaacgtaatgtgtatgcctgagctggctgacttcagcaccttatcgacactgggcgtaaaacgaatttcgatgggcaattttatttatgctgcgacgcaggccagactgaaagacttattatgtcaggtgcaaacccaacactctttctcaggtgttttttgaccatgaaaattaccgacagcatgcagtgcgatatctggtatcaggcgctgcttgaacgcgcggtggaattcaccggcgtttttttcgtcggcgtgaaaaccaccggcgtattttgtatctcggtctgtcgggcgcgaaaaccccggcgggaaaacgtcgaattttataatgactttaaatccgcgctggatgccggcttccggccatgcaaagtctgtcgcccgacggagaatgcccggacggcccccgcctttgttgaacaagcgctccgcctgctgcgagaagctccaaaggtccgcctcagcgatagcgagctacgtcagcacgatattagcccggaacgcgttcgccgctggttcctgcaaaaccacgggatcacctttcaggcttttcaacggatgcagcgtttgaatatggcgcttcaggaattaaaagcaggccgctcaactaccgatgtcgctttcgatagcggttacgagtccttaagcggcttcggctatacctgcaaaaaattgaccggtttcgcacccagcgcacaacgccaggttgttttaattcatcgttttaccaccccgttagggccaatgtttgtttgtgcaacgcaacggggaatttgtctgctggagtttgtcgacagacgagcgctggagtcagaattcagcgacctgcagcggcggttcaacgccagcatcatcacaggtgaaaatgcccacaccaggcaggcgcaacaggaaataacggagtatttcgccggacagcgtcaatcgttcgaggtggcgcttgatgccccaggcagcgagttccagcgagcggtctggcgccgtttacagcacgttagcttcggtgagacgacgcattatcaatcgattgcgatggagataggtaaaccaacggccacgcgcgcggtggctgctgcaaacggcgctaaccgcgtcgcgattatcatcccgtgccatcgaattatcggcaaagatggttcgatgaccggttacggcggcggcattgcacgaaaaatatggcttattaaccatgaggcaaccatcagggaaaaacgcggctgattttactttcaggatcaacgggcccctccctggctttcaccgcgtctcggtaagcctattttttatccagcacccggcaggttaaaaacgcccctgccgcgcacagcagcgccggagccagatagctgtgatccatgtgggtaaactccatcaccagcgccactgcggtcaacggcatctgcatggaggcggcgagaaacgcggccgcccccaccacagcgaagctgcttttatcaccgccagggaagccgagctgccagagcgcgcagagcagcaggctgaccaatccgcccaccgccagccctggggttaacaatccaccctccgcgccgccgcgcagcaccgccagaatcaccaccatcttcaatactaacaggacagcgaccatggagagaggcagcccgtcgctgagcgccagctgcattggacccttgccattgcccggaagctcggggaaataaagactcaggatggcaagaagagaaaaccccagcagacagaacaccggcatctgccagttacttcgcgcgcgtgaacgcgccgcgctggtcgctttgcgaaagagccaggcgccggtgccaagaatcgggcccgccagaatcgcccaccagagaaaggtgtgcggaagtgcgctggaaacaaaatggtattgcgattcatcccctaaccccagggtggccgtccaggcggcaatcgccgaggtcatcatcgccgccagcgttttttcccagctaaacgacagcagcatgacctcaaggctgaacaacgccccggccagcgggacgttatagaccgccgccagacctgcgcccgccccacaggcaatcagcgtgcgggtttcatcttccagcaggcgcagcttacgcgccaccatccccgcccccagcgcgcccatttcccggggcgccacctcgcggccaagcggggagcccagcgctacggtgacgatctgcagcagcgcgtggatcgtcgtggtgcccgcgggcatgggtgcgcaggggttggccaccgccgccgcaatagaaacccgcctccgcccgtagcgaccaagcagccaccagccaaatccggcgacggcgccgccggccacgattgccacgatgcggcgtggccaggacgactccgtgacgccctgtaaaaatgacaccgaaccgacgatctgcccataactgtaaccaaaagccaggtgctgaatcgcgtgtaaaatcagtgccaaaaccatgccggacagaccggccagaatcccggttaataccacggctatcaggcggatcagatgatttttattcccggcggcgacgctcattttctcaggccttgaaaaggaaaaataaaagaataaaggacgagacctaaacattgcgtaatcatagtgttttcgatagtgatacccatcgcttcacttagcattactttttctaatcaataaaaatccctaaaaaatcaataaacctttaaatcaagccatcacagatactatttccattaatttttcctggcgtaaatgattcgctttagaaaatctcaatcgtgatcctgcgcacaaatcgttaacctgcccgccattacctggggggatctatgctgcttcatgttctgtacttaatcggtatcaccgcggaagccatgaccggcgcactggctgccgggcgccggcggatggatacgtttggcgtcatcattatcgccactgcgaccgcgctgggcgggggttccgttcgcgatatcctgctggggcactatcctcttggttgggtgaagcatcccgaatatgtcatcattgtcgccgtcgccgctgtcctcacgaccattgccgctccggtgatgccgcaccttcgtcggctgtttctggtgctggacgcgctggggctgatcgtgttttccatcatcggcgcgcagatcgccctggacatgggcgaaggcccggttatcgcctctattgccgccgtgatcaccggtgtcttcggcggcgtactgcgcgatatgttctgcaaacgcattccgctggtcttccagaaagagctgtatgccgggatctcctttgccgcagccgtactctatattgctctgcaacattacgtcagcagccacgatgtggtggtgctggctacactgctgttcggctttaccgcccgcatgctggcgctacgctggaaactggggctaccggtcttccactacacccatgacgcccactaaccgccttaaaatccggggatgcgctgcccgctaagccattgcgccagcgccaccacgtccggatggtgcaggaaagccaccagctggcgggctctgatctcccccacgcccggcagcgtgcgccattgcgcttcactttttgccgccagcaaatgccagttctcgctttcgagctgcgccagcgccccctgcggcaccgggatccccatcgccagcacccagcggataaaaggtcgtttgcgaacgagatcaaactgatgccagaggtgctgcccgcgggcggcggaaatccctggcaccgcctgcagctgctcaacggtaagcgccagccaggaaaagatatgcgtcatcgggttttgctgctgaatgacgcgccataaattttcccccacgccatcgacattcagggcggactttgatgacaaccagatcagcctggaaagaaactgttcgctgcactcaggggtggcgaaatagcaggttagcgcattaaatttcgccggcggcggcgtcggtttatggcgctcggccgtccgccagacgacggcgtcgacccgaggaataccctgccctgccagactgatctgcagctgatcgccaaccccaatatgcagcatctgccagcgggacacagagccaacgttaacccgctgcacgcgtttatcatccagccgctgggcctcaagctcggccaccacgttgagtctgccgctgcggccggtactgaaacggatcgcccgtacctgcatcacccgcgatgccggaggatatttccaggctgccagccactcgccctttccgggcgaccagactcgccccggcggctcgcgtccttcgcgcacaatcacaccgtcgctgacgaagggcagcggcgagcgataccagcgctggcgccactgcgccacctgctcgatgcgcgacaccggatgggtatattgtccgctgtacttaaaccccgcctgcgccagcagctgctgacgacggcgcatatccgacgggccgtctggccaggcccagataaaaacgtccagttgactgagcgccgccgccgcgtcggctcgcatcatcaacccggcgactttcgcccgcgcgttcatccccccagcctgctgctgaacatggccgtcccggcgcagaaacagctccccctgcagtacgctgtcggccagttcaccggtcatcactttctccagcgctgggatctgccgggctcgggcggtccatgcctcaccgcgcagaccatcgccgcggctaatggcctgaaccagacgcccctggcgataaacgagagtcaccgccacgccgtccactttaggctgtatccacaggtcggatttatttttcatccagcgggcaacgctgtcctcatccgccagcttgcgcacgccggtatgggccaccggatgacgcgcatcgccggtgggcggaggcagatcgtcatcctcaggcgtcgcgcccggaaagcattgtcgccactgcgccaggcgcagggtgagctggtcgtaaacgtcatcgctcactccgctggcgccctgccgccagtaagcctctttccaggcgacaatttgctgatgaaggcgtgatgtctcctgccttcctctggccggcggccagtccggacacgtcgccagcgcgctggcagagaacatccctaacgccagccaccaccctcctttacgcattgcagtcccctcctccatcacctcgcggagagtctgctgcagaatgccgcgagccgcgacggaagctttttcgccttgcgaagcgccttccaggatttacgcctcattgcagcaacggctggcgaattcaggaaaacggcaggcaaaatgaaagaaacagcggcaaaaagtgtgacaatgactgcgtcacgccgcggcgacgtgtataataggctcgtatgtaggacctctttcgataaccacatacaaaagacactcatggctcaaggcacgctttatattgtttccgcccctagcggcgcgggtaaatccagcctgattcaggctttattaaaaacccaaccgttgtatgacacccaggtatcggtctcccataccacgcgggcgccgcgtccgggtgaagtgcacggcgaacactatttcttcgtgaatcacgacgaattccgctcgatgattggcgaaaacgcgtttctggaacatgcagaggtctttggcaactattacggcacgtcgcgtaaagcgatcgagcaggtgctggcgaccggcgtcgatgtcttcctcgatatcgactggcaaggcgcgcagcagatccgtaaaagcatgcccggcgcgcgcagtatttttattctgccgccgtcaaaagatgaactggaccgtcgcctgcgcggccgcggccaggacagcgaagaggtgatcgcgaaacggatggcccaggccgttgcggaaatgagccattacgcggaatatgattacctgattgtgaacgatgattttgacaccgccctgagcgacctgaaaaatatcatccgcgctgaacgtctgcgcatgagccgccaaaagcagcgacatggcgctttaatcaccaaactattggcagactgaacccacattcagtatcatgcccagtcatttcttcacctgtggagcattttaagtatggcacgcgtaactgttcaggacgctgtagagaaaattggtaaccgttttgacctggtactggtcgccgcgcgtcgcgctcgtcagatgcaggttggcggaaaggatccgctggtaccggaagaaaacgataaaaccaccgttatcgcactgcgcgaaatcgaagaaggtctgatcaacaaccagatcctcgacgtacgtgagcgccaggaacagcaagagcaggaagccgctgaattacaagccgttaccgcgattgctgaaggtcgtcgttaatcacacagcgggtcgcccttgtatctgtttgaaagcctgaatcagctgattcaaaactacctgccggaagaccagattaagcgtctgcggcaggcgtatctcgttgcacgtgacgctcacgagggtcagacacgttcaagcggtgaaccctatatcacgcacccggtcgcggtagcctgcattctggccgagatgaagctcgactatgaaacgctgatggccgcgctgctgcatgatgtgattgaagatacccccgccacctaccaggacatggaacagctttttggtaaaagcgtcgccgagctggtagagggggtgtcgaaacttgataagctcaagttccgcgataagaaagaggcgcaggccgaaaactttcgcaaaatgatcatggcgatggtgcaggacatccgcgtcatcctcatcaagcttgccgaccgcacccacaacatgcgtactctgggctcgctgcgcccggataaacgccgacgcatcgcccgcgaaaccctggaaatttacagcccgctggcgcaccgtttaggcatccatcacatcaaaaccgagctcgaagagctgggctttgaagcactgtaccctaatcgctaccgcgtcattaaagaggtggtcaaagcggcgcgcggcaaccgtaaggagatgattcaaaagatcctctccgaaatcgaagggcgtttgcaggaagcggggatcccctgccgcgtcagcggtcgcgagaagcatctatactccatctactgtaaaatggtgctcaaagagcaacgttttcactcgatcatggatatctacgccttccgcgttatcgtccatgatgccgatatctgctatcgcgtgctcggccagatgcacagcctctacaaaccgcgtccaggtcgtttcaaagattacatcgccattccgaaagcgaacggctatcagtctttgcatacctcgatgatcggcccccacggcgtcccggtcgaggtacaaattcgtaccgaagacatggaccagatggcggagatgggggtagcggcgcactgggcttataaagagcacggcggcgaaagcagcaccaccgcgcaaatccgcgctcagcgctggatgcaaagcctgctggagctgcagcagagcgccggtagctcgtttgaatttatcgagagcgtaaaatccgatctgttccccgatgagatttacgttttcaccccggaagggcgcattgtcgaactgcctgccggcgccacgccggtggacttcgcctacgcggtgcataccgatatcggtcatgcctgcgtcggcgcgcgcgtcgaccgtcagccctatccgctgtcgcagccgctctccagcggtcagactgtcgaaattatcaccgcgccgggcgctcgcccgaacgccgcctggctgaactttgtcgtcagttcgaaagcgcgcgccaagatccgtcagctgctgaaaaaccttaagcgcgacgattcggtcagccttggccgtcgtctgctcaatcacgcgctgggcggaagccgcaaactcgccgagatcccaccggagaatatccagcgcgaactcgatcgcatgaagctggcctcgcttgacgatctgctggcggaaatcggtctgggcaacgccatgagcgtcgtggtggcaaaaaacctgcagcagggcgaagccgctgcggcgccggtgccggccaacgcgtcgaaccacggtcatctgccaatcaaaggcgccgatggcgtgttgatcaccttcgccaagtgctgtcgtccaattccaggtgacccgattatcgcccacgtcagcccgggtaaagggctggttatccaccatgaatcctgtcgtaacattcgcggctaccagaaagagccggagaaatttatggcggttgagtgggataaagagaccgctcaggagttcatcaccgaaatcaaggtggacatgtttaaccaccagggcgcgctggctaacctgacggcggcgatcaacaccgcgtcttccaatatccagagcctgaatacggaagagaaagatggccgcgtatacagcgcctttatccgcctgaccgcgcgcgaccgcgtgcatctggcgaatatcatgcgcaaaatccgcgtcatgccggacgtgattaaagtcacccgtaaccgaaactagctttatgaactcaaagcgctacgagcgtatctgcgagatgctcgccaggcgtcagcctgacctgacggtctgcatggagcaggtccataagcctcataacgtctctgcggtcatccggaccgcagatgccgttggcgtacacgaagtgcatgccgtctggccgagcagccggatgcgtaccatggcctccgccgccgcgggcagcaacagctgggtgcaggttaaaacccaccgcactatcgcagatgccgtcggccacctgaaaggccagggcatgcaaattctcgccactcacctttccgacaaagccatcgattttcgtgaaatcgactatacgcgtccaacctgcatcctgatgggtcaggaaaaaaccggcatcacccaggaagcgctggcgctggccgatcaggacatcattatcccgatgatcggcatggtgcagtcgctgaacgtctccgtcgcctcggcgctgatcctttacgaggcgcagcgccagcggcagaatgccgggatgtaccaacgcgccaacagcatgctgccgccacaagagcagcagcgcctgctgttcgaaggcggctatccggtgctggcccgcgtcgccagacaaaaaggtctgccttacccccacgttaacgagcagggcgaagtggaagccgatgccgcgtggtgggctaccatgcaggctgcgaggtaaacccaatgtcaggccgcctgttagatgccgttccgctcagttcactcaccggtgtgggcgctgcgcagagcagcaaactggcgaagattggcctgcatacggtacaggatctgctgctgcacctgcctttacgctacgaagatcgcacccatctttacccgatagccgagctacttcccggagtttatgccaccgtggaaggtgaagtgctcaacagcaatatcaccttcggcggccggcggatgatgacctgccagatcagcgacggcaccggcatcctcaccatgcgctttttcaacttcaacgcggcgatgaaaaacagcctcgcgaccggtcgtcgggtactggcctacggtgaagccaaacgcgggaagtacggcgccgagatgatccacccggaatatcgcgtccagggcgatatgagtactccggagctgcaggaaacgttaaccccagtctatccgaccaccgaaggcatcaagcaggcgaccctgcgcaagctcaccgatcaggcgcttgagctcctggaaacctgcgcgattagcgaactcctgccgccggagctggcgcaggggatgatgagcctgccggaggcgctgcgtacgctgcaccgcccgcctccctccttgcaacttagcgagctggaaagcggcaagcacccggcgcagcagcgtctgattctggaagagctgctggcgcataacctcagcatgctggcgctgcgggcaggcgcccagcgctatcacgccctgccgctcggcgccaacgataccctgaaaaaccaactgctggcctccctgccctttaagcccaccggcgcgcaggcgcgggttaccgccgagattgaacacgatatggcgctggacgtgccgatgatgcgcctggtgcagggcgacgttggctccggtaaaacgctggtcgctgccctggccgccttgcgcgctatcgtccacggcaaacaggtggcgctgatggcgcccaccgaactgcttgccgagcagcatgccaataacttccgcaactggttcgaaccgctgggcatagaagtcggctggctggcgggcaaacagaaaggcaaagcccgtcaggcgcagcaggaggctatcgccagcggcgaggtgcagatgattgtcggcacccacgccatcttccaggagcaggtgcagtttaacggcctggcgctggtgattattgacgaacagcaccgcttcggcgtgcatcagcggctggcgctgtgggagaaaggtcagcagcaggggttccacccgcatcagctgatcatgaccgccacgccgatcccccgcaccctggcgatgaccgcctacgccgatctggacacctcgattatcgacgagctgccgccaggccgaactccggtgaccaccgtcgccatccccgacacccggcgcagcgatattatcgaccgcgtgcgcaacgcctgtacccatgaaggtcgccaggcctattgggtctgtacgctgattgaagagtccgatctgctggaagcccaggcggcggaagccacctgggaagagctcaaactggcgctgccggagctcaatatcggcctcgtccacgggcggatgaaaccggcggagaagcaggcggtgatgctggccttcaagcagggcgagatgcatctgctggtagccaccacggtgattgaagtcggcgtcgacgtgcctaactcaagcctgatgattatcgaaaacccggaacgtctgggtctggcgcagctgcaccagctcagagggcgcgtcgggcgcggcgcagtcgcttcccactgcgtgctactctataaatcgccgctctccaaaacggcgcagaaacgtctgcaggtcctgcgcgacagcaacgatggtttcgtcattgcccagaaagacctcgaaattcgcggtcccggcgagctgctcggcacccgccagaccggcaacgccgaatttaaagtggcggacttactgcgcgatcaggcgatgatccccgatgtccagcgcattgctcgccacattcatgaacgctatccgctgcaggcccaggcgcttatcgagcgctggatgccggaaaccgaacgctattccaacgcgtagcgcgcttttgccgcgctgcgggcaatttttctacacaacgagtggattatgaaacgagaactggccatcgaattttcgcgtgtcaccgaagccgccgcgctggcgggctataaatggctgggccgcggcgataagaataccgccgacggcgcagcggttaacgccatgcgcattatgcttaacctcgtcaatatcgacggcaccatcgtcatcggcgagggcgaaatcgatgaagcgccgatgctctatatcggcgaaaaagtgggtaccggcaagggcgatgcggtagatatcgccgtcgatcccatcgaaggcacccgcatgacggcgatgggccaggccaacgccctggcggtgatggcggtcggcgataagggcagcttcctcaacgcgccggatatgtatatggaaaagctgatcgtcggcccgggcgctaaaggcgctatcgaccttaatctgccgctggaagagaacctgcacaatatcgcccgcgccctgaacaagccgctgggcgagctgaccgtcaccgtgctggcgaaaccgcgccacgacgcggtcattgcccagctgcagcagctgggcgtgcgcgtgttcgctattcccgatggcgacgtcgcggcctctattctcacctgcatgccggatagcgaagtcgacgtactgtacggcatcggcggcgcgccggaaggggtggtttccgccgcggtgatccgcgccctcgacggggatatgcaggggcgcctgctggctcgccaccacgtgaagggcgataacgaagagaaccgccgcatcggtgaaaatgagctggcgcgctgcaaaaccatgggcattgaagcgggcaaagtgctgcgtctggatgaaatggcgcgcagcgataacgtcgtcttctccgccaccgggatcaccaaaggcgatctgctggacggcatcacccgcaagggcaacatggccaccaccgagacgctgctgatccgcggcaagtcgcgcactatccgtcgtatccagtcgattcattacctcgaccgtaaagatccagacattcagcagcacatcctgtaataccgctttttctctcccaggcaaccgtccgcaggcggttgccctgttcttcgtttatatttgatcaatagagctttcttgcgccttcggggtggaaatctggctcgtctggaccgaagataaggcatcgcttggcaacaggagaagacgatggcggactgggttagcggcaaagtgacaaaagtggagtactggacggacgccttgttcagtttatacgtgcgggcgcctgttcatccgtttaccgccgggcaatttaccaagctcgggctggaaatcgacggcgaacgcgtgcagcgcgcctactcctacgtcaacgcccccggcaatcccgacctcgagttctatttggtcaccgtcccggaaggcaagctgagcccgcgtctggcggcgctgaagccgggcgatgaagtcctggtggtgagtgaagcggcaggtttcttcgtcctcgaggaagtaccggattgcgataccctgtggatgctggcgaccggcactgccctcgggccgtacctgtcaattttgcaggaaggcaaggaccttgagcgctttaataacctggtgctggtccacgccgtccgctacgccgcggacctgagctatctgccgctaatgcgcgaactggagcagcgctatgccggcaaactccgtattcagacggtggtcagccgcgaaaccgtggaaggctcgctgaccggccgggtgccgtttctgattgaaaccggcgcgctggaagaggccgtcggcctgccgatgaccactgacaccagccatgtgatgctgtgcggcaacccgcaaatggtgcgcgatacccaacagctgttaaaagagacccggcagatgaccaaacatctgcgtcgccggccgggccatatgacggcggagcactactggtaatcaggcgtccgctttccagcgcacgtcctgggtctccttgccgaacttattctcgccctgggtgccgacaaacgcccccaggtcgatcagcatcatgacgataatcagcgtcggcacaaagcgcccgacgccccactgccagacctgcggcaacatcgcccagttccccgccagcagcatccacgccagaaccatcagcagcgcccacagcccggatttgccgcgatcgtgcagccgcttgaccaccaccgccgccgtcggccacagcaggcagacgataataaacgccgccgtctgcaggttgagcagattgctgcctgccagggtaaacagggcgctcatggtcaccagccagatggcaatccagatccagaaatcgcggcggccaatgcgccctttaattgagaataaccactgctgtagggtcatgcgtttttccttatcatcatcgtctgcgtagtttaccctggcgtcgtgactttttgacaagcgccgcgcttcccgatttaatcgtcagcaggcaaaaaaaggaacgacgggcatgaagaagtggacaattttgtggttaagtgggctgatgggccttgccgtcggcccgcacgcgttgtccgcagagagcgaatcgacgaccgcggcagcgccctacctgctcgccggcgcgccgagctttgaccagtcgatcagtcagttccgcgagaaattcaacgccgataacccaaagctgcctctgaacgaattccgttccatcgccaccagtcgcgatcgggctaacctgacccgcgccgccagcaaaattaacgaaaatctctatgcctccaccgcgctggagcgcggcacgctgaagatcaaatccatgcagatcacctggctgccgatccaggggccggagcaaaaggcggccaggaccaaagcgctggagtatatgagcgccatgatccgcgccttcgtgccgacttttagccaggcgcaaagccagcaaaaactgcagaaactgctggccgccggcaagggcaagcgctacttcgccgataccgaaggcgccgtgcgctatgtggtggcagatcatggggaaaagggcctgaccttcgccattgaaccgattaagctggcgctatctgaaacgctggaaggtaacaataaatgacaaaaagcaaagcctttccagtgacgagtctctatactgtttcacagaccatgctgccctctggggcggctatattccttaattcgcttaagtagcgtggagaattaaaatgcgacatcctttagtgatgggtaactggaaactgaacggcagccgccacatggtaaacgaactggttgcgaacctgcgtaccgagctggctggcgtaagcggctgtgcagttgccatcgccccgccggaaatgtatctggacctggctaagcgcgcggcagaaggcagccacattcacctgggcgcgcagaacgttgacgtgaatctgtccggcgcattcaccggtgaaacctccgccgaaatgctgaaagatatcggcgcgcagtacatcatcatcggccactccgagcgtcgtacctaccacaaagaatccgacgagctgatcgcgaagaaattcgccgtgctgaaagagcagggtctgaccccggttctgtgcatcggtgaaaccgaagccgaaaacgaagcgggcaaaacggaagaagtttgcgcgcgtcagatcgacgccgtgctgaaaacccagggcgctgccgctttcgaaggcgtggttatcgcttacgaaccagtatgggctatcggtaccggcaaatcagcgaccccggctcaggcgcaggcggtgcacaaattcatccgtgaccacattgctaaagctgacgccaaaatcgctgagcaagtgatcatccagtacggcggttccgttaacgctggcaacgccgcagagctgttcacccagccggacatcgacggcgcgctggttggcggcgcctccctgaaagctgacgctttcgcggtgatcgttaaagcagcagaagcagcgaaaaaagcgtaattcgcttttcccggtggcgacacgcgaccgggttgactgacaaaacgtgggagcccggcctagcacagcgcaagccgggctttcttttgccgttacagtttccccaacagctgataccaggcgtagtccagcggcagtaaaatcagataactcaccgccgccagcgccagacacagttgcatccccgccctcgccgggaccttgcctaaccccatcgccaccacgatcggcgacgcctgatagggcagcagcggcgtggaatagcccagcacctgaatcataatcacgcttagcagcggaaaaccggtggcgtcggcaaagctctgggcaaaggtggtatacagcgccggcacgccgttggcggtcataataaagttcagcgcgctggttatcccggtcagggcgagaaagctggtgaaaggattgtctttatccaggggcatcacctgcagcagcgcattgcccactgcgccgccaatcccggtttgggtgacggcgatcgctagccccagaatcccggcgacgtaaatgcaggtgcgcatattcaccccgctggcaaactcctcgccgttaataaagcccacccgcggcagcagcgtgatcacagccgccgccaggccggtccacgccgggccgacgccgtgccagctctcggtcacccatagcgagaggaccaccgccagcagccacgccagacgtttctcgtcgcggctcatcggcggcagcggcgccaggtcgcgcggtggatgcggcttgccgggaaacagccagcaaatcagcgccaccagcaccgcccctttcagccagccaagcaccggcgtatgcagcagtaaatagggaacataattcagatggataccgtacgagccttccgccgcgccactcatcaccagattcggcacgttggcgggcaaaatcgttgccgacagctgaaaggtgccgaaccccaccgccagcgccaggccgaaccagccgcggctgccgtcggcaatgcccgcgcggcgggccatcgccgccacgatcggcatcagcagcgcgatgcgccccatgttggagggcatcacgaacgccagggcgtagctcaggagtaccacgctggcgaccatccgcggccaggagtcggtgagcctggccgacagcgcctgcgccgcccggtccgccagtccggttttacggatggcgatgccgagcacaaagccgctgaacaccagccagaacgccgaagaggcaaagccgccgaagatcacctccggcggagcgattttcgccatcattgccgctgcgaagaacagcagcgcggtgataaattccggcagcagcgacgtcgcccagagcacgatggtgacgccgacaatcaatgaaggaaggaacagcgggtgggtaagccagagcgacatgcctgtctcctgtcgtttttttcagcaagaatacgacgacaggtaagacaggtaaacgccagaactagtggtttgcgttaaggatggcgcagcgatgatcctgaatttcttccgctgaagcccggttcagggtcagcaggttacgctccgtcgcaagcagcaccagcgagccgtcgctctgttgcgccattgccagcgcgaagcgtcccatatgttcacgcgcctccggcacctcttccgccagcatcaggaacgggctacgctgggccagctccgcctccgtcacccgtcgcgccaggtattcgtggccctgaagcccgcccggtagcggcagccagcggctgctgatcgctgcggcatccttatctaactgcgcgcgcacatcggggcgcaggcaggagatatgaatatggaaatggttttgcgtacgtccactgcgcgagttgatcgccagcgataccgcgttatcaggaaccggcgcgccgtggcgctggctcatgatttcacgcccctgccaggcctgccagaaaaagttcggcgtcaacggatccagcagcagcgggctttcggtgccgttgatgcggtaggtcggcatcagcaaatactgcagcgggccgttacggtctttaaacagcacatagccgcccttgaggttcacttccgcgcacggcgacgggttttgctgctgttgctgatggggtacgcactgctgcaggacaatcttgcgtaatgcgtccgggttgccagagtgcagccagtagtagccgcccgccagcgccgcgaggatcgccaccagcagcgccagcaaaaagtatcttactcttctcattttcattccctgttaagcctgaagcggaagagtagcgtaatttgatgactaaatgaaaacagatggtggacggggcgttatcccgggtagcggctgatgccttacccgggctacgcaccgcgcaaaactgtagccctgctaagcgtagcgcaagcagggacaagagaattaacgctggctaatctggtcgaaggtgccgccgttggagaagtgctctttctgcgctttcgtccagccgccgaactcctgatcgatggtaaacagcttcagtttcgggaattcgttagcatatttcttcgccacattcggatcgcgcgggcggtagaagttcttcgccgcaatctcctggccttccggcgagtagagatacttcaggtacgcttccgccacctgacgcgtgcctttcttatccaccactttgtcgaccaccgagacggtcggctcagccagaatcgactcacttggggtcacgatttcaaacttgtctttgcccagttcgttggtcgccagcagcgcttcgttttcccaggcgatcagtacgtcgccgatgccgcgttctacgaaggtattggtcgaaccgcgcgcgccggagtccagcacttccacgtttttatacagcgccttgacgaattcctgggctttcgcctggtcgccgtgattctgatgcagggcatagccccaggccgccaggtagttccagcgggcgccgccggagcttttcgggttcggggtaatgaccgacacgcccggtttgatcagatcgttccagtcatggatctgtttcggattgcccttgcggacgaggaacacgatggtggaggtatacggcgcagagttatccggcaggcgtttcagccagtttttatcgatgcggccgcgttcagcaatagcgtcgacatcgtaggccagcgccagcgtgaccacatccgcttcaataccgttaatcaccgaggtcgcctgtttgccagagccaccatgcgactggcggatcaccacgttgtcgccggtctcctgcttccagtgtgcgctaaacgctttgttgtactgttcgtacagctcgcgcgttggatcataagatacgtttaatagctgaatgtcttttgccagaacgctggcggatgccagcaacagagttaaccctacgccccacttattcatcgcaccgctctctttatgtgtgttgtgatgggttaagcgtgccagaaagcgattcaatgattaaagaataaaaaaagattggctataacttgcggatataaagacgcgagtaaggatgaccccctcccgggcgggagagggcgcgaagcgattagacttcttccatgcgacccagcagcgcctgcagacgttcctgccagccctgctgctgctctttcagctggctgttttcgcgctccagctcttcacgaccatgctgcgcgctctgaacttcctgcaccagggtgttgttcttttctttcagctcttcgatttccatctgcaacagagtgatggtatcaatcgcctgctgaaccttagattctaatttctcaaacacttctaatgacatcgtcatacctctcctgaacttgcaaggcgttgatagaaactcgtgtttcgtatacgcggtcccgccttaacgaaaattagcgcacatagcggtgttatcgtcgattgtatgaatccccgccgcccctgtccagcggcaagccgcgtagattgcggtttgcaacacttttcagtctttacctggtgctttcagcgcagttcgctcgtagttcatgggtcaatgttaattttatggttaacaaaatgcgtggtgaaacgctccggcagcgctctcaatgcgcgcaaatggcgcgaaaacgctcattttcttgacgaggcacacacatttgaagttcgatatttctcgtttttgctcgttaacgataaattaacactatgcctacatggcaatatggtcgtctgtgaccaccctacatacaataatcatcaccacgcttcaggattcgattatgagccaaacatcaaccttaaaaggccagtgcatcgcagagttcctcggtaccgggttgttgatctttttcggcgttgggtgcgtggctgcgctcaaggtcgcgggagccagcttcggacaatgggaaatcagcatcatctggggtctgggcgtcgccatggcgatctacctgaccgccggggtctccggtgcgcaccttaacccagcggtgactatcgcgctgtggctgttcgcctgcttcgaaggccgcaaagtggttccttttattatttcgcaattcgctggcgccttttgcgctgcggcattagtttacgggctttactacaatcttttcctcgattatgaaaccacccaccatatgattcgcggcagcgtggaaagcctcgatctggccggcattttctccacttacccgaacccgcacatcaattttgtgcaggccttcgcggtagagatggtgattaccgctatcctgatgggcgtcatcctggcgctgaccgacgatggcaacggcataccgcgcggcccgctggcccctctgctgattggcctgctgattgcggtgattggcgcctccatgggaccgctgaccggcttcgccatgaacccggcgcgtgacatcggcccgaaagccttcgcctggctggcggggtggggtgacgtcgccttcaccggcggcaaagatattccttatttcctggtgccgctgtgcgcaccggtggtcggcgcggcgctgggcgcattcagctatcgtaagctgattggccgtcacctgccttgcgacacctgcgtggaggaagagcaacagagcccctcctcttccaccgctcaacataaagcttcgctgtaatctgactacgggacaccgactatgaccgacaaaaaatatatcgttgcgcttgaccagggcactaccagctcccgggccgttgtgatggatcatgatgccaatatcgtcagcgtctcccagcgagaatttgaacagatttatcctaagccaggctgggtcgaacacgacccgatggaaatctgggcttcccaaagctcgacgctggtcgaagcgctggccaaagcggatatcaactccgatcagatcgcggccatcggcatcaccaatcagcgtgagaccgtggtggtgtgggagcgagagaccggtaaacccatctacaacgctatcgtctggcagtgccgccgtaccgcggagatctgcgagcagctcaagcgtgacgggatggaagagtatatccgcaaggccacaggcctggtggtggacccgtacttctccggcaccaaggtgaaatggatcctcgaccatgtcgaaggttcccgtgagcgtgcgaagcgcggcgagctgctgttcggcaccgttgacacctggcttatctggaagatgacccagggccgcgtgcacgtcaccgactacaccaacgcctcgcgtaccatgctgttcaacatccacgacctcgactgggacgacaagatgctagacgcgctggacattccgcgcgccatgctgccggaagtgcgcaagtcttccgaagtgtacggtcagaccaacatcggtggtaaaggcgggacccgtattcctatcgccgggatcgccggtgaccagcaggcggccctgttcggccagctgtgcgtcaaggaagggatggcgaaaaacacctacggcaccggctgctttatgctgatgaataccggcgaaaaagcggtcacctccacccacggtctgctgaccaccatcgcctgcggcccgcgcggcgaggtgaactacgctctggaaggggcggtgtttatggccggcgcgtctattcagtggctgcgcgacgagatgaagctcatcagcgatgccttcgactccgagtacttcgccaccaaagtgaaggataccaacggcgtatacgtggtacccgcgttcaccggtcttggcgcaccgtactgggacccgtatgcccgcggcgcgattttcggcctcacccgcggcgtgaactccaaccacattatccgtgcgacgctggagtccatcgcctttcagacccgcgacgtgctggaggcgatgcaggctgactccggcattcgtctgcacgccctgcgcgtagacggcggcgcggtggctaacaacttcctgatgcagttccaatccgatatcctcggcacccgtgtcgagcgtccggaagtacgcgaagtgacggcgctgggcgcggcctatctggccggtctggcggtcggtttctggcagaatctggatgaactgcaggagaaagcggtgattgagcgcgaattccgcccggggattgaaactactgagcgtaactatcgttacagcggctggaagaaagcggtgaaacgcgcgttagcgtgggaagagcacgacgaagcgtaagattgtgaagttattcccggcttgcggcgtaaacgccttagccgggctacaaaaccccaaacagcacgatcttgtagcccggacaggtgcgcagcaccgcctccgggttttttatcagccaaatatcggcagcagcaggtacagcttaatcaccagcgcgttgacgatatcgataaagaacgcccccaccatcggcactaccaggaaggccatatgcgatggcccgaaacggtcggtaatcgcctgcatattggcgatcgccgtcggcgttgcccccaggccaaacccgcaatgcccggctgccagcaccgcggcatcgtagtttttgcccatcatccgataagtgacgaacaccgcatacagcgccatcgccagcgcctgcaccgccaggataataatcatcggcagcgccagcgaggccaactcccacagcttgaggctcatcagcgccatggcgaggaacagcgacaggctgacgttgcccaataccgataccgcgcgatcgaacacccgatacaaccccgccagcgccaggctgttgctgaggatcacgccgataaacagcacgcagacgaaggtcggcagctcgaagacgctccccgccagcagttgcgcaaccaccttgcccagcgtcagacagatggcgatcagggcgatactttcgatcagcaccagcgaggtgatcacccgccccacgtccggcttttcaaaggcggttggcgccacctgatcgtccggtgtcccgtccggtgaggaagagtgcttcaccagataacgcgccaccgggccgccgatcaggccgcccagcaccaggccgaaagtcgcgcaggccatcgccacctcggtggcgttggcaaaaccgtagcgctcaacgaacagcttactccacgccgccccggtgccgtggccgccggataaggtaatcgacccggccagcagacccattagcggatccagccccagcagcgtcgccatgccgataccgagggcgttctgcagcagcagcaggccaaccaccacgatcaggaaagtgcccagcaccttgccgccggcccgcaggctggcgaggttggcgttaagaccgatggtggcgaagaacgccagcatcagcggatctttcagactcatatcgaaatcaatttcgatatccatgctttttttcagcgccagcagcgccagcgccaccagcagaccgccggcaacgggttcaggaatagtgtatttcttaaggaagggaacggtttgtacgagttttctgccgagtaacagcacgagcgttgcggcaacgagcgtcgataaggtatcgagatgaaacataaaaagctccttatgggcgcatgatccattcacacgcgacgatattcctggtgtctttagcttctcatcatgaggagtcagagggggattttacgcagaacggcggaaaaattgacagaaaaagatattttgtatccttaatgatgcgatttagcatacaaaatgttaattacctcgttgcgcatattcacggtataaatttttatgagcaaacgctggcaaacgtttgcttttggtctacagtccgataaaattcccgctttgccaccttgggattgcttgtgatgtccgttaacaccgcagagtcagaaaatgcgcaaccggttgcgcataaaccagccagcgaattaatctaccgcctcgaagatcgcccgccgctaccgcaaaccctgttcgccgccttccagcacctgctggcgatgtttgtcgcggtgatcaccccggcgctgttaatctgccaggctctcggtctcccggcgcaagatacccaacatatcatcagcatgtcgctgttcgcctccggcgtcgcctctattattcagatcaaagcctggggcccggtcggctccggactgctctccatccagggcaccagcttcaactttgtcgccccgctgatcatgggcggtaccgccttgaaaaccggcggcgccgacgtccccaccatgatggccgccctcttcggcaccctgatgctggccagctgcaccgaaatggtcctctcccggatcctgcacctggcgcgccgtatcattaccccgctggtttccggcgtggtggtgatgattatcggcctgtcgctgattcaggtcggactgacctccatcggcggcggctacgcggcgatggccgaccacacctttggtgcgccgaaaaatctgctgctggcgggtatcgtgctggcgctgattattatcctcaaccgccagcgcaacccgtacctgcgcatcgcctcgctagtgattgccatggctgccggttatctggcggcgtggttcctcgatatgctgccagccaacaccgccccgaccaacagcagcctcatcaccgtcccgacgccgctctattatggcctcggcatcgactggagtctgctgctgcccctgatgctggtgtttatgatcacctccctggaaaccatcggcgatatcaccgccacctccgacgtctccgaacagccggtctcgggtccgctgtatatgaagcgcctgaaaggcggcgtgctggctaacggcctgaactccttcgtttccgcggtcttcaacaccttcccgaactcatgcttcggccagaacaacggcgtgatccagctgaccggggtcgccagccgctacgtcggctttgtggttgccctgatgctgatcgtcctcggcctgttcccggcggtgagcggctttgtccagcatatccctgagccagtgctcggcggcgccacgctggtgatgttcggcaccatcgccgcgtccggcgtgcgcatcgtctcccgtgaaccgctgaaccgtcgggcgatcctgattatcgctctgtcgctggcggtaggcctcggcgtgtcgcagcagccgctgatcctgcagttcgccccggactggctgaaaaacctgctttcctccgggattgccgccggcggtatcacggcgattgttctgaatttaattttcccgccagaaaaggcgtgatctcatgcgttcccggtcacgcaacggccgggacgtcctccaaccaccagccccatcacggaaataaaccacgcctgccttgagaagtgcgcctaaatcgggcataacacggtgatgtgcatctcacagaatggaagaccatgaaatttcttggaaagctgattctctggctgctagtcgctctgctgctcgtcattattggcgcgtggttcctgctgcaaacccactggggcgcccgccagaccagcgcctggctcagcaatggcaccggctggcaggtctccttcgatgagatggagcacgatttctcctccccccttcatgtgcagttgcgaaacgtcacctttggtcgggaaggcaagcctgccactttggtggcaaaaacggtcgacattggcttcagcacccgccagtttagcgatccgctgcatgcggatgagatagtccttaacgacggcactctgaatctgtcaccccactctgcagacctgccgttcgctgccgaccggctgatgttgcgcaatatggctttcaacagcccggaaaccggctgggcgctcagcgcgcagcgcgtcaccggcggcgtcagcccatggacgccggaggcgggcaatgtgctggggaaaacggcgcagatccagatgagcgcgggctcgatgacgctcaatggcgtcgaagccagcaacgttctgattcagggtaagattgatcagggcgaggtcaccctctccaccctcggcgccgatgtcgcccgcggcaccttaaccggcaatgccaaacgcagcgccgatggcagctggcgggtggataacctccagctcaacgagattcgactgcagagccccgcctcgctgaccgagtttttcgcgccgttaaccacggtcccctctctgcagattggccgcctggacatcaccgacgcccgcctgcagggaccggactgggcggtaaccgacctcgacctgagcctgcgcaacctgacccttagccacggcggctggcagagtgaggacggcacgctgtcgatgaacgctagcgaatttatctacggctcgctgcatcttttcgacccgatcctcaatgccgaattctctccccagggcattgcgctgcgacagttcacttcgcgctgggagggcggcatggtgcgcacctccggcaactggctgcgcgccgggaacgccctggtgctcgacgacaccgccttcgccggactggagtacacgctgccggcgaactggaaacagctgtggatgacgccgctgccaacctggctgcaaagcctgacgctgaaaaaattcagcgccagccgcaatctgatcatcgatgtggaccctgctttcccgtggcaaattaccgccctcgatggctatggcggcgagctacagctggtgaaaaacggcagctggggagtatggaacggcagcgcgacgctgaacgccgcggcggcgactttcaaccggatcgacgtgcgccgcccatcactcaaactgaacgccacagcctcgacggtcaatatcactgagcttagcgccttcaccgagcgcggcattttgcaggccaccgccgcggtatcccagctgccgcagcgccaggtcaatctgagcttcagcggccgcggcgtgccgctgaatattctgcaggcctggggctggccgtcgctacctataagcggggatggcaatctccagctgaccgccagcggcagcgtgcaggccgatgccccgctcaaaccgacgatcaacgggcagctcagcgccgtgaatatggagaaacagcaggtggcgcaaatcatgcgcaacggcgaggtcagccccgcccccgccgcgccagcgcccgctcccgtcaccccatagcgatgcccattccctctcctctatggggagagggattgcttcccggcaaaactccactctgactactctctccctttcagggagagagttggggtgcgagtcctgaaacctgtgcgcaatacgcggctatctgtacctatttagcgcaacaggttcctttcaaatatcagagttgctataaccaaatcactggaagtcgataaaaaaccgctccctgtacctacaaaaatataaaaggatcaatcatgcctgaaatacgtcagcgtattctggagaatatgcaaaaattctcccgggccatgatcggcgccgtattgttcttgccggtcattggcttaattctggccctcagttcagtattaactaatccgacattaattgctgaaaccagtttcttacatcagcttgggcaaatgctcggcgacaccttttggcctttatttggcaacctcggcttattattttgcgtcggcatcagctatggcctggcaaaggataaaaaaaccgaagtcgcactggtttcagtgatgtgttttattatgtttcttggcgccaaccactcctggctggaacacacccatggactcgccgaaaaaattaacggtgaatattatggcaccgggcaaacccagctgctgggctttgtggtggtggatatgggcgttttcctgggcattattctcggctgcacgattgcgtgggtgcacaataaagtctctgccattgagctgcctggcgcgctgtcgatgtacggcggcgccaagctgacgctggtggcgatgacgccggtggttatcttctacgccatcgcctttacctggatttggccctttatgacccacggcatctccgccctcaccggttttatgaaaaatgccggggtcgccggggtcttcgtctatggtttctttgaaaaattccttatccccaccggcctgcaccatttcgtctggtcccccttccagctcacccagattggcggcacgctgaacgtggatggtcaggtggtctccggcacccaggccattttcctcgcctatatgcgccatcccgacctgacgccggtcatgaacgacgcattacgtttttcgcagcaagggatgaccactatctttggcctggcgggcgcctcgctggcgttctaccacaccgcgaaaccggagaagaaagcgatggcgaaggcgattctgctgccggcgattatcacctcgatgctgaccggcatcaccgagccgattgagttcaccttcttatttgtctcaccgctgctgtgggtgatccacgcgacgttaaccgccgcctcgcaggccatttgcgacatcttcaccgtacgtccctggggagcatcgggcctgatcgagtttctgatctataacctgccgctgccggtctccttaacgcgctggccgggctatgtccttatcggtatcggccagttcgccgtctactacgtgattttccgcaccctggtggtgaagctgaacctgaaaacgccgggccgggaagatgacgagaacgtgaagctctacagcaaagcagagtaccgccagaaagtcgcgcaaccgcagtcggtcaccgatgacattatccgcggcctcgggggcaaggagaatattctctccgtcgataattgttttactcgcctgcgcgtggccgtgcgcgatatggcgcgggttgatgacacgcaattaaaaaataccggcgccaacggcgtcgtacgcaatcgaaatgaagttcaggttatttatggcgtcaaagtgggacaggtacgttcccgggttgataactggttagcagaaaattaatgaggagtatttatgaaattaaccgtattaggcgggggcggcgttcgctctgcatttttagcgaaatctctggcctataacgctcaccgcattggtttaacagaagtcgtttttctcgataactctgctgataatctggcgatatttggcgaaattgcccgctatgtatttaataccattcgcccggatattcagtttagtaccaccaccgacccggtcgcagccctgcaggacgccaactatatcattaccaccctgcgggttggcggcgatgaaagccgcattcgcgacgaacgtattgcgcttgagcataacactctcggccaggagaccaccggcgccggcggtttcgcgatggccatgcgctcgatcccggcgatccttcgctattgccggctgatcgaagaacatgccgccgaagacgctattctgtttaactttaccaacccgtcaggtctggtgacggaagcgattattaagtccggctttaagcgccgggtctatgggatctgcgatgccccctccgagctgattcgtgaactgccggcgatccttggctgtgaggagcgcgacctcagcgtggaatgctatgggctgaaccatttctcctggtttacccacttcaccgtccgtggggaagaggtgaccgaacggctgatcgccagcccggaactgtaccagaagacggcgatgcagtacttctccccggagctggtacggctttgtgataatcagctcctcaatgaatatctctattattactactatcgcgacgaggcgctgaaggcgattcaaggggccggcgagacgcgcggagagcagatcgcccgcatcaatcaggagatgcgcgaggcgctgcgcaccgtggatgccagaacgcaaccggaggccgccttcaccatctggatgcagcattacctacgccgggaaaacagctatatgcagaacgaatcccggcaggagaaattccacacccgcgaaccgctgacgctgcgccagtttatcgaagagccggacaccggcggctatgccggagtggcgctggatatcctggaagcggtgaacagcaccaccaccaagcggatcgtggtgtcgatccagaatcacgacacgctcgactttttgcgcccggacgacgtgatcgagatcagctgcgacctgagccgggatggcctcaaaccggtgacgccggtgaaggtaccgacggcgcagaagaatatgattgcctgcgtgaaggagtatgagcggctggcggtggcggcgatcctgcagcaggataaatcgctggcggtgcgggcgctgatggcgcacccgctgatcggttcctattcgctggcgaaaaccctggtcgaagcctatctcgacgatgagcagttcgccgcctggcggtaatccgctgccgatgggattcccccgctcgcaccgcgcttagcgggggctaactattgctacgtagactggtaaaccacatcttcaatagtcgctcaaagcctaagatgcagtagccgaaaaacgggttgctccagtaaatatcatcatcgaacttctgcgggtcgtgaataataaacgccgtatccgcggcctgcgccagcgggctttggtagtcgccggtaaagcagaccagattaatctccttcccctccagggccttaacccagttgagcgccgagctgctgcgcccggatttagaaatgatccagatggagtcgaagcaggcggcgtttttctgttcgaggatttcgtaatcgggccacagcgccaggctggcattcacgccggtgacgagaaacttgttgtaaatatactgggcgatcagctgtgaaaagccgctgccgtggatcaggatgcgctgctgtttaaggcttgccagcagcggcgtcagcgcttcttccggctgaacgctcatgtagtcgatatcgttggtgacatcgagcttcggcatggtgatattgaacttgatgaaatagaccagctccagccagccgctgaacttcagttttttcgctagccggaccagggaagaggggttgctgtagcactgttcggccacagcgcgaactccctggcggatacactgctccgggtcgttctgaataaagcgcagcacggtcatttccgttttgcttagcttcacgtcacgaaagatattttctacgtccatggcgggctcctctcagcggcagaatacgctaacaccgttcgacaaccgcgtctgcggcctgagtcaccacaatgaaatgaacgttactttttgtacaaaaatggaataaaaaaaccctctccgcctggcgaagagggctgcagccgttaagatggtgttttacagggtaatcgtcagcgtattgccctcggcgctcaccaccacgcccagttcgctaccggtctgcgtaccgccctgcacgcccgcgacctgcgggatattgcgcagacacagcgtccagccgcgggcctcgccttcgccgctcacagcgatggcgttaccctggcgcctggccttcagggtgaagatcgtcgagccgtctgccgccggaacgtcacagcgtgcctcgcgtccatcctcaaggtggaacagctggaaggcggtgccctcatgccaggcgtaatccggcttctggtcattgttgcccagcgccagcaggctgttgtcgcgaacgtagaccggcaggctcagcgcatcgtgatgctgcttatgccagcggctacccggcaattcatcgttatgccacagatgcgtccagtgcccttccggcagataaaactgcacttcgccggcctcggagaacaccggcgccaccaggaccgaatcgcccagcatatactggcggtcgagatagtcgcaggccggatcgtccggaaactcgagcatcatcgcgcgcagcatcggcgtgccgcactcgttggccagcgccgcctgacgatagagatacggcatcatgcggcatttcagctgcgtgaagtggcgcaccacgtcgcaggactcgtcatcgtaggcccatggcacccgataggatttgctgccgtgcaggcggctgtggctggagagcaggccgaaggcgcaccagcgcttgtagacgtgggccggcgcggtgttttcgaaaccgccgatatcgtgactccagaaaccaaagccggacatgccgatcgacagcccgccgcgcaggctttccgccatcgattcgtagttggcgtagcagtcgccgccccagtgcaccgggaactgctgcgcgcccaccgaggcggagcgggcgaacagcaccgcctcctgctcgccgacggtctctttcagcaccttccacaccagctcgttatagatgaaggcgtagtggttgtgcattttctgcggatcggaaccatcaaaccactggacgtcggtcgggatacgctcgccaaagtcggtcttgaagcaatcgacccccatcgccacgaggccttttagtttgtcggcataccactggcgggcttccggattggtgaagtcataaatcgccagccccggctgccacttatcccactgccacagcgaaccgtccgggcgcttcagcagataacccttctctttcagctccttgaacaccggcgagcgctgaccgatgtacgggttgatccacacgcagaccttcagccctttcgccttcaggcgcttgatcatcccttccgggtccgggaaggtctgcggatcccattcaaaatcgcaccactggaaggccttcatccagaaacagtcgaagtggaagacgtgcagcggcagatggcgctcagccataccgtcgatgaagctattcaccgtcgcttcgtcatagttggtggtgaacgaggtcgtcagccacagaccaaacgaccatgccggcggcagcgccgggcggccggtgaactgcgtatagcggttaagcaccgctttcggcgtcgggccgtcgatcacgaagtactcaaggtattcgccttcaacgctgaactggactttagagactttctccgagcccacctcgaaggagacgcgctgcggatggttgaccagcacgccgtagccgcggttggtcagatagaacgggatatttttgtaggattgctcggtgctggtgccgccgtcctcgttccaggtttctaccgtctggccgttgcgcaccagggcggtaaagcgctcgccgaggccgtagacggtttcgccgacgccgaggtcgaggcgctcaaacatgtagttgcgctgggtcttactatcctgcacgtagccgttgttttttagctggctaccggtgatacgcacgccgtcgcgcagaaaatccagcccccagaattcgcctttagtcacccgcacgctgaggctgccgcttttcagctcggcgaacccggccgtattttctatttcgacatggacgtctttctgcacgttcagcggatagtgcgggccgttatccagcgcgccctggaagtgctccatgcgcacgccgattatcccttcctgcggcgagaaaaagcgcagggtgaacaatggcgtatccagctgccaggcgcgttcgcggacatcgcgcggcgcggcatagaccaccatttcattcccctgctgctccacctcgtaaacctgtacgggttggatcaggttgagccctggttgaatgagccagtttccatcactgattttcattaaaacgtcctcttagttttgccattctttgtcgatcggggcggcggtgaaatcttgttcgttgcgacgcgcgccctcggccagctcggccatcatttttttcaggaacggcgttttcagcgtgtagtagcgtttggcgatcaccgcgctcagcaggtagcacaccgccggaacgagggtgaacaaggcgataatgatggtgagggtggcgctgttctgggttttagcggcggcatcatagccgccgccggccagcatccagccgatcagcgcgccgcccagcgccagtcccagcttgagcacaaacagggtgccagcgaagctgatgccggtcaggcgtttgccgttacaccattcgccgtagtcgacggtgtcggacatcattacccactggattggcgtcaccagctggtgcagtacgccaatgacgaagataaagacaaacatggtgatttcggcgtccatcggtacgaagaacatcgccacgctgagcaccgccaggagggcgttggtccaccagaagacgctgactttgcatttccagtcggtcagcggtttcgccagcgccgagccaatcaggttgccgacgcagtaggtcgtgaggaaggcggtgaacagcgccgccgagcccatgatccaggtggtgtaatacatcatcgcgccgccgcgaacgcagaccgcgaggatattgaggatggtgagcacgccaaccacccgccactggtcattgcgccagatatcgcgcaggtcttcacgcatcgaggtactgctcggcggcgcttcgacacgctctttggtggtaaagaagcagaaggccagcatcaggaaggcaatcaccgacagcaccgcgatgcccccctggaagccgagcgctttgtcttcgccgccgataaagttgaccagcggcatcatcagcacggtggagagcatgccccccgccgtcgccagcacgaagcgccaggactgcagcgaaatgcgctgcgtcgggttgtcggtgatcacgccgcccagcgcgcagtaagggatattcaccacggtgtagagcagggtcagcagcgtgtaggtcacggcggcgtagatcagcttgccgttgtggcttaaatccggcgagctgtaggccagcacgcagacgaggccgaacgggatagcgccgaagaggatccatgggcggaacttaccccagcggctgcgggtacggtcggcaagcagacccatacacgggtcggaaatcgcgtccagcgcgcgcgccagcaggaacatggtgccgacaaagccggcggggataccaaaaatatcggtgtaaaaaaacatcatgtacaacatgacgttatcaaaaataatgtggctggcggcatcacccatgccataaccaattttctctttgacggacaaaatgtgatctttcatatgcgcactattcccttagcggcaccgagggttggtaccggttacggtttttgtaaacctttgccgcactaagatgaattgcgatatctcgttatcagattacgtttcttgttttctgtgatcgcggtagggaatcagggagtgaaaaagtgtaactcacggattttgtgaggatttgtccaggactgttctgtaaagtccagttttaacagtaaaaaagtgcgtttaggtatgtggtaaacggctgaaagtagctataatgcgccccgcctccatgtagcaatcgaggcgcggaagatcgtcatctccggtgaggtggctggacttcaaatccagttggggccgccagcggtcccgggcaggttcaactcctgtgatcttccgccagtttgcccctgctcccccacagccactccctaccaacctgagccccccaaactcatcatcccagccaatcatttttatccaaaccctgcgttattttgtctctcgcaaacccgttacactggcgcggtggccgcgtgccgttaccaaccgaaacaggagagccataatgacccccgaactcagacactgtttttccattaccatccaggttgataaaccgataattgtctcccgcagcccgcagaccggtaagcgccagctgatcccgattgtcggcggcagcgtctcgggtcaacttcgcggccacgtattacccggcggcgtcgacagccagataatcgaacccgacggcacctgcaggctgtccgcccgctatgccctgcaggtggcggaaggcacggtctatgtggaaaacaatggcatccgccgggtgccggcccagtatcatgaccagcttttcgccgacgatatgcgcttttttagcgatattccgccagaagccatctattttcgcaccgtgcccacctttgaggtggatgctcccgcgctcagctggctaaccacctcgctgtttatctgcgccggtggccggacccaggatggggtgatgctcgacttctatcaggtgggctgattttcactttctgcatataactgttattgccgttagcccgtttttcccctcccggcagcggtctacgatggctccatcttttcattcacccgaatcacagaccggagcagttatgaaagctatcgccattactcaagccgccgctgacggcaacaacatcccttctttaaccgagatcgacctgccgatccccaccgcccacgggcgtgatctgctggtcgctgtgaaggctatctcggtcaatccggtagacaccaaagtgcgcgccggctttcagggcgacacgccgcgggtgctgggctgggacgccgttggcgtggtgcagtccgtcggtgaggaagtgacgctgttcgcgcccggggacgaggtctggtacgccggcgcgctgggccgggccggcagcaacagtgaatatcagctggtggatgagcgcctggtggcgcacaaaccgcgcaccctcgataatgcctccgccgccgcgctgccgctgacggcgatcaccgcctgggagctgctgtttcaccgtctcggcgttgaggaaggcggcaatgcgggcgacacgctgctaatcgtcggcgcggcgggcggcgtggggtctatcctgacccagctggccagtaaactgaccgccatgacggtgatcggcaccgcctcgcgtccggagagccagcagtgggtccgcgaggcgggcgcgcaccatgtgatcgatcacagcaagccgctcgccgacgagctggcgcgcattggtatcacgtcggtaacccatgtcgccagcctgaccaataccgagcagcacttcaacgcgctgatcgacgccctcgccccgcagggcaagctggcgctgattgatgacccggagaccctggacgtggtgccgttgaaagcgaaaagcctgtccctgcactgggaatttatgttcacccgttcaatgtttgagacggatgatatgatcgcccagcatcagctgctcacccgcgtggcggcgctgatcgacaaccacactatcgaaaccacccttggcgaacactacggcgccatcaccgccgccaatctgcagaaagcgcatcgccagctggaaaccggacgcgccgtcggcaagatcgtgctggaggggttttaagatgatatcgcttatcgccgtgctcaaggcgaaaccgggccaaacggacgccctgcgtcaggccctgcaggcgctgctcctgccgacgagacaggagccgggcaacctcgactatgccctgtttcagctgcgcgacgcgccggacaccttctatatgcgcgaggcgtggcagggacaggacgccctcgatgcccatgtcgcgatgccctattttcaggcgtttatggcgcagatggagtctctgctggctgagccgctgcggctggactttctgacgccggttgagccttagcccaccggctgacgaggggtgggaaaatcacgcccctccgccgcgcgggtttaaaagtgggcgggaagcgggtgggttatcttttccagcaccccgcgatggaccgtaatgtaaccacctttgcgcagctctgccagaatcgacataacacggctgcgcgacaggttggtgcggcgctgtataaagcttaacgcattaatttggcgacgatactcctccgggtagtccgccagctctgttagcagggttcgcaccatcggataagaatccacccccaccatctcctgcgaacgcatgctcaacaccatcagccgctgcgccagaacatgggccatctcctgccacaggttttgcgcattgaggatctcgaccgcggcctggtgtcctatccagcgtccgcgcaaatctgtctcagcaaacagagagcagtggtgtttttccggaataccgttaaagacgccgtaaccatcgattaatcccaatagcgaaggggcaaatatcgttgatatcaccatgttgttttccgcatggcatagcgaggcaatcccctcttcgagcagaattaatccggattcagcctgggtcggcggaaaacgataataggtcgatcgcggcagcgcaaagggtgagctggcgggcaggaacgcagataacagggattccaccgcgaataacggctttgtctgtcttccgtaataaaaagacggtaacgcctggtcagtagagaggctggctgcagggatcgacatggtttttatgccatcaggtcaggttgaaaaagtgattcgttgagaatcatagtatcaacaggtgaattaacgaataaaagacaagacgttacgaggataaaaagagtgtaagcatcattatctgcaataactatttatctctattttacaggaataaaaaatacgatgagccttaattacctataaggcttagcggcgataaagataaggccaccttattatttactgcgctggctaacgccgcgcctgagggtttctctaccgctttccccctcgcatctcggccagtccaggctacgcttatcgatgccactgaccacccgcattcccctcccgttctattgagtccattcatcaagaagaggtttcgctatgctgatcaacgctattggtacctactccgccagccagccgctggaatcaatggccatcacccgccgcgacccggggccgcaggatgtacagatcgccatcgcttactgcggcgtctgccactccgatctccaccaggcgcgatcggaatgggcgggaacgctgtatccctgcgtgccggggcatgaaattgtgggtcgggtgaccgcggtcggcaacgccgtctcgcgctacgccgtcggcgatctggtgggcgtcggctgtatggtcgatagctgtcaacagtgcgaagagtgcgctgaggggctggaaaactactgcgaccacatggtgctgacctataacgggccgacccaggacgcgccgggacacacgcttggcggttattcacagcagatcgtggtcaatgaacgctacgtgctgcggataacccatcccgaagcgcagctggccgccgtcgcgccgctgctgtgcgctgggatcacgacatactcgccgctgcgccactggcacgtcgggccgggtaaaaaagtcggcgtggtcggcatcggcggcctggggcatatggggatcaagttggcccatgccatgggggcccacgtggtggcctttaccacctccgaatccaagcgtaatgcggccagagcgctgggcgccgatgacgtggtggtgtcgcgcaacgacgacgagatggcggcccacgtcaaaagcttcgacttcatcctcaacaccgtggcggcgccgcacaatctcgatgccttcaccacgctgctgaaacgcgatggcaccatgacgctggttggcgccccggccacgccgcatccgtcgccggaagtgttcaatctgatcttccgccgccggtcaattgccggctcgatgatcggcggtattccggaaactcaggagatgctcgacttctgcgccgaacacggcatcgtcgccgatatcgagctgatccgcggcgatgagatcaacgaagcctgggaaagaatggtcaagggtgacgtgaaataccgcttcgtgatcgacagtgcgaccctcgccggctaagcgccgcgacgaaaggtacgccgccattccgtcgggctgacgccaaagcgcgctttaaactgctggcgccaggtgaccgctgaaagatagcccaccgcctccgccacctgctcgaccggcagatcgcccgcctcaagcagagtctggctgcggcgcagacgttcggcggtcagccagtcggtaatgctcatcccggttgcccgggcgaagtggcgggtcagggtacggcggctcatcgccaccacccgggccagcgaatcgagactgtgcggctcggcaatatgctgctgcagataatccagcaggcagttgattcgcgcatcgcgggtgtttttcggcaccggctgggcgataaactgcgcctggccgccctcgcggtgcggcgaaacaatcatccgccgggcgatctggttggccgcgaggctgccgaaacgctggcggatgatgtagaggcaacagtccagcgccgccgcggtgcccgccgaagtaatgatccgctggtcgtcgacgtacagggcgttgatatccagctgcacctgcggaaaccggcgctggaaatcctgctcgaactcccagtgagtcgccgctcgcctgccgtccagcagcccggcgtagccgaggacgaacgcgccgaggcacaggccgacaatctccgcgccgttatcccgggcccgcaccaggctatcaagcagcgcctgcggcggacgtcgatcgacctcgccccagtaaggcaccaccacgatatccgcctgttccagcgcggcataatcgccggtggcgtacagcgcaaaaccatcgcgggcgcgcagcagccccggccgctcggcgcaaatgtgcagattaaagcgtttgatttccgaaaccgaatcgccaaacagcatgcaggggacggcgtagtgaaacgggctaaagccctctacagcgacaatcgccacgtcggtgagtttcatcgtcccttccccttacgcatgttaataaaccacggtttctccatcctgcgggatagaaaccacatcggcaatctgattatccagcgcatactggcgcatctcttcccgactcaccaggcagtggttgaccgcctcgaggtggatagccatgatttttgcttccggcagggtgaagtgcacgttcaggagatcttccttgcccatgataatcgggccaaagccgatgacgtgggcgtagccggcgttgaggaccaccacgtccgggcgcagcttcagcaggtcggctgcaatgtcatcgcgccagatagtatcccccaccagccacagcgtcttctcctgcggatggcgaaacaccacgccgcaggcctcgcccaggcgttcagccatcgccggcaccgcgtaggtgcggtcgctgccatgctgcccggaggtggttttcagcagacgcacgccggcaaattcgctgtctgccgacagcaggcgcagatcctgaaatccctggctgcgcagcagcgcggcgtcggcctcatgctggacgaacaccggcagggttttcgggatcgcggcgatcgctgccgcgtcccagtgatcgtcatgggtatgggtgacgatcaccgcatcaacgtcgataattttatcgcgggaaaacggcagctcaaccagcggattacgcagttcgctgcgcgcggtgcccggaaaacccggccaggcgcctttgtccgccagcatcggatcgatgagaaatcttttcccggcgtagtgaataatctgggtcgcattacggatgtgggtgatgttcatgttggcgttcctctggggtcatctgacgaacatcgtactgagtccccgcctggctcaacaggggcgtttgggcaatgatcgatgaaatcgggccaacctgcggcggttgccatccgcctccggctatgttgttcttaaggctcaatttttgacaggagtggcaggatgaaaaagaaactgaccgccgccgatatgcacgacccgcaggtcatcgccgagacgccgtggttcagcatgcgtaaggtgggtattgatgtcgcccccggcgagcgccgcgacttttattccattcattacccgcgcccggcggtggggattgtggccatccaggatgagaaagtgctgctgattcgccactaccgctacctgatcgataaggtggtgtgggcgatcccttctggcggcgtcgatgaaggggaagacccggcggtcgccgcactgcgcgagctgcgggaagagaccggctggcaggcgcaacgcgttgaggagatcattcgctttaacccctcctacggcagcagcgatcagctgtttatcacctggctggccaccggtttacgctgggtggggatggatgcagagcaggatgaggtgatggagaccggctggtttaccttcgacgagataaaccagctgatcgcccacggcgagatgccggacgggctgtcgctggtgccgctgctgcagctgatggcgcagcggcgaagcggctcgcttacggcttaagcatccgccagcggaaccacagctgggccacgaggatcagcacgccgccgataatcttctgcagcggcagctgttcgccgtaccacagcgcggcggcaatgaccgtcagcagcggttcgagcaccatgatgatcgccgcgctggccaccgccgcgtacttctgccccttcatctgcagaccgaagcgcaggctggtagcgatgacaatgctggccaccaaccagccgagagtcggcagggtcatcggctggtcccagcgttcaacggcagcggagatggtcaacccgacgataccggtgatcgccagctgcacggtggtcagggggatcagcggtacttcacgcgcgcagcggctggtgtaacagaaccagatcgactgcaccagcgccgtcagcaaaaaccagccctgactggggtggaaggctatcggcatatgcagactgagcagccccaggcctaccaccgcgatcggcaggcactcccaccaggcgcgaggcgggcgcactttcatcatcacccatgcggtcagcgggacgaacatcatcgacaggctcatgataaacgccccttcgccgagcgacgccgtcgtggagaccgaatagatccacaggcagaggttgagcgcaaaccagagtccgctgatgatgagttttggccagtgctgcttttgcgggcgaaaaccgcggcagaacggcagcagaagcagcgcggcgaagaaaaaacgcagcccaagaaacgcgaacaccggcatgccggcgatcgcctcgcgggaaaatatccagccgcaggcggcaatcaccgtcgcggcaatcagcagcaggtcagcctgccgttggcgtaccatacgcgcctctccctgtgtgttggcttaccagccaggcaccgcgccgccgttgaagatagtctctgccgccttcgccacctccggcgactggtacgactgcataaactccttcacgttttccgcgtctttattgtcttctcgggtcacgatgatgttcacgtagggcgagtttttatcttcgataaagatgccgtcacgaaccggcgacagcccggtttgctgcaggtaggtggtgctgatgatagccacgtcgactttgggatcgtcgagtacgcgcggcagttgcgccccttccagctccatgatcttcaggttatgcgggttgtcggtgatatccaccgccgtcggcagcaggccggtcccggctttgagggtaatcagcttctctttttgcagcagcagtagcgcccgcccgaggttggtcgggtcgttgggaatagcgatcgtcgcgccgtctttcagttcggcgactgacttgatcttgcgcgaatagccggccatcgggaagacgaaggtattcccgaccgccaccagatgatagttatgcgctttgttgtcctgctcaaggaaaggccgatgctggaagacgttggcgtccagatccccggcgttggtcgactcgttgggcagcagcgagccgctgaaccccaccagctcgacctccagaccgtacttctctttggccaccttcttcgccacttccgctacatcctgctcggcgccgttaatcacaccgaccttaatgtgcttcgcttcattacccttttggtcgcagccgaccagcgccagacccgccagcattaccgcggcggcggcccgtaaacgtaatctcatcctcttcaccctgtctgtcctgaatgtcattgtttttttcgtacaaaactatagcgactttcgggtcgggtaataaacagcaaaccacgcaactggaaataaaatcatcttcgcgaaacgcgaggcgctagccccggcgccactcgcccggcgtcacgccatagcgcattttgaagcgcttcgagaaggacgccagcgactgaaagccgcagcgttcggcaatgacctcgaggttggtctgacgctccaggcgcagcagccgggcggccagcgccattcgcagctgcgacagccacgcctgcggcgtcaggtgataaacgcgggcaaaatgacgggcgaaggtggcccgcgacagaaaggcacgggcggccatactctccagcgtccacggttgctccggggtcgccatcaccgccagcaccgccggcatcaggcgttcatcgctcatcaggcgcagcagcccgccgggcggctgttgctcgccaagcagcatgcgcagcaggagcaccagcagcgtatcgccgaggctgcgcacgatagcgctgccgccgggacgctgcgccaggctctcgcgcaccagtatattaagcagcgcgtccagctccgggcagtcttcacgcgcatcggtatggagatggatcagcgtcgatgcttcactgaacagccagctgacgtgcggaccaaaatagaattcgccgcacagcatctccagcgccccctccgccgggccggcgcgcatttccgtcaccgtgccgttaaaccggtgcgccaccggcagcacctggccccactccaccaggctctccatcaggtgcggcgaaccgtggggcaggaggacgacatctcccgcgcgcaggtgatgggtctggccgccgacgttgagccgcccctcgccgcgcagcaccacgtgccagggcaccacgccgctgcgcatttgctggtgcccggcctgccagcggccgccgaagcgacagtgcaggttcacttcgcagcgcggcgccagcagcgccagcagatgactgagactgtccatgcttctcctgagacgataagacaaaaaggtgagacgaagaccgccagtctagcatgcggcaagcgcctaagatgaccccattgccaacacaccctcgataacaacaggagttaaccatgagccgtttagcagatatccgtgaacaagacgccaccggcaaagccgccgatattttcgccgggatcaaaaaagcgatgggcaaagtgccgaacgcctacctgaccatcggcggccactcgccggcggcgctgcagcaggcgctggcgcacaatgcgatgctccataaaggcagcctcagcgcccaacagctggaagcgattaacctgtcggtcagcgaagccaccggctgtgactactgtctggccgcgcataccctgatggcgaaaaaagccggcttcagcagcgaacaaatccatgccctgcgccgcggggagtatgcggaagaggcgcagcttgatgcgctggtgaaattcgcgcagaccctggtgaccaccaccggtacgctgccggaagccgacgtcgccgcgctgcgcaacgccggttttagcgaccagcaggtgattgagattatcagcgccatcagcgccatcctgttcaccaacatggtgaaccgggttaacgacacggtggtcgacttcccgaaagccgattaatccgtcgcgcagcgccggttttacagccccagatcgctgagccccggatgatcgtccgggcggcgcccctggggccagtggaacaggcgctcgctttcggcgatcggcagatcgttgatgcaggcgtagcgcgtctgcatcaatccgtgcttatcaaactcccagttctcattgccatacgagcgaaaccagttgccgctgtcgtcgcaccactcgtaggcgaagcgcacggcaatgcgattctcctgccatgcccacagctccttaatcagccggtattgctgctccttgcgccattttcgctgcaggaactcaacaatttgcccccgaccgtggacaaattcgctgcggttgcgccattcgctatccacggtgtaggccagggcgactttttccgcatcgcggctgttccagccatcttccgcggcgcggaccttctggatagcgctgtcgcgggtaaacggcggtaacgggggacgttgttcggtcatgcttactctcctctacgggctaattgctgctgcaggcgctgattctcctgctccaggtcatgaatacgttgctgcaggttctggctgtactccgccacctgctgcgcgctgtagcgcggcgtaatgtgctgcgggcagttccagtcaaacgcctgcaaatgaaaaagaaacagacgttcaatgcgggcgcgatagttggccggcgccacctgcgccagcagctgcgggtggtcctctgccgccaggacctcgacggcggcgtagattttcagcctggcacggcgcggataatccatcaaaaacaggcaggcccggtcgctgccgcgcagattgccggtagtaatgtactggcggttaccgccgaaatcggccatcgccagggtggtgtcatccagcagatgcagaaaccccggcgggccgccgcgatgctgaatgtagggccagccgctctgcgacaccgtcgccagataaaagctgtcgcgggtggcgatcatccccgcttcgctgtcgccgaagcggtcggcctggcggcgactgcgcggcgtttgccacagcgagtcgctgcccatttcatgctgcacatccatcacgtccggggtgatagcgatatcgagaaaggttgctgccatagcgcctcctgttgtctggcgccatcatggactgtactgtgaagaatgataatacgggtaaagtggcaatcatctttccgaaaaacgggagaataatggatcgattaagcgcgatggcgctgctggtgaaagtgaccgagctggggagcatgtcggcggcagcgcgggcgctgaatatgccgttgaccaccgtcagccgccatattggcgaactggagagcgcgctgggcgtacgcctgctggcgcgaaccacccgcaaactgacgctcaccgacgccggggtcgattatgttgccgccgcccggcggatccttgaggaggtggaaaacgccgaacgccaggcgacgggcgaatatcaggagccaaagggtgagctggtgatctccgcgccgacgatgtttggacgccagcacgttcttccggtaatcagtgaatttatcgcccgctacccgctaattcgcgtccgtttgctgctcagcgatcgcaatgccgacctggtgagcgaccatgtcgatctggcggtgcggattggcgacctggcggacagcagcatggtggccacccgcctcggcaccatgcggattgtggcctgcgcccatccggcgctgctggcgaaatacggcgagccgcagcggccgcgcgatctggcggcgctgccgatcatccgcattgaatcgccgatgccctatcgcggctggcgctttcgcgccgctgagcgcgaggaccagctgattaacctgccgccggtgctatccgtcaccacgccggagagcgccgccgatgccgcgcggctgggggtgggggtggcccgcttactgcattatcaggcgctggatggcctgcgccacggggagctccgtctgctgctggaaaacgtcgagccggatccggcgccggtccatttgctgtataccgctcgggatctggcgccgcttaagctgcgcaaatttatcgattttgccgcaccggcgctgcgtcaggcactgttgcgcatcgccggggccgcttaatgcgtcgcggtcttcagcggcgcctcctttaacagccatgagaggacaaacgccaccgccataatgccggccgccatcagaaacgccgcgtggatcgccgcgccgaaggcgtcgaggtagtcgaggcggatatccgcgggcaggtgctggaccgccaccggattcattcccggcggcagcaccgcgccttccggcagcagttgttgcagtttgctctgcagcacatgcgtgaacaccgcgccaaacagcgccacgccgatggagccgccaatcgagcggaacagggtcacgccggaggtggcgacgccgtacatctgcgccggcatcgcattctgcaccgccaggaccagcacctgcatcaccagccccagacccgctcccagcacgccggtaaacaggtacagctgccacagcggcgagtgaatggtgatgcgggtcagcagtaccatgccggtcacgccgagcagggtgccgaggatcggaaacaggcgatatttaccggtacggctgataatccgcccgctgataatcgaggtcagcagcaggccgcccatcagcgggattaactgtaacccggcctcggtgggcgtcgcctccttcaccacctgcagatagagcggcaggaaggtgactgacccgaacagcgacatgccgatgacgaagccgatcaggctgcacagcaggaagctgcggttgcggaacagcgccagcggaataatcggctcggcggccatccgttcttcgtaaataaagccgatgatccccacgatgccgaaggccagaatgcaccacagctgcgggtcattccacgcatggacgctgcccccttccgaggtaaacaggatgatgcacagcagcgccatgctgagataaatcgcccccagccagtcaatctgatgctggctgcgtttattgctgctgtggaataccgcgccgatcaccagcagcgcgaacaggccgagcggcaggttgatatagaagatccagcgccaggaggcgtgctgcaccagaaaaccgccgatcagcgggccgatcaccgtcgccaggccgaaaacgccgccgaacagcccctgatagcggccgcggttggcgggcgggatgacgtcggcgaccgccgccatgctgatcaccatcaggccgccgccgccgagcccctgcaggccgcgcatcagcaccagttgggtcatattctgcgccagcccgcagagcgcggagccgacgagaaacagcccaatcgccacctgcagcacgattttgcggccgaacagatcgccaaatttaccgtacagcggcaccgcgatggtggagctgaggatataggcggtgaccacccaggaaagcttgtccagcccgcccagttcgccgacaatcgtcggcagcgcggtggagacaatggtctgatccagcgctgaaagcagcatcaccagcagcaatgcgctgaacaggaggcgtatcgactgcaccggtgggttagcgacttgagaagtcattacaacgctcgcttgaaattaattaaatgcataattaatatttagtgaaagaatgagtcgggtcaagagatcgccatatcatgacagcacaaaaggatcaggatgctccccgccgcccgggtcggccgcgcggtaaaaaaccgggtaccgccaaccgcgaacagttgatggacatcgccctgacgctgtttgcccgcgacggggcgggccgcgtatcgttgaacgccatcgccaaagaggccggggtgacgccggcgatgctgcattactacttcagctcgcgggatgcgctggtgactcagctgattgaggagcgctttatgccgctgcgcaatcacatcagccgcatctttgtcgatcatccacaggacccggtactggcgctgacgatgatggtcgagacgctggcgcatatggcggagaaaaacgcctggttcgcgccgctgtggatgcaggagatcatcggcgaaatgccgattctgcgccagcatatggatgcccgcttcggcgaggagcgttttcaggtgatgctggggacggtgcgtcgctggcagcaggaaggcaagatcaatccggcgctggcgccggagctgctgtttaccacggtaattagcctggtgctggtgccattttcacgcatccacagcgatccgcgtttacaggcggtcaaccgtcagaccatcgtcagccacgcgctggcgttaatgggccacggcgttggaggttaaggcgtggttttgacgcttttgtagtccggataagacaccacgcgccgccatccgggattttccctgctcgcgctacgcttagcagggctacaacttctatgttaattcccggcagattgcgctcccggttgatcttctgcgttatgtctcttatgccgcagggagcgcacagcacgaaccgtaggccgggtaaggcgacagccgccacccggcaagaatacaggtgccgtgcctgatatcctgcccggcggcgttgcgcttgccggtcctgggtggggcgaaactacgggaggactgtgtaggccggataaggcatttatgccgccatccggcacaaccacaggtacggtacctgaccgcccggggataccaggatcgttacagcgccttcgacaaatagtggcgctgcatgcctgcgtgcgggaagtcgggcagcgacatctgcagctgatagcctaatttctgataaaacggcagcgcctggaagctaaaggtatccaccagcagatggctgcagccttgcgcctgcgcctgctgttccgcctcctgcatcagctcgctccccagcccgcgcccgcgcgtcgtctcgctaacccacagatactcaatgcacagccagttgcccttgcgtttggcaatcagcccgccctgcattaccccttgcgcatcgcgcgagtaaatccccagatcgccaaactgcgccgcatcgagatactgctgattatactgccgtagaccggcaaacaattcttgttgatcgtcgggattaatgctttttgtaatgattagtgtcattaactatctccagtatcgcgctgccgaatggttattttccctctccactttcacaaaatattcttattttctccatgattatttgccttaattttttgcgttctaaaagtaagcaaaaaaacctttccattatcgcgacggatcgtataatggggaaaaatgagaatgatcattctcactacaaaaccagaggagatgcgcttttcacctcctgaagaccgaagaggttggcttcagcgaagacacaataacaatcacgttcaggaacatctgtgttccttttttgtcattttcgctcacccgaaaatgcctcagcgcccaacctattccctcgtttttaaataaacggggcggacgtcttatatcttgagaaaatataatgaaatacatcatagctcccatcgcgacagcattatttctccttagcggatgcgataatgcgcagacatctgctccgcagcaacccacgccggaagtgggcgtggtcaccctgcaaagccagccggtgccggtagtcagccagctcaccggccgcaccaccgcctcgctcagcgccgaagttcgcccgcaggtgggcggcatcattcagaaacgcctgtttaccgaaggcgatatggtgaaggccgggcaggccctttaccagatcgatccctccagctatcgcgcgacctggaacgaagcggcggcggcgctgaaacaggcccaggcgctggtggtctccgattgccagaaggcccagcgctacgcgtcgctggtcagggataacggcgtttcccgccaggatgccgacgacgccgcctccacctgcgcccaggacaaggccagtgtggaatcgaagaaagcggcgctggagagcgcgcgcatcaacctgaactggaccaccgtcaccgcgccgattgccgggcgcatcggcatctcgtcggttacgccgggggcgctggtctccgccgatcaggataccgcgctggcgacgatccgcgggctcgacaccatgtatgttgatctgacgcgatccagcgtcgatctcctgcgtttacgcaagcaaagcctggccagcaacagcgacaccctcagcgtgacgttaaccctggaagatggcagtacctatcccgaaaaagggcgtctggcgctcaccgaagtcgccgtcgatgaatctaccggctcggtgaccctgcgcgctatcttccccaacccgcagcacgtcctgctgccggggatgttcgtccgcgcgcgcatcgatgaaggcatcatgaacgacgcgatcctcgccccgcagcaggggatcacccgcgatgccaaaggcgacgccacggcgctggtggtcgatgccgccaacaaagttgagcagcgtaccgtggaaaccggcgacacctacggcgataaatggctggtgctgagcggcctgaaagcgggcgacaaactgattgtcgaaggcaccggtaaagtggccccaggacagacagtgaaggccgtcgccgtcaacaataacggaggcaacgcctgatgttctcccgtttcttcgtgcgtcgcccggtctttgcctgggtgatcgccattctgattatgctcgccggggtgctggcgatccgcacgctgccggtaggccagtacccggacgtcgccccgccggcggtgaaaatctccgccacctataccggggcgtccgccgaaaccctggagaacagcgtcacccaggtgatcgagcagcagctcaccggcctcgaccatctgctctacttcagctccaccagcagctccgacggctcggtcagcatcaccgtcacctttgagcaggggaccgacccggacaccgcccaggtgcaggtacaaaacaaagtgcagcaggcggaatcgcggctgccgagcgaagtccagcagtccggcgtaacggtggaaaaatcgcagagcagctttctgctgatccttgcggtgtatgacaaaaccaaccgcgccaccagctccgatatctccgactggctggtcagcaatatgcaggacccgctggcgcgcgtggagggcgtcggcagcctgcaggtattcggcgccgaatacgcgatgcgcgtctggatggacccgaccaaactcgcctcctactcgctgatgccttccgacgtccagtcggcgattgaggcgcagaacgtgcaggtttccgccggtaaaatcggcgcgctaccgtcgtccaatgcccagcaattaaccgccaccgtgcgcgcgcagtcccggctgcaaacccctgaccagttcaaagcgatcatcgtgaaaagccagggcgacggctcggtagtgcgcctgagcgatgtcgcgcgggtggagatgggtagcgaggattacaccgccaccgccaatctgaacggccacccggccgccgggatcgcggtgatgatggcccccggcgccaacgcgctggacaccgcgacgctggtgaaaagcaaaatcgccgaattccagcgtcagatgccgcagggttacgatattgcctatccgaaggacagcaccgagttcatcaaaatctcggtcgaggacgtgattcagaccctgttcgaagcgattatcctcgtcgtctgcgtgatgtatctgttcctgcagaacttccgcgcgacgctcattccggcggtggcggtgccggtggtgctgcttggcaccttcggcgtgctggccctgttcggctactcgattaacaccctgacgctgttcgccatggtgctggcgatcggcctgctggtggatgacgccatcgtggtggtggagaacgtcgagcgcattatgcgcgacgaagggctccccgctcgcgaagccaccgaaaaatcgatgggcgaaatctccggcgcgctggtggcgattgccctggtgctgtcggcggtgttcctgccgatggccttcttcggcggttcgaccggggtcatctatcgccagttctcggtaaccattatctcggcgatgatgctgtcggtggtggtagcgctgaccctcaccccggcgctgtgcggcgcgctgctcagccactccaaaccgcacaccaaagggtttttcggcgcctttaaccgcctgtgggggcgcacggaggcaggctaccagcgccgggtgctcggcggcctgcgccggggcgcagtgatgatgggcgcttacgcgctgatttgcggggcgatggcgctggcgatgtggaagctgccgggcagcttcctgccggtggaggaccagggggagatcatggtccagtacaccctgcccgccggggcgacggcggtgcgtaccgccgaggtgcgccgccaggtcaccgactggttcctcaccaaagagaaagccaataccgatgtcattttcaccgtcgacggcttcagctttagcggcagcgggcagaacgccgggatggccttcgtgtcgctgaaaaactgggcgcagcgcaaaggggacgacaacaccgcccaggccattgccctgcgcgccaccaaagagctggggacgatccgcgacgccaccctcttcgccatgaccccgccgtcggtggacggcctcggacagagcaacggcttcaccttcgagctgatggccagcggcggtaccgaccgcgacagcctgatgaagctgcgcagccagctgctggcggcggccaaccagagcagcgagctgcagtcggtgcgcgctaacgatctgccgcagatgccgcagctgcaggtggatatcgataacaacaaagccgtctcgctggggctgtcgctgagcgacgtgaccgatacgctctccagcgcctggggcggtacctacgtgaatgactttatcgatcgcggccgggtgaaaaaggtctatatccagggcgaaagcgacgcgcgcgcggtgccgtcggaccttggcaaatggttcgttcgcggcagcgataacagcatgacgccgttctccgccttcgccaccacccactggcaatacggcccggaaagcctggtgcgctacaacggctccgccgcctttgagatccagggcgaaaacgccgccggcttcagctccggcgcggcgatgaacaagatggaaaagctggccgacagcctgccggcgggctccacctgggcgtggagcggcatttcgctgcaggaaaagctggccagcggccaggcgatgagcctgtacgccatctcgattctggtggtgttcctgtgcctggcggcgctgtatgagagctggtcggtgccgttctcggtgatcatggtcatcccgctcggcctgcttggcgcggcgctggcggcgacgctgcgcggcttaagcaacgacgtctacttccaggtggcgctgctgaccaccatcggcctgtcgtcgaaaaacgccatcctgatcgtggagttcgctgaatccgccgtggatgaggggtattcgctctcccgggcggcgatccgcgccgcgcagactcgcctgcgcccgattgtcatgacctcgctggcgtttatcgccggggtgctgccgctggccatcgccaccggcgccggagccaacagccgcgtggcgatcggcaccgggattatcggcggcaccctgacggccaccctgctggcggtgttcttcgtaccgctgttcttcgtgctggtgaagcgtctcttcacccgccaacgtccttctcaggagtaaggtatgtttcgtgtaagttttatgtttatcgcgctcctgaccgcgggctgcgtctcgcttgacccgcattatgatcgcccggccgcgccggtgccggccaccctgcccggggcgcacggcgaatcgacggcggtggtcggcgactggcagaaagtggtcaatgatgcgcggttaaaaaaagtggtcagcatcgcgctgaacagcaaccgcgatgtgcaaaaggcattggccgatattgaagccgctcgcgcccagtatggcgaaacgcgggcatcgctgtttcccaccgttgatgccgaactgagccacacccgcagcaaaacggtggccagtggcctgagctccgcttcacaggccgacggcgcggtctccagcttcgaactggacttgttcggcaagaaccagagcctgtcgcgcgcggcgcgcgaaacctggcttgccagcgaattcaccgcgcagaatacccggctgacgatgattgccgatttgaccaccgcctgggtgacgctggcgacggataacagcaatctggcgctggcgcagcagaccatggacagcgcggcaaactcgcgcaacatcgtcgcccgccagatggcggttggcaccgcctccgcgggtgatttaagctcggcggaaagcgtctatcagcaggcgcgcgccagcgtcgccagctatcgcacgctggtggcgcaggataaaaacgccattaacctgctggcgggggaaaccgtgccggagagcctgctgcccggcactctcgagagtctcggggataacagcatcgcgctggtgccggcgggcgtgtcgtcgtcggtgctgctgcgtcggccggacattcaggaagcggagcacaatctgaagagcgccaatgccgatatcggcgcggcgcgggcgaacttcttcccgtcgatttccctgaccgccagcgccggggtcggcagcgactcgctgtcgtcgctattcagccacgggatgcaggtgtggtcgttcgccccctccatcagcctgccgctgttcaccggcggcagcaacctggcgcagctgcgctatgcggaagcggagaaaaaggggctgatcgccacctacgagaaatcgattcagagcgcgtttaaggacgttgccgatgcgctggcgcgccgggaaacgctgagcgaagagcttgatgctcagcggcagtatgtcgccgccgagcagacatcgctggatatcgccatgaagagctatcaggccggggtcggcgattatctgtcggtgctcaccgctcagcgcacgctgtggtcggcgaaaacgacgctgctgtccctgcagcagaccgacctcaataaccggatcaccctctggcagtcgctgggcggcggcgccagttaaacttacccgccgggcgaccgagcccggcctctacaaggaatcgttatggcacgtgtttccctctcctgggcgctgatcctcggcctgctgtcgggtatcggcccgctgtgcacggatttttatctaccggcgctgccggagatcactcagcagctgcaggccaccagcactcagacccagctgtcgctgaccgccgcgctgattggtctcggcctgggtcagctgtttttcggcccgctgagcgaccgcattggccgcctgaaaccgctggcgctgtctctgctgctgtttatcttctcttcggcaatgtgcgccctgacccgcgatatcaacatgctgattgtctggcgctttttacaaggcttcgccggcgccggcggctcggtgctgtcgcgatccatcgcccgcgataaataccagggcaccctgctgacccagtttttcgccctgctgatgaccgtgaacggcattgcgccggtgctgtccccggtgctgggcggctacgttatcaccgccttcgactggcgaattctcttctggacgatggccgccattggcggcgtgctgctggtgatgagcctggcgatcctgcgggaaacgcgcccggccacagcggcgcatgccagccgccaacggcccggccagccggtgctgaaaaatcgccgctttctgcgcttctgcctgatccaggcctttatgatggccgggctgttctcctacatcggctcttcttccttcgtgctgcagagcgaatacggcatgagcgccatgcagttcagtctgctgttcggtctgaacggtatcgggctgatcatcgccgcgatgatcttttcccgtctggcgcgccgctttagcgccgaaagcctgctgcgcggcggcctgacgctggccgtgagctgtgcggcgatcatgctgctgtttgcctggctgcatctgccggtgctggcgctggtcggcctgttctttaccgtgtcgctgatgagcggcatcagcaccgtcgccggcgcggaggcgatgagcgccgtcgacgccgcgcagtccgggaccgcgtccgcgctgatgggcaccctgatgtttgtcttcggcggcatcgccgcgccgctggcgggtctcggcggcgaaacaatgctgaaaatgagcctcgcaatggccatctgctacctgctggcgctgctgctgggcctcagcaaaccgcgcgacgcacgctaatctcctgctgcggtaataaaatattccagatttattaccgcactatttcccgccatatctaccattctcgtattattttccgcgtactaatcgtgatactcttcacaggaaaggaataaataattccttatactgcgcgccactgagaataacgaggtttctatgagtatcgacctgagcaaactgctgaccgagcgacgtaacgccaacagcgccaacattgacaccctctccaccctcgagatgctgacggtgataaaccaggaagaccagcaggtagcccaggcgataacgccctatctgccgcagattgccgaggtggtggataaggtcgcggcggcgctgcaggccggtggccgcttgatttacattggcgcgggtacctcagggcgtctggggatcctcgatgccagcgaatgcccgccaaccttcggcacccgcccggagcaggtggtggggatcatcgccggcggacataaagcgattctcagcgccgtggaaaacgtggaagacaacaaagcgcagggggcgatggatctgcagaacctgaacttcagcaaccgcgatgtgctggtgggactggcggccagcggacgcacgccgtacgtcattggcgccatggaatacgcccatagtcagaatgcctttgtcgccatcgtcagctgtaacccgcatggcgaaatggcccagctggcggacgtggcgatcaccccggtagtcggcccggaagtggtcactggctctacccgcctgaaagccggcaccgcgcagaagctggtgctgaacatgatctccaccggggcgatgatccgcgtcggcaaggtgtacagcaacctgatggtcgacgttgaagcgaccaacgccaagctgattgagcgccaggtctctatcgtgatggaggccaccgactgcgatcgcgccaccgcccagaaggcgctggaggcctgcggccgccactgtaaaacggcgatcgtgatggtgctggcggacttaagcgccgcagaggcgcagtcgctgctggcgaaaaacaacggctatatccgcaaggcgctcagcaacacctgagcgccgacagacaggtaacgggcaatggcaaaaataacgaaagagatgatagcgcggatcctcgcccacgtgggcggcgccgcaaacgtcgcgcaggcgggcaactgcatgacgcgcctgcgcttgaccctgcgcgatgaaagtctggccgacagcgccgccatccgccagattgacggcgtgatgggggtgatcgtcagcgacgagcagttccaggtggtgctcggccccggcaaggcgcaaaccgccgccgaaatgatgaacggcctgctggaggcggcgcccgccgccgcgccgacgctggccgacgtcgcggcggagaaaaagcaggcgctgaagggcaggcagaccagcgcggtgcagaagtttctcgccaaattcgccactatctttacgccgctgatccccggctttatcgccgtcgggctgctgctgggcttcgccaccctggcggaacaggttttcgtgctggagaacgcccatccgaacgccagcctggtggcgctgattggctatatgaaggtcttcagcaaagggatgttcacctttctgagtatcctgattggctataacgcgcagaaggcgttcggcggctccggcgtgaacggcgcgattatcgcctcgctgttcgtgctgggctacaacccggaggcaactagcggcttctacgccggcatttccaccttcttcggccatggcatcgatccgcgcggcaatatcatcggcgtactgatcgccgctatccttggcgcgtgggttgaacgccaggtgcggcgggtgatgccggccaacctcgatatgatcctcacttcggcggtgacgctgctgatcatgggcgcggtgacctttacggtgatcatgccgattggcggctggttgtttaccggcatgtcgtggctgttcctgcatcttaacggcaacccgtttggctcggcggtgctggccggcctgttcctgctggcggtgatgttcggcgtccatcaggggtttgtcccggtctattttgcgctggtggacgcccagggctttaactcgctgttcccgatcctggcgatggccggggccgggcaggtgggggcggcgctggcgctgttctggcgggcgaagcgcgattcgctgctgcgaacccagattaaaggggcgattattccgggcttcctcgggattggcgagccgctgatctacggcgtcaccctgccgcggatgaagccgtttgtcaccgcctgcctcggcggcgcctgcggcgggttcttcgtcggactgatcgcctggctggggctgccggtcggcctgaacacggtgttcggtccgtccggtctggtggcgctgccgctgatgacctccggcagcggaatttacgccgggatggcggtctacgccggcgggctggcggtctcctacctgtgcggttttgtcctcacctggctgttcggcagtaaaaatgtcgatttaagctagaacgcgactatcggttaatgcccggcggcggcttcgccttaccgggcctgcaaaatagttacgccgccgcgcccgactaccatttcctgccccgccgcccgggcgcgcgcatgctatgattcccctttgtcatatttcgcttgaggaaaagatgggctccagcaaaaaagggatgctgaacgtactgattgccgccgtgctgtggggcagttccggggtgtgtgcgcaatttattatgcaggaaagccagatgtcgtcgccgtttctgaccatgacgcgtctgctgttcgccgggctgatcctgctgatgctcggctttgttcacggcgaccgcattttccgcgtgctgcaaaaccgccgcgacgccctaagcctgctgtttttctcgctgtttggcgcgctaaccgtgcagttcacctttctgatgaccattgaaaaatccaatgccgccacggccacggtgctgcagtttctgtcgccgacgatcatcgtcgcctggttcgccctcgcccgcaaagcgcgtcccactccgctggtgctgggggctatctgcacctcgctggcgggcacctttctgctggtgacccacggcaacccaacgacgctgtcgatttcgccggcggcgctgttctgggggatcgcctcggcgtttgccgccgccttttataccacctatccttcaacgctgattgcccgctacgggacgctgcccatcgtcggctggagcatgctgttcggcggcgcgatgctattgccgttttacggcggccagggcaccgattttgtggttaacggcagcctgctgttagcttttttctacctggtggtgatcggtacttcgctgaccttcagcctctatctcaacggcgcgcagaagattggcggcgcaaaggccgggatcctcagctgcgccgaaccgctgagcagcgccctgctgtcgctcctgctgctggggatcaccttcacgctgccggactggctgggcactctgctgatcctcgcgtcggtggtgctgatcgccatcgactcgcggcggcgggtgagagccgcctgagcaggcgataaaaattgcattttcaataagttaaactgaccactatttgcgtgttttcccgcctgcgcatatagttgacggaagcgattacggaaggagaagcctgatgaaagcatgttggatggtatgcctggtcaccgccctgagcgccacgtcggcgtgggccgaatcaccgctgcaaagcctgcagttcgagcagcaaaaacagcaggtgctcaaagcggtgaaggaaaaatgcgcgccagcaagccacctcagcgacaacgattttgccaataaagtgctggcgaccgacggtaacaagaacgcggtccgcgaagcaacgctggcgaaggagcgcaataaccagaaaagctaccaggccgcaatcgacaaaatcgtctgtccggccaaatagcggttatttcagcctcgcgaccagcgttttccagtcaaacggcgtcagctgcctgtagctcaggctacgggcggccatctgctccggcagctggcgctggcttttcgcgatcgcctcgctcattatcccggcgctccccacgtcacgcagggttttcaccacctcttccatctcttcgctgcgccgaatgccatgttccgccacccggctgatcagatagtcggggaacgcgcctgtccagcccagagagggaaaactatgatgcaaggagctaagcacctcctcctcaacgccgtattcacgagccgcgaacaggcattctgtggtaagcgcttcaagacctttgatcatcacgctacggcacatttttatcgccgacacctggcccaccgtactggcgccatagcgggcattcagccccagcccccgcagacgcggcgcgatcgcctccgcctgcggcccgccgatcaataacggtgtctgcaatcgggccggcggtaccggcgccatcaccgcgacatcgatgtaggcgcccggcagaaaatgttcagccgcctgccgtttcgtctccggcgccacggagttgagatcgaggaaatattgtcccggctgcagcagcgcggccgcctgctgcgccacctttagcgcctcaccggcggtcacagtagaaaaaaccagcgtggccccctccagcgcctgcgccagcgaatttcccacctgaacgcgcgaatcacgggcttttttgcccatcgcctctcgctccgggccattgagcttgcaatcccaaatggtcaccgcatgctcacgggccagatccgccgccagaatgccacccgcctcgccaaaaccaataaacgcgattgtcatcatcactcctcacgcggccagacgcgggccggaataaaaacctcgccagcaaacagcagtcgcgccgtgcgtaacaggccgcagccagccagggcgccgtcagcatcaagctgaagcgtcacgctaaattcgcctgtcggatgctcgacgctgagcagcggcgtatcgcctggcgctacctgcgccaggccctgcgcgacagagccggggagcagacaagcgctggccacgctcaccgcgccaaatacgccgatcgacgcgtggcagcggtgggggataaaggtgcggctgctgatggcgccgccgtgtcgcggctcggcgatcagggtcatcttgggcaccgtgcgctggctgacgtcgccaagctgcatcagcggcccggcctgcaggcgaatcgactccaggcgacgtttaagcgcgtcgtcattatccagctgttcgcgcgtctcatagccggtgcaaccgaggtcgcacgcgcgcagcaggatcaccggcattccgttatcgatgcaggtcacctcgacgccgtcaaaacggtcacgaacccggccggtcggcagcagcgccccgcagctggagccggcgacatcaagaaaatggagcaggatcgggctggcgctgcccggcacgccatcgatacggctctcgccgacgtagttgaccccgtcggcgtcacaggggatctctgccaccgccagttgccccgtgttctccataaaaatacgcacccgagtgagcggcgcatcgtggcgaaccagaccgcgctcgatggcgaaagggccaacggcggcaagaatattgccgcagttttggccataatccacggtagccgccgccacgttcacctgggcaaatagatagtccacatcggcgtcaggtcgtgcggagcggcggataatcgccactttgctggtcagcggatcggcgccgccgatcccgtcaatttgccggggatcaggcgagcccatcaccgccagcagcaccgcatcacgtcgcaccggatcggcaggcagatcgtcggccagaaaacaggccgctttagaggtgccgccgcgcatccatagacaggggattccgcgttgcgccatttattcctccacctcgtctgcgcggtcgtaataccgcaggcccttttccgccagacgcggacgcatagcgtaaatatccagccccaactcgccattgcgcatccgctcacgtttcgcaagctcattgctcatgcgggcttccgctttatggagcacatcacggacccgggcgtgaggcagcaccacgacgccatcgtcgtcggccactacgacatcgcccggctgtacaagctgacctgcgcatatcaccgggacgttaaccgaaccgaggctctctttcaccgtcccctgggcataaacctgacgggaccagacggcgaatcccatttcccgcaacgtttgcgaatcacgaatgccgatatcgcccaccagcccgaccacgccgcgcgattggagagacgtcgccagtagatcgccgaagaagccatcgccgcacggcgaggtcggggccaccaccagaatatcgccggcgcggcactgctcgaccgccacatgaaacatccagttgtcgccaggcgtcaccagcacggttaccgcgttgcccgcccggctgacgccctgctgaatcggacggattgccggccccatcagcccctgacgatcccaggcttcatggagcgtcgccaccccggccgcctcacagcggcgcaaaaccgcctcgtcatggcgcggcaggtggcggatcacaaggccttttttatttaacaggttcatgccaggttctccgttacgcgggggaagatgctctggaaggcttcgccgtgaacgatatcgcgcgcggccgtgatgccgatattgcgcttggcctgcaccccgcgctgcagcgccacgcgggtgtagtattcccacagatgctcctgaccctgcatgcactgaatggcctgatactttttctcccagacagcggtgatgtccagcaacacatcgggtttccagttgcactgctccggctggtgcggttcgaaacagtaaaccgggggagcagcgacaattttctcaccggggcgatagccctctgcctgggcgataatccgcgcttcctgcgccagatgggaggccagggggtgatcgtagttatagggatcctgcagggagtgcgtcaggacaaagtggggctggatacggcgatacacatccgccagacgaaatagcgtctctttatcggcgcgcagcggatagtcgccgatatcaaagaattcgacgctggcgcccaggatcgcggcggcggcctgcgcctcttcgcgacgcacctgcttcaccgcctcctcggtcatgttgcctttacgccacagtttggcggactcgccgcgctcgccaaaggataaacagaccacatggacctgatagccctgcagggcatgcagcgctatcgcaccgcccgcgcgccagacgaaatcggccgagtgggcgctgacgacaagggcacttttttcgctaaccggatgagacatgatggcttcctctgttgtttttttcagcttgtcatgtcccgtcgtggggaggtaattcgttaacttgcgaaggctatgatttttatttatgttgtcgtctcactcactttttcaggcctgacgaacaatgctaaagagaaagcacgataaaattataaatatcatgcagctgcgctttttctgtcaggtcgcgctgcgcggtagcgtctcacgcgcggccgatgacttattccgcacgcagtcagcgataacccgggctattcgcgatcttgaagccgcgttgaacgtcacgctgttcgaacgccattacagcggcatggtgcccaccgagtatggcaagtgcatcctgccgcgcgcccggcgggcgattgacgacctgcaggccatcccggcgctgctgcagaagcaccatacccgcagcagcggcccgctggcggacgccggctggctgttcaatacccgccgcttagccatttttattcagctctatcacgtcaaccatacccaaaccgtcgcgcaacagttggggatcactcagccggcggtcagtgccgcgctgaaggtcctggaaaaaggagcggattcggcgctatttcgccggacgccagagggggtgcgtcccacgcctgccgcggagctactctatcccccggtgagcagagcgctcaacgagctggaaaacatctggagcgatctcgctgcccgtcgcggggtgctggagggcaccgtgcgcattggcgccctgccgctgagccggacccggctactgccctccgccatcgccgcctttctggcccagcacccgggcatcaccctcatgaccaatgaaagcccgtatgagtcgctggtcgccgatatgcgggcaggtaatatcgattttattatcggcgccctgcgccaggatgaagatctcccggacctctgtagcgaagcgttattcgaagaggatatgttgattttactgcgtaataaccacccgctgcttcgccatccggacccacgcagccagctggcgacagcgcaatgggtgctgccgcgcgccaacgcgccggcgcgcaatttgctggataaggcgtttgtcaccctggggctgccgctgccccagccgacggtggagaccggggatgcggcgatggtgcgaggattgctgcagggctccgacatgctggcggcggtctccgccagccagatgcgttttgaaactgacaatgggctgcttagcgtgttgccggttcccctgcccgataccacccggcgtatcgggctgacgtttcgcgccggcagcctgccctccccggcgacgcaggcgctgttgcgttttatttatcagcaggttcaggacggggccgtttaacgtttacccgccaccgaataggttacctgctggttgcgcgtttgctgaaacgcctccagcgtctgcccgcgcatcgcggcgtaaatatgcaggttggatacgccgaccaccgcgcccattttctccagcaggaagaagctggcgccatactgaattaatccccgccagtcgcgcgcgttgagcaactgctgttcctcctcactcagtccggcttcggcataaagcgactgaggcgactgcagaaaacgttcacgccaggcaggctcaatcagccgatgcaggaaacggttaagccgcaagccattcaggctgcgctcgtgggtaaaaggataggttcccggcagtttctccaccccggccagctgctgcgccatatgctggcgatggcgcgtcagggtatcgacggggggcaggcgcgcattgttctcaaggatcagcgtggcgataccggtcatcgagggcaggtaatagtcgcgccaggtttcggtgacattggctgatagcgcgccgcgcatcaccagccacatgattacttcggacccctccatcccccccagctcggcatattcgccaagggtcatttcggtaagcttttccgggtcattaaccagcatatcaacaaactgggcatcccagtcgggattattaaatccgcagcgctcgccatgaacctgatgcgagagcccgccggtcgcgacaatcgccacattgatatcttccgggaagctttcaatcgcccggcgcagcgcctggccgagtttgtaacaacggcgcgcgcttggtaccggaaattgcagcacgccgatctgtaacgggatcaccgccgtcggccacccctgcgcttcatcccagggcaacagcgccgaaagcggcgagaaaaggccgtggtcgagctttttatccataaagaacgacatatcaaactcgtcggccatcaggctggcgccaatgtgccttgagagcgccgcgttgccctggaccggcggcaggcagcgcggtccgcctccctcatcggcaacgtcatattgactatcgattcccagcgtaaaagtcgaatagtgatcgaagaaaaaggcggtcacatggtcattaaagatgtataccagcgcatccggttttttctcctccagccagcgctgcagcggttcgaagctctggaagatcggcgcccacgccggatcctgctgtttatgatgatcgaccgcgaagccgatagtcggggtatgagagacggcgataccgccgagaatgttagccatcagataactccacttatcggtgttcgaggggggatgacaaagcgtcaagttctgcctctgtgagtcgaggcttagcgtgattcatacggtgcaacaaaatacagatccccgccaggcaggccggcagcgcaagcaccaaaaagatcgacgagtgtcccggcacggccagcatcagcatcccgcccagcgtggagctgaggatagccccggtacggccgataccatgcatccagctgacgccggtagcgcggatctcggtttgataataggcgggcgaataggcctgcagaccgttctgcgcgccgttaatgcacatcccgctgataaaaatcagcaccgacagcgccgccgaaccgaaatccatcaccccctgggacaacaggcacagacagccgaggaaataggttgccgcaatcacggctttcgccgaagcgcgatccatcagcataccgacaaggatcccgcccagcgggccgccgagctggaacaagccggtcatcatcgccgcctgctgcagcgacagcccgccggagcggagaatggttggcagccagccgttcagcaggtaaatcacgaacagccccataaaataggttaaccacagcgctatcgtgccgcgggcatagccatgccggaacagctgcgccactttgctgctccgcgtgatgggcggcgcattcagctggaaaacggtttcagccgtaaactggcccccaagccggttaagcgccctggcaatctgctcgcccggtagtcggcgcgccaccatgttcatcgccgactccggcaacatcacgatcataaaggggagcaccacgagcggcagcacgccgccaaaaaccagcgccgagtgccagctgtaatgcgataacaaaccggcggcgataaagccgccgaggccggaacccacgttaaaaccgctgtacatcagggtgatcatcacccctttacgccgctccggcatatattccgccaccagcgtgacgcagttgggcattacggcgccaaggccaaggccggtgagaaaacgcatcagcgccagttgcgtcgggctttgcgccacggcgccggccaggctgaacagcgcaaacagcgccaccgaccagagtaaaattcgctttcggccgtagcggtcagaaagcggacccgctaccagggcgccaatggcgacgccgaacatggccgccccaagaatcggccccatttcggcccggctgatgccccagtcttcgatgagcgccggggcgacaaagcccatcaccgcggcgtcatacccatccagcataatgatgatgaaacagagcagcagcacgttccattgaaagcgcgagaccgggcgggtatctatccacgctttcacatcgacaacgttcgtgtgattcatagggtgacttcctcaagcaggcggtacgaatgttctggttagtgttttttgagtggaactttcgtactcaacttaaggcaggtcacgcaggctgtccggttcgaaaatccggcgtcagatatgagttttatttataatgtgagggatacgacaaaaaccagccagcaaaaaacccgcagccaacggcggcgggtcagggcaagagcagcgtttagtgcttcggaataattaaatcgccgcgcagcgggctgccgcccgggttgtccgttttctcggtcagccagttgacgatccgcgacgccatcgcgtccatggaatattcaatcgccgggatagtcgggataccgggcagctgtaacgatccggcgaggctaaacaccatgacattttgcggaacggcgcggttaaacgcctgtagctgcggcaccacgcgctgcgcctgctgttcatcgctcaccagcagcgcgttaaagttcagcgtcgtggcgttattgaccagctcctgcaccgccaccgacggcgaggtgttatccagaaacaccaggttgcgattaaacggcaaaaagtttttttccagcgcgtgcttgtagcccagcagcacctggtcggcaaagccgctgctctgcggatgaatcagcgcaatctgccgtctcccctggctaatcagatagtgacaggcggtttcggcggcgaaagcatgatcgaactgaatactgttgtcgccttcgctatcgaggcagtccaccagcaccacgtccgggcggttaatattcagaggaaaacgcgcgccgatgattagcacgttatcgcacagcccgcaggtcaactcctccagagagttcatcacgccgtggctggtgttggcgaagcgcagcagcaggtgtttctggtgctggctgagctgtttttccagggcgtagagatagctggtggtttggttgatgttgtcctgggcgcagatgacgccgatgcagccggtggactggctgagcaacgactgggctatcatgtttggccggtaattgagcgcttccgccgcctgcagcaccgcctgacgactggcttccttcacgccacgtgagccgctcaacactcgcgacaccgtggctttggaaaccccggcaagtcgtgaaacatcattgattgtcgacatcattttcccctgcgcgggcgccgcgtcccgccaaaatcctgtaaacctgaatcgcttcaattatgaccagcgcagtatatccatttcgccatttgtttggaaaccgattttccatttcagcgcaaaacatcgccaaatcgacagaataatgtgagcgaaatccaataaatccgccctataagcaggagatcttgaccactatcacagttctgctttttataaatggaaaccggtttccgtctgatatcaaatcacccacgcaataactttttacattttgaggatggtcgtcgatgtacaagattatgctgtgctgctctgccgggatgtccaccagtctgctggtcagaaagatggttgaggcggcgaatgaacgtgacctgccggtgcagattgacgcctatggcgtttccgaatttgacatgcagtttccgcagtatcaggtggtgttgcttggcccccaggtgaaatacatgttgaaaaccctgtctgacaaagcggcttccctgaacattcccgttcagcccatcgatacgatggactacggtatgcagcggggagacaacgtcctgaattatgctctgtcgctgatcccagcggcgcactgagaggtgttgaaatgagttctctgtatcagtccatgattgccgtgatcgagcaatctattactccgctggcaggacgccttgggcagcagaaatacgttatcgctatccgcgatggcttcactgccgccttgccgtttatgatcatcggctctttcatgctggtatttatctttccgccgttttcacccgataccaccaacggctttgcccgcggctggcttgatttctcccagcactaccgcgaacagctgatgctgccgtttaacctcagcatgggcgtgatgaccttctttatctcggtcggcattggcgccagcctcggtcgtcagtttcagctcgatccggtgatgtccggtctgctggcgtttatggctttcctgctggtcgccgcaccctatgccgatggcaaaatttccactcagtatctgtccggtcagggcattttcaccgcgctgatcaccgccatctactccacccgcgtttacgcgtggctgaagcaaaacaacattacgattcgtctgccgaaagaggtccccaccggcgtcgcccgttcgtttgaaatcttgatcccggtgctggtggttattgcgactctgcatccgctgaatctgtttatcgaagcgcagaccgggatgatcctgccgcaggcgatcatgcatctgctggagccgctggtttccgcctccgactcgctgccggcgattttgctctctgttctgatgtgccagattttctggttcgccggtatccacggctcgctgattgttaccggcattatgaacccgttctggatggccaacctgtcggcaaaccaggcggcgctggcggctggcacggtactgccgcacgtctacctgcagggcttctgggatcactatctgctgattggcggcgtcggttctaccctgccgctggccttcctgctgctgcgtagccgggccacccatctgcgcaccatcggcaagatgggcatcgtgccgagcttctttaatatcaacgagccgattctgttcggggcgccgatcatcatgaacccgatgatgtttatccccttcgtctgtgtaccgatggtcaacgcggtgctggcttacggcgcgacgcgtcttggctggctgagccaggtggtgtcgctgacgccgtggactacgccggccccaattggcgcgtcgtgggcggctaactggaccctgagcccggtggtgatgtgtctcatctgcatggtgatgtcggcggtcatttatctgccgttcctgcgcgcttatgaacgttccttaatgaaaaccgaagttgagaaagccaaaaatagcgttccggtagcagaaaccgttagctaatccctctccttccggagagataataagatgatagcgtaataatgcagaaaatggactttcactgcattattaaataataaatacctcaggaatacacatgattgaattagaagatgcggtaatggaaattatcgttaatgcgggacagtcacgctcattatgttttgaagcgctgcatgcggcccgaatcggaaatatcgacgaagcgcgcttactcttaaacgaggccgacggctacgcccgccgggcgcatcagatgcaaacccagctcatcgggcaggatgccggtgaagcgcgtcagcccatgacgctgattatggtacatgcccaggatcatttgatgaattcgctgctggcccgcgagttctcagaagaattaatccatctgtaccagcgttaattaatatggaataacgttagcgagaatattattctccggcgtcgctgtaccctaaaaaacaaatcagcttattttggctatttattctagccagaatgggatggttattatctgaaatatattaattattaaagcgagataaccatgaatactgtaaaaaaactgcctttagccatggcggtggtcgccgcgctgtgcccaatttctgtcatggcgcaagaatttacgcaggaacagatcgacgccatcgtcgccaaagccgttgataaagcgctggccgaccgccaggcaaaaatcgacgccgcggccaacaaaaaggtcgacgtgattactaacccggaaaccaccgccgcctcgccggatatggccattccgttcggcctcaagttcagcggctacgcccgctatggcgcccacttccagaccggcgaccagaaatatgtcggcgtcgacggctcctataacggcgcctcggcgatcggccgtctgggcaacgaaagcaacg

SEQ ID NO: 56 - DNA, 359577 bp, Unknown
  source: /note="Description of Unknown: KP2-Mcoc1 Bacteria Sequence"
taggcctgccgccagcgttcaatctgagccatgatcaaactcttcaatttaagtttgatgctcaaagaattaaacttcgtaatgaattacgtgttcactcttgagacttggtattcatttttcgtccgaggacgttaagaatccatgtcactttgagtgcccacacagattgtctgataaattgttaaagagcagttgcgacgcgctttagcgctctgtcgcgaggtggcgtatattacgctttcctctttcagagtcaacccgtttttcaggatttttctctgcaaccgaaccggctgtttgtgtgaagtgattcacatccgccgtgtcgatggaggcgcattatagggagctctccgggaatgacaagcggaaaaatacaattttatttcaaccgctcatcttttaaacgcaacgcttatttttgctgctttttaatcgccgccggcagctctgccaggctatttagcacccaatccgccgctttttccgcttcttcagttaggggtttaccggtgcgcaccagtactttagtcccgacatccgcagccgctgccgcctgcatatcttccagtttgtcccctaccatataagaagcagccatatcgatatgcagataatcgcgggcggaaatcagcatccccggatgcggtttacgacaatcacaggtctgacggtactcctcaaccgcaccctgcgggtgatgcgggcaatagtagataccgtcgaggtcgacgccgcggtctgccagagaccagtccatccattcggtcagcgtttcaaactgggcttcggtaaatttaccgcgggcaataccggactggttagtgaccagcaccagcgcgtagcccatctcttttagttcgcgcatcgcgtcaatgacgccatcgataaattcaaaattgtcgatttcgtggacgtagccatgatcgacattaatagtgccgtcacggtcgagaaaaattgcgggtactgactttgccaccggtttgctcctgaaaaagactagtgccgctagtatcgcatgtttccgcatgcaagaaagtgctcattataaagagtcagattgatttagacgtctggatgccttaacatccatttcattgccaggcatcgcctggatacggcagaagaaaatgccacggcaaacggctaaacgataataaataactgatgattaaactttccaatatcaccaaagtattccagcaggggaatcgcagcattcaggcgctgaataacgtcagcctgcatgtccctgccggacagatttacggcgtcatcggtgcctccggcgccggtaaaagtacgctgattcgctgcgtgaacctgctggagcgcccgaccgagggcagcgtacaggttgacggtcaggaactgactgccctgtcggagaaagagctaacccgcgctcgccgtcaaattggcatgattttccagcattttaacctgttggcctcgcggaccgttttcggcaacgtggcattacccctggagctggataacacgccgcaggctgaaatcaaacgccgtgtcacggagctgctggagcttgtcggcctgggtgataagcacgacagctacccggccaacctctccggcggccagaaacagcgcgtggcgattgcccgcgcgctggccagcaatcctaaagtattgctgtgcgatgaagccaccagcgccctggatccggccactacccgttccattctcgaactgctgaaagacattaaccgtcgcctgggcctgactatcctgttgatcacccatgaaatggacgtggttaaacgtatctgcgactgcgtggcggtcattagtaatggtcaattgatcgagcaggacaccgtgagcgaagtcttctcccatccgaagacgccgctggctcagcagtttattcagtccactctgcacctcgatattccggatgactatcaggcgcgcctgaaacctaccgccacagcggatagcgtaccgatgctgcgcatggaatttaccggccactccgtcgatgcgccgctgctctctgaaaccgcgcgtcgcttcaatgtgaataacaacattatcagcgcgcagatggattatgccggcggggtgaagttcggcatcatgctcaccgaaatgcacggtacacaggaagacactcaggcggccatcgcctggctgcaggaacatcatgtaaaagtagaggtattgggttatgtctgaggcaatgatgtggctgctgttgcgcggcgtatgggaaacgctggcaatgacttttgtctctggcttcttcggttttgtcctcggcctgccggtgggcgtgctgctgtacgttacccgtccggggcaaatcgtcgccaatgccaaactgtaccgtacgctgtcggcgctggtgaatattttccgctccatcccgttcattatcctgctggtctggatgattccgtttacccgcgtgatcgtcggtacctctatcggcctgcaggcagcgattgtgccattaacagttggcgccgcgccgtttatcgcccgcatggtggagaacgccctgctggagatccccaccggccttattgaagcctcccgcgcgatgggcgccacgccgctgcagatcgtgcgcaaagtcctgctacctgaagcattgccgggtctggtcaacgccgccaccatcacgctcatcacgctggtgggttattccgcaatgggcggcgcggtgggcgccggtggcctaggtcagattggttatcagtatggctatattggatataacgccaccgtgatgaataccgtactggtattgctggttgttctggtttatttaattcaattctctggcgatcgcatcgtccgggctgtgactcacaaataacgttattggcagacaacactcattcttacaggaaggaaataacatggcctttaatttcaaaacttttgcggcagttggcgcgttaatcggttctctggcgctggtgggttgcggtcaggatgaaaaagatccgaatcatattaaagtcggcgttatcgtcggggcggaacagcaggtcgctgaagttgcgcagaaagtagcaaaagagaagtatggccttgacgtagaactggtgaccttcaacgattacgttctgccgaacgaagcgctgagcaaaggcgatatcgacgtgaacgccttccagcataaaccgtatctcgatcagcagattaaagaccgcggctataagctggtggctgtcggtaacaccttcgtctacccgatcgcgggttattcgaagaaaatcaaatcgctggacgaactgcagccgggctcacagatcgccgtccctaacgatccgactaacctcggtcgttccctgctgctgctgcagcaggtaggtctgattaaactgaaagacggcgtgggcctgctgccgacctcgctggacatcgtcgagaacccgaaaaacctgaagattgttgaactggaggcgccgcagctgccgcgttccctggacgatgcgcagattgcgctggccgttatcaacaccacttacgccagccagattggcctgaccccggcgaaagacggcatctttgttgaaggtaaagagtctccttacgtgaacctgattgtggcgcgtgaagacaataaagatgctgagaatgtgaaaaaattcgttcaggcttaccagagcgatgaagtttacgaagcagcgaacaagatctttaacggcggtgccgtgaaaggctggtaatcttttctcaccgtaatatcattcaggacgggcttcacgcccgtcttgtcatttatgcaagcacctgattcaataacgccctgttttttattcattgaggaaatactatgcgtgctttaccgatctgtttgttagcactcatgttaagcggttgttccatgctaagcagatctcccgttgagcctgctcaaagcactgcaaccccgccggttaaatctgagccgagcaaaccgcgcgccacccgcccggccccagtacgtatttacaccgatgcgtcagagctggttggtaaaccgttccgcgatctgggtgaagtatctggcgagtcctgccaggcttcgaatcaggattctccgccgaatatccccaccgcgcgcaagcgcctgcaaattaatgccgcgcgtatgaaagccaatgccgtcctgcttcaccgctgcgaagtgaccagcggtacgccaggctgctaccgtcaggccgtttgcctgggttcagcgcttaacgtctcggcgcaatgagcgcatttcagttcgcgcagataggcgtcatccgttcgccgtataaagagaagtttgccgttcctcgccagccaggcctggtgaaacacggcggcggagaactccatctggtcgcgccctataaccaggccgacgccgtgcgtggcctggagagcttcagccatctgtggatcctgtttgtgtttcatcagacaatggaaggcggttggcgtccgacggtgcgacctccccgactgggcggcaatgcgcggatgggcgtcttcgccacccgttcaacgtttcgccctaatcccatcggcatgtcgctcgttgagctcaagggcattcgctgtcagaaagatcaggtaatactggaactcggcagcctcgatctcgtcgacgggacgccggtggttgatatcaaaccgtatcttcctttcgccgaagccctgccggacgccagcgccagctatgcacagcaggcgccgctggcgggtatgaacgtcagctttacgccggaaatagacgcacagttactcacgctggaaaaacgctacccacatatcaaagcgtttatccgcgaggtgctggcgcaggatccgcgtccggcctaccgaaaagaggaacaagcgggaaaaacatatgccgtctggctgctggatttcaacgtccgctggcgggtgactgcctccggttttgaagtctttgccctcgaagcgcgctaattttattttcctctcttttggcatctttgccacactggtaaactaaaccactttttttgtttcaggctgggcaaccagcctgttccgctcgtttaactggaaccgttacaacatgcgtactagccaatatctgctctccactctgaaggagacacctgccgacgccgaggtaatcagccatcagctgatgctgcgcgccgggatgatccgcaagctggcctccgggttatacacctggctgccgaccggcgtgcgcgtcctgaaaaaagtcgaaaacatcgtgcgtgaagaaatgaacaacgccggtgcgatcgaggtgttaatgccggtcgttcagccatctgaactgtggcaggagagcgggcgctgggagcagtacggcccggaactgttgcgcattgccgatcgcggcgatcgtccgttcgtcctcggcccaacccacgaagaggtcattaccgatctgatccgcaacgagctgaactcctataaacagctgccgctgaacttctatcagatccagaccaaattccgcgacgaagtacgcccgcgtttcggggtgatgcgctcccgtgaattcctgatgaaagatgcctactctttccatacttctcaggaatcgctgcaggaaacctacgacgcgatgtatgccgcttacagcaaaatcttcagccgtatggggctggatttccgcgcggtacaggctgacaccggttctatcggcggcagcgcctctcatgaattccaggtgctggcgcagagcggcgaagacgatgtgatcttctccgacagctccgactacgcggcaaacatcgagtttgcggaagccgttgcgccgaaagagccgcgcgcagccgccacccaggagatgaccctggtcgatacgccgaacgccaaaaccatcgccgagctggtggagcagttcaacctgccgatcgaaaaaaccgtgaaaactctgctggtgaaagcggttgaagatagcgcttccccgctggttgccctgctggtgcgcggcgatcacgagctgaacgaagtgaaagcggaaaaactgccgcaggtcgccagcccgctgaccttcgccaccgaagaagagatccgcgccctggtgaacgccggtcctggctccctgggcccggtgaacatgccggttccggtgattatcgaccgtactgtagcggtgatgagcgatttcgccgctggcgccaacatcgatggcaaacactacttcggcatcaactgggaccgcgatgtcgcgacgccggaagtggccgacatccgtaacgtcgtcgccggcgacccgagcccggacggtaaaggtaccctgcttattaagcgcggtatcgaagtgggtcatatcttccagctggggacgaagtactccgaggcgatgaaagccgcggtccagggcgaagatgggcgtaaccagatcctgaccatgggctgctatggtatcggggtgactcgcgtggtagcggcggcgattgagcagaactttgacgatcgcggtatcgtctggccggatgcgattgcgccgttccaggtggcgatcctgccgatgaacatgcacaagtcttaccgtgtgcaggagctggcggagaaactgtacgccgagctgagcgcccagggtattgaagtgctgatggacgatcgtaaagagcgtccgggcgtgatgttcgccgatatggagctgatcggtatcccgcacaccatcgtgctgggcgatcgtaacctcgacaacgatgatatcgaatacaagtatcgtcgcaacggtgagaagcagctgattaagaccggggatattgtggaatatctggttaaagcgataaaaggctaacacccacctcagggccctgaacggatgtcagggccttttttttacaaggacagtaccaatgactgcacatctcctccgcagcggactgcttacttttgccctgctcctacttaccgcctgtaccctggacgtcggccgcagctcgccttccacatctgctgccgatgaccattcatcatcctgggctgttaccctccagcgtcaaagctcgattgccggcagcggactgcgcgaaatcgccgaaagcgacctgcgctccggcgacctgctgttctcctccagcctgggcgtcacatcgcttgggatccgcgccttcagcgcctcttccgtaagccacgtcgcgctgtatgttggcgaaggtcaggtagcggaagccaccggcgccggcgtacaagtgattacccttcagcaggcgctggcgcacagcgataaactctttgctctcagggtgcctgacctgacgccggaccaggcgacggcgatgaaaagttttgcctggcaggtcaaagacagcgggtataactatcgcggcattattcagtttatcccttatatggtcaccaaaccgctctgctcgctcaaccccttctcacgagactttcgccagcagtgcgtcagcggcctggctaaagcgcagctgggcgatgcggcaagcggcgacaagaaagcgtggttttgctcggagtttgtcagcgaggcctttgtccgagccgggcatccgctgacgctcgcgcaggcggcgtggatcagtccttccgatctgctgcacatgcgggaaggagacgtcgccacgtttaaacccgaaacgcagctccagtatgtcgggcatttgaaactgggagtttatcttcaggccggtaagctggtggggctgaacaaaccgaaggacggtgcggagtaaagaaacgattgacgcttttccgccagccagatccacgctcactcttgatgtgacagggctaataacaggaggaagtaggtggtactgcgcgggatcatcccctgcccgttacccggacaggggcctgacaatcaatggctgcagtctttaccgggaataaatttgccggcttgatccgtcatcagcgttttcatcatctcgccggtatccgggttcgcttcgagagtaaagtgcccttctaccaccagcagtaccgggcgagtatcggtcccgcgcgcggcggcataatcccgttcaagctgggcattgttcgccaccgcgacgcgtttaccggtcgcgcaatcggtaaaggttgccgcatcggccatatagaaatacatgccgcgcatcgccatcggcgtcgtcggcaggctggccttcactggctccagggtatagttgagaggagactgaatggggcttccgttgcggtcgagcatctccagcttgtcgcctttcgcgcgaaagtaagatttctcgcccttgctgttggtcagcaccagcttatccgcggtacgtgcccaggtgccgtacgaggcaaaggatgacggctcacgacgggcgccctggtagtgctcattcatcacccaggtcccgtctttttccaggaacagcgaggtgtcgataccttcgcaatccgcgcaaggcagcacgcctcgccagctttgctgcatcggcttgagctcttccatcgccgctggctggaccgtgtcagtctcggcgcgatggttacaaccaaacagcgcgaacagcgaacaggccgctatcacggagaatacgattttcttcactttgctttccttatcatccatttcacccgttcgccgacgccttcactggcgaactttcccacgcagcgccttgactgaggacttctgtgccttggaagcaaggcgtcgctctttcgatgcccgagtcggtcgcgtctcccggcgacttttttgcactgcggttaattctttaataagggccaccaaccgggcgatcgccgcttcacggttcatctcctggctgcggtattcctgagccttaatgataaccacaccgtcagcagaaattaagtggtggctggcggcgagcaggcgctctttgtaaaactccggcaggcttgaagctttaatatcaaagcgcagatggatcgccgtcgacgctttgttcacatgctgcccccctgctccctgggcgcgaatgcctgacaagacgatctcgtcgtcggcgagggctacgctgcggctaatagtaatcatgccgacgcttgccaggcggtaagctgaatttccagattattccgagcgtcggataaccagatactgccctcctgcagagtggcctgcagcgtcatggtacggtcggcaaaggcgctaagcagtgccagttgcgcatcatcaagataccagatggtcagcttcgggtacgccgcaagcttgctctgattctgctgccaccagatttcagctgcccggctattataagcaaacagcgccaccgcctgcgcccgtgagcaggctttcttaatccgccgctcatccggcagacccagttcgatccacagatcgaccccgagatgatcgttaagcagccacagctccggctcgtcatccgacgatagaccgcgggtaaactgtagccgttcatcggcatatttgatccatgccagcaggcgcagcatcatgcgctcctgggtttctgacggatgctgagccagcgtcaggttagcatccagaaactggttgcgatccagatcggctacatttaccgcagctttatatattgtcgctttcagcgccatgaataaactcctgaaaagaatggcgtacattgtagcgaaactggcggcaaaaggctgtcgtcaatcgcagcaacctgtttcatcctgctgaaattgcttaaatgactatgatatagttcccttgctaaacagagtttatcttcgtaggcttaaacttgcatcccacggttgagtcagaacgctgacaggagggcatgtggaccactattgtgagttaatacgcaagcggtatgcggaaatagccagcggagacttagggtatatcccggatgcgctgggttgcgtgttgaaagtattgaatgagattgcggcggatgaggccctttcggagtcagtcagggaaaaggccgcttatgcggcagcaaacttactggtgagcgattatgtcaatgaatgatacttatcaacccattaactgcgatgattacgacaacctggagctggcctgccagcatcacctggtgctgacgctggcgctgaaggatggcgaacagctgcaggcaaaggccagcgatcttatctcgcgaaaaaatatcgagtatctggtggtcgaactcgccggcaacgtccgcgagctgcgcctggataaaatcgccagcttcagtcacccggaaatcggcaccgtggtggtgagcgaatcctgaatcaaaaacgggcttaatcgcccgttttcctccacatcagcctgaccccttccccgtccttcacttcaccttctgtggtcacaaacagatcgtccgctgcggcaatcggcgtttcgccgtaaaacagcagcggcgtggtgtctcgtcgccacggagcaacgcccagctcctgccagagcttcttaagcttgcgtccgccatggcgcccgacaatatgcaggtggccgctggcgcgaaagcggacggtgaccggctcatccgccgacggcgggcgcagcctgccgccgggccgcagcgtcagctcgccgagaccgtccgccagccgcagcggctggcgccagtcgggccagcgctgaacgctgtccgtctgaccgggaagatacttcacccagtacaaacgctgttgaaaacggcggacggtaaattcccccagccgcagacaggggctggcatcttcccgcgccagcgccacctcgtgccagaggcgctcaggcacctcgcgggcgggcatcggcgcctgctgcccggcgagccagcgacgcagcagcgccgctcggcgcggcggactcatcgtcgccagcggcgcgatagccagcgagccatcttcggccaccagcgacgccagctccgccgccaacatctcgtccagcagttgttcctgctcggcgcacaggctggcgctgcgggcgacggcctcgctaaagtgcggccaacgctcgcgcagcaccgggatcacccgcaggcgcaggaaattgcggtcataggtatcatcctgattactctcatcttcgatccacgacagctgatgggcgagcgcccactggcgtagtgattcgcgggtttcattgaggagaggacgcagcagtcgactgccggcaaaggcagaggatggcgccatcgccgacaggccggtaggaccgctgccgcgttttaacgccagcagcagggtttcgcactgatcgtcctggtgctgggcggtcactaacacctcgccggcattgagcgtatcctgaaaggcctgatagcgcgccgcacgagcgtgggcctcgacgcccagccctccccgggctaacgtcacgtgatgcaccaccagcggcacctgccactgctggcaaatctgccgacaatgcgccacccagtcgtctgcgtgggcgctaaggccgtggtgaacatgcaccgcccgcagcgtcagcgagggatcctgttcccgcagcagcaccagctgatgcagaagaaccgtcgagtccagaccgccgctgaaggccaccagcagctggcgatggggatgaagcgtatgcgcaatatcagccgtcatatccacgaacataccgagaagtgatggcccggcacgttaccgggccagggtcgcgctggcaagatttactgctgatatatttccagcggcaggtcgtccggatcgctaaagaaggtaaagcgtttaccggtaaagggatcgacacgaatcgcttcgcactccacgccatgcgaggtgagatgggctaccgcggcgtcgatgtcatccacgctaaaggccagatgacgcagcccgcaggcttccggacgactggggcgggctggcggaaacgggaacgagaacaactcaatcacatactcgccgttgagcgccagatcgcctttccaggaatcgcgctcggcgcgataaaactcactttgcagcgtaaaccccagaatatcgcaatagaacgctttactgcgggcgtagtcggtcgcaatgatggcaatatggtgaacccgtttcaaacccagcatggttaaactccttctgttaagccagccacgttactcgtgcgcgccgttaacgcgcaagcctttcgtcattttttaagactcgtacccgatacacaccgtcctcatcgcgcttggcgccgtgaatatcggtctcaaagcccgggtaatgacgaccgatagagcaaagcatcagcagaaaatcgagcaccgcccggctttcctcggtgatcatctctcccggcatcagcagcggaacccccggcggataagggaggatcatgttggccgaaatccgccccaccaggttctccagttcaatagtttccacctcccccttgatctggcgctgccaggcgtgatgcggcgtcattttcatttccggcaggacgtcaaaggcgctgagcatcagctgcggcagctgatgctgacggatcaagcggtggatcccctgcgccagatcctggatccgcatgttgcggtagaagtcgggatcttcggcgtacagatccggcagcatatttttcacccgcagattgagatcgtaggcgcgtttaaactcggtcaggccgcgcagcagccccatcgcccgggttttatcgatgccgatactgaacaggaacagcagattgtaggggcctgttttctctaccaccacgccccgctcgtcgaggaacttcgccaccagcgccgccgggatcccctcttcatccatattcccctgctcgtccatgcccggcgtcagaatggtgaccttcaccggatcgagatacatatgatccgcatcggcatctttgaaaccgtgccagtcctcgcccggcgctaccggccagcactcggctttatccacggcttccggctgccagatatcaaagaaccagccgtccgactcctcacgcagtcgctgcacctctttgcggaagtccagcgcccgctcaatggagcgctggatcagacgtttaccggagttgccgcgcagcatcgccgccgcggtctcaatcgacgcgacgatggggtagctcggcgacgtagaggtatgcatcataaaggcttcgttaaaggtctcttcatcatagttgcctttaatgtggatcagcgaggcctgcgacagcgcggccagcatcttatgcgtcgactgcgtctcgaagatgactttcccggggatccgctccccgctcataccgcttttcccctgatatatcggatggaaatgggtatagggcacccaggcggaatcgaaatggatcgacgggacatcgagcgtctccttaagccaggtggtgttatagagcagaccatcgtaggtggagttggtgatcaccgcatgcacgggccactgcgccccgcccgtgtcgcgcactttctgctgaatgctgtcgcgggtaaattcgcgccgggggataccgccgaggatccccagcgcgttgcgggtcggcttcagccacaggggaaccacatcgctcatcatcagcaggtgggccagcgatttgtgacagttacggtcaatcagcagggtgctgccggcgggcgccgagtacatgccgacaattttattggacgtcgaggtgccgttggtcaccatatagctttgctcggcgccaaaggcgcgcgcgatatactcctccgcctccaggtgcgggccggtatgatccagcagggagcccagctcggtgaccgaaatcgagacatccgccttcagcgtattcccgccaaaaaaatcatagaacaggcagcccaccgggcttttctgataggcgctgccgcccatatggcccggcgtgcagaaggtatattttccctcctggacatagttgaacagcgcgcgggtaaaaggcggggtgatattctccaggtactcgcgggtgtactgcccaatgcgggtggcgatctcttcggagagtcccagcgcatattcgaagaaccacagcgtcatgcgcaaatcctgactgctgacatccatcgtcgagtgggcgttaataaaggcgtacagaggaaggtattcattgagctgattgatatcgctgcacagatcgacgctgtattcatcccagtcgaagatcaccccgcagatgcgcgggttgtgctcgataaactgcagcaggtcggcgctgttttgcggccagatggtctggaagccctggcgctgcagcgccgcttccagttctttgatcggctcgtctttgtggtagacgccgtgaggccccatgatggcgatgatattcacgctttcctcctggtattaacctaagtcaagcatcatagcaatcccccgggcgcatcgcacataaaaaaagggccggaaaatccggcccttagtgttaagtcctgacgaaaaagttaagcgtaaccgtagctcatcagacgctgataacggcggttcagcagctcttcttcgctgagcagatcgaggtctgccaggtctgccagcagctgcgccttcaggcttgccgccatcgcttccgggttgcggtgagcgccgcccagcggttccggaacgatagaatcgatcagcttcagctctttcagacgcggggcgataatgcccattgcttccgcagccagcggcgctttatccgcgctcttccacagaatggaggcgcagccttccggcgaaatgaccgaataggtgctgtactggagcatgttgaccttgtcgcccacgccgatcgccagcgcgccgccggagccgccttcaccgattacggtgcagataaccggcacgctcagacgcgacatctcacgcaggttgcgggcgatcgcttccgactggccacgctcttccgcgccgacgcccgggtaggcgcccggggtgtcgataaaggtgatgatcggcattttaaaccgctcagccatctccatcaggcgtagcgctttgcggtagccttccggcgccggcatcccaaagttgcggcgaattttctctttggtttcacgacctttctggtggccgatgatcatcaccggacgaccgtcaagacgcgcgataccgccgacaatcgctttatcgtcagcgaaggcgcggtcaccggccagttcgtcaaattcgtcgaacgccaggcggacataatccagggtgtaaggacggcgcgggtggcgcgccagttgcgcaacctgccatgcaccgagatcggcgaagattttgcgcgtcagctctacgcttttctcacgcagacgatgcacttcttcgtcgatgttaatatccagtttctcatcctgacggcttaccgcagtcagggaatcgattttcgcttccagctctgcaatcggctgttcaaaatctaggaaattcagactcatagtattcctgtattagtcaaactccagttccacctgctccgagccgataaggccccgcagatcgttaagtaaacgatcgctcggagagacgcgccatgttgcgccgaaacgcaaccgcgcgcgtgcatccgccctctgatagtagaggtgcactggaatggttcccgaacggtggggttccagagactgacggagtcggtttaaaagctggtcatcaatttgcctgtccgtcagcgagatagcaagcccgcgagcatatttttcccgggcttcgtcaatgtccatgacttcacgggcggtcattttaagccccccgctaaagtcatcaaagctgacctgtccgctgacgataagtatgcggtctttttctagcaactgctgatatttatccagcgcgtcggtgaataacatcacttccagccgcccggaacggtcatccagggtacagatgccgatacgattgccgcgcttggtgaccattacccgcgccgcaatcaccagccccgccgccgtggtgactttcccacgttcggtcggatgcatgtctttgagcctcacgccgccgacgtagcgctcaatctccttcagatactggttaatcgggtgtccggtgaggtatagccccagggtctccctttcaccatccagcaccacctgctcaggccatggctggcagctggcgtaggattgctcaatttgctcgggctcttccgccagcacgccgaacatatcagcctggccgatggcctcggctttcgcgtgctggtcggcggctttcaacgcatcgcccagcgaattcatcagcgccgcgcgatgtgggccgagacgatcgaacgccccggacataatcagcttttccagcacccgacggttgagctttttaatatcggttcgcgcgcagaggtcgaacagctcgcggaaatagccgccattgttgcgcgcctcaataatcgcttcgatcggtccttcgccgacgcccttgatggcgccaatgccgtagacgatctcgccatcgtcgttgacgtggaaatggtacaggccggagttaatatccgggggcaggatttttagccccattcgccagcactcatccaccaggccaaccactttctcggtgttgtccatatcggcggtcatcaccgccgccataaactcggccgggtagtgcgccttaagccacagcgtctggtaggagaccaacgcgtaggcggcggagtgcgatttgttaaatccgtaaccggcgaatttctccaccaggtcgaagattttcatcgccagttcgccgtcaatgccgtttttcttcgccccatcctcaaagatagaacgctgcttggccatctcctccggctttttcttacccatcgcacgacgcagcatgtccgcgccgccgagggtgtatccggacagcacctgggcaatctgcatgacctgttcctgatacaggatgatgccgtaggttggctccagcaccggtttcaggctttcatgctgccactgcacgtccggataagagatctcctcgcggccatgcttacggtcgataaagttatctaccatccccgactgcagcgggcccgggcggaacagagccaccagcgcgatcatatcttcgaagcagtccggctgcaggcgtttaatcagatctttcatgccgcgcgattcaagctggaagaccgcggtggtttccgagcgctgcagcatgtcgaagcttttcttgtcatccagcgggatggcggcgatatccagcggcccttcgccgttcttctcacggcgcttgttgatcatctccagcgcccagttaatgatagtgagcgtacgcagaccgaggaagtcgaatttcaccagcccggcgtattccacgtcgttcttatcaaactgggtaaccggatgcagcccctgctcatcgcaatacagtggcgcgaaatcggtgattttggttggagcgataactaccccaccggcatgtttaccggcgtttcgcgtcaccccttccagcttacgcgccatgtcgatcagcgccttcacttcctcgtccgcctcgtagatctccggcagctgcggctcggcctcgaaggctttcgccagcgtcatgcccggatcgggcggcaccagcttggagatacgatcgacaaatccgtacgggtgacccagcacgcgaccgacatcgcggatgaccgctttcgccgccatggtaccgaaggtgatgatctgcgataccgcgtcgcggccgtacatatccgccacgtgctcaataacctggtcgcgtttctccatgcagaagtcgacgtcgaagtcgggcatcgagacacgttccgggttaaggaaacgttcgaacagcaggtcgaactccagcgggtcaagatcggtgatcttcagcgcgtaggccaccagcgaaccggcgccggaaccacgtcccgggccaaccggcacgccgttatccttcgaccactggataaactccatcacaatcaggaagtagcccgggaaccccatctggttgataacctggagctcaatatccagacgctggtcatactccgggcgcttttcagcacggacggcaggatccgggaagaggaattccagccgctcttccagaccctctttcgatttcatgaccaggaaatcttccgtggtcatatcgccggtcgggaactgcggcaggaaatattcgccaagccgcacggtgacgttgcagcgcttggcaatttcaacgctgttcgccagcgcttccggaatatcggcgaacagctcgcacatctcttcctcgctgcgcatatattgctgcggcgagtagttgcgcggccgtttcgggtcgtcgagcgtaaagccgtcgtggatcgcgacgcggatttcatgggcgtcgaaatcgctggtgtcgagaaagcggacatcgttggtcgccaccaccggcaggccgcgcgcttccgccagcgccacggcggcgtggagataggcctcttcatcctgtcgaccggtacggatcagctccagaaaatagcggtccgggaaatgctcttcgtagaaggcgacgcactgttcaaccagcggcatattgccgcggatcaggctgacgccgacgtcacctttccggccgccggagagcagaatcagcccttcctgatgttccaccagccagtcgcgatcgatccacggccccagggcgccgtagccgcgctgataggcgcgggaaatcaacagggtcaggttctggtagccggtgttgttcgccgccagcacggtcagctcggtaaattcgtcgccgagcaggtcgcactgcacgtgaaagtcggcgccgacgatcggcttaatccccgcgccgtgtcccgtcccgtagaacttcaccagtccgcagaggttggtgaaatcggtgatcgccagcgctggcatgccaagcgaggccgccttcttcaccagcggcccggtctttgccagcccatcgatcatggaatagtcgctgtgcacccgcaggtgtacgaaacgtggttcagccatctttagatcccggtgacttagttggacgccaggcccagggcacgcttcaccgggccaaaactgcgccggtgatgctctgttgcgccgtgttcctgcagcttctgcaggtgaacagcggtgggatagcctttatgctgggcaaatccgtagtggggaaatgcgaggtccagcgtggccatttcggcgtcacgagtgacttttgccagaatagacgctgcgctgatttctgccacccggctgtcgcctttcaccaccgcctgggagggcatcggtagcgacggacagcggttgccatcgatccggacaaactcaggaacaatgctcaggccggcgacggcgcgctgcatcgccagcatagtggcatgcagaatattcagctcgtcgatttcgtgcggctcggcgcgccccaggctccagcacagcgctttctctttaatctcatcgaacagcgccagacgacgcttctcgctgagttttttggaatcattcagacccacaatcggcttcgccggatcgaggatcaccgccgcggtcaccaccgcgccaaccagggggccacgcccgacctcatcgacgccggcaaccagatgggtatgcggatagacgaactccatcattgttttgctaactccagtacggcgtccgccgcctgctcatcggcgttgcagcggatctgctgatgcagggcgcggaacgtctcatgcatctcatggctggttttgccatcggccagcagcggctgcagagcggctgccagcgcctggggctcgcactcatcctgcagcagctctttaaccagttcgcgacccgccagcaggttcggtaacgagacgtagtcggtttttaccaaccgcttcgccagccagaaggtgaacggcttcatccggtagccaaccaccatcgggcatttcgccagcatacactccagcgctgccgtcccggaggccagcagcgcggcgtcgctggcgatcatcgcatcgcgcgcctgaccgtccagcatatgcacgatcatatccggcgccgtcgcagctttaatacgctcaaactgctcccgccgtttagcattaaccagcggcaccaccacctgcagatcgggataggtggcgcgcagaagctgcgcggttttcaggaagtcggcgctaagcatttcgacttccgcgccgcggctgccgggtagcagagcgaggcagcgcacgctgtgcgggatccctaaccggtcgcgcgcagcgcctttgtcaggatccagcggcatcgcatccgccatggtatggccaataaagcggcaggggacgttaaatttgtcataaaacgctttttcgaaaggcagaaaggccagcaccagatcggtggatctgccgattttgaaaacgcgtttttgtcgccaggcccagaccgacgggctgacgtagtgaatggttttgatgccctgctttttcagatttccttcgagggtgatattaaagtcaggggcgtcgatgccgacgaagacatcgggacgcagctcgccgaagcggcgggtcaaatcggcgcgaatatggagtaagcgacgcaggcgaccgagcacttcaacaatgcccatcaccgccagctcttccatttcataccaggcttcgcacccttccgcctgcattagcggccccgccacgccgacaaagcgcgcattcgggatgcgtgctttaagcgcgcggatgagaccagcgcctagaatatcgccggaggtttctccggcgaccagggctatcgtcaggggacgctgttcagccattaacgaatcaagccgcgggtagaacgagcgaagaaatcgacaaacggctgaacctcaggatgctgagcagccagttcggcgatttccggcttggcttcttccagcgttttgccgctgcggtacagcagtttatacgcgttgcggatcgcggtgattgcttcccggctgaagccgcggcgtttcagcccttcgatgttaacgccgaacggcgtcgcatggttgccctgggcaattacgaacggcggaacgtcctgcgccacgccggagcagccgccaaccataacgtgtgagccaatgacgcagaactgatgcaccgccgtcatgccgccgataatgacataatcatccagcgaaacatggcccgcgagcgtcgcgttattggccagaatgcagcgatcgccaagcgtacaatcatgcgccacgtgggcgttgatcatcagcaggttatcgttgcccacctttgttaatccaccgccctgtactgtgccgcgatgaatggtgacgctttcgcgaatgcggttgcgatcgccaatttccacccgggtcggttcgccagcatatttcagatcctggttaacttcgccgatggaagcgaactgatagatctcattgtcacggccgattttggtgtggccgttaacgacaacgtgagacttcagcacggtgccttcgccgatttcgacgttagcgccaacaatacaaaacggaccaatgtggacgttagcgccaatcacggcgccttcttctacaatggcggtaggatgaacaaaagcggttttatcaatcacgtatcaggcctcccggctacgcgcacacatcatcgtcgcttcgcaaaccactttaccgtcaaccagcgcaacgcctttgaaacgggtcaggccgcggcgggttttctcgaaagtgacttccataatcatctgatcgcctggtactaccgggcgtttgaagcgtgcttcatcgatacccgcgaagtagtacagctcgcctggttccagttttccgacgcttttgaacgccagaatcccggtggcttgcgccattgcttccagaatcaggacgcccggcaaaatcggcttaccagggaagtgcccctggaaaaacggctcgtttacagaaacattttttactgcgcgcagaaaacgaccttcttcaaaatccagcacacggtctaccagcaggaacgggtaacggtgaggcagaagttccagaatctcttcaatgtgcagagtatgagtgtcagtagtcaaaatactcttcctgtctaaatgtactaaaaggcaataataacacggcctgcggcaatcttttagcgaatgcaacaggccggaaatgtcatgtgaccaaatgatgaattagtcttgttgattaaccttgcgctcaatcgctttcaggcgcttgctcatctcgtcaatattcatcaccagcgcagcggttttacgccacgccttgttcggctgcagcggaataccggaggaatatacgccaggttcgctgataggacgcatcaccatccccatccccgtgacggtgaccttatcgcagatttccatatgaccgttaatcacgctggcgccgccaatcatgcagtagcggccaattttcaggctgcccgccatgataacgccgccagcgaccgcggtattgtcgccaatcaccacgttatgcgcaatctggcactggttatcaatgataaccccgttgccaatcacggtatcgtccagcgcaccacgatcaatcgtggtgcaggcgccaatctccacgcgatcgccaataatgacgcgacccaactgcgggatctttacccagttaccgcgatcgttagcgtagccgaagccatccgcgccaatcaccgtgctggactgaatcaggcaattctcgccgatctcaatctcatggtaaacggtcacattagcccacaaacgcgagccggcgcctattttcgtatttttcccaacgaagcagcctgcgccgataactacgttatcgcccagcactacgccggattcgataaccgcgttggcgccgatggcaacgttgctacccagcttcgccgacggatcgatgaccgcgctcggcgcgatatcctgagccggctgcggcgtggtatcaagaatttgagccatgcgcgcgtaggtcaggtaggggttacgcactaccagcgcggcgctatgggcaaaaggtaaatcatcctgcgtcatcacaacggcagaagcctggcaagcggccaggtgctcacggtacttagggttgaccatgaaagtgatttggcccgttttcgcgctctgcatggacgcaacgccggtgatgacgatatcgccatcaccgtgtaattctgcatccaactgctgcgcgagatcagccagtcgaattgaaggcattacttatttaacctgtttcagcacatcagcggtgatgtcttttacatcgctgctgttatatgcaacggcattcgcgtcaaccaccagatcgatgctctgatctttcgctacgctctgtacggcagtctggatacgggtaaccagtttgccacgctcttcgttggaacgacgtgcgcgatcctgttcaaacgcctgcgctttctgggagaaggtctggcgctgagccatcacgtctttttccagtttggtacgttcggcgcccggcttcatggactgcagacgctgcattttggattgcaggtcgccttccatacgctgcagttcgctagcgcggcctttgaactcgttttccagcgtgttggaaacgccagttttctgggcaacctgttggaacaggctgttcatgttcaccagggcaattttatctgccgcctgagcggaagttaccattgccaaacccagacctgcagctaataaccactttttcacaataaactccttaccatcccatgagtacccaggggtaccgttatttgcgtggcgaggcgataaacgcgttatcgcctacagtcagcgctatactgcacttgcattccgttgccgccaacaattaccaggttttaccaatgttaaactggaactgttcggctttgtctccatcgtactttttgaacggttgggcgtaggagaagaccaacggccccaacggcgacatccactgcacggcaatacccgcagacatacggatgttgctcggatcgctgtaatccggataaccagcgtacgcgctcgaatcccagtgagtatcccatacggtacccatatcccagaagacggaagtacggaccgagttcgcatatttgtcactaataaacggcgtcggggtaatcagctcaaggctggccaccgccatcgcgttaccgcccaccgcatcatcggatttacacggtgcggattcggtgctcttacattcattatcgtaactatcgtcatcatcatgacgactgcttgccgggaagtacactgccttcggaccaatggtgttcgactggaagccacgcacggtgctggaaccaccggcatagaagttctcatagaacggcatctctttgccgccaataccatcgccataaccaaagcgcgtacgacccagtactacccactgatgatcgttgtcgatcggcacgtaggtcgcggtatccagcgtcgctttgtagtactcgttgtctgagcccggaatggtcaccttaccgttcaggttgacgcgcgaaccttccgttgggaagaagccgcggtcaagcttgttataggtccaaccgtagttgaaggtgaagtcattcgcactgaacgagttccggtcgttggtgttgtccggatactggcccatcgagttaaggtaacgccacattgccacctgcggctgcatattggacagggagttatgcacataaccgacgccggcgcgcagcgtgttgtattcgttgaccgggaagcccagcgtaatgtctgtaccatagcttttgttggtatagtcagacagatccgcatcgttcgcatcaaagtcattatagaagacacgaccgccgaggcttacaccgtctacggtgaagtacgggttggtcaccgacagctcggtataggtctggtagtcgtttttggtaccgttgatcccgacagcatagccagtacctaaccagttatcctgctgaacgcccgcctggaagctgacgccgctctcggtgccgtagccgataccgaagttgaagctaccggtgttacgctctttcaccttgtagacaacgtcgacctggtccgggctgcccggcacgcgctgggtatcagtatccaccgtttcaaagaaacctaaacggttgagacggtctttaccctgatcgacgaggtcgctccccagccatgcgccctccatctggcgcatttcgcggcgcagtacggcatctttagaggtgtcgttgccttcgaagcgaattttacgcacgtaataacggttgcctgcgtcgacgttaacgtgcagcttaacggttttatcgctgtcgttgatctccggctgcgactgcacgcgcggataggcgtaaccataacgacccaacagtttcttgatgtcgttttccatcttggtcactttcgcgccgttgtacagttcgcctggctcaactttagtcagcgcttcgatttccgcggaatggccagcgaggttgcccgtcacctgcactccggaaaacttgtactgatcgccttcggtgatgttgacggtgatgtagatccctttcttatccggcgtcaggctgacctgggtagaatcgatgttgaaacgggcatagccgcgatccaggtagtagctgcgcagggtttcaaggtcgcccgctagcttctgcttctggtatttacggtcgccgaccacgttccaccacggcacctcatcgcgcagctggaagtgggagatcagctcatcggtcgaaaacgcatggttgccgacgatgttgatctgttgaatttttgcggagacgccttcctggaagaccagcttcaaatcgacacggttacgcggcagcggcgtaacgactgctttgacgctggcgctgtatttaccgacgctgtagtagaagtcttcaagacccttctcgatatccgcgatggtcgtgcggtcaagcgactcgcccacccgaacgcctgaggcctcaaggttctgcttgagcatgtcatctttcaccgacttgttgccggagaaagtgatgctggcgatcgtcggacgctctttcacctgcaccagcagggtatcaccatcgcgcaggacgcggacgtcctcgaagttgccagtggcaaacagcgcgcgaatagtgttactgatatcatcgtcggtcaccgtatcgccaggacgcactggcatactgaggagggccgcaccaacagcgacacgctgcaagccttcgaaatgaatgtccttcaccacgaacccttcagcaccgtatacagtcgcgctgctaaacagcagcgacgctatgagcaactttttcatcgccatcgttattatgcgttcttcctaacaaactctcttataaccgagagaaatcattgaaaagtgcaagccccattaacagcaccagcagtattgagccaatgcgataactaaagtcttgaactcgctcggataccggcccgcccttcagcttttcaatcgctaaaaacagcagatgtcccccatccagtacgggtagagggaacaggttgatgattccgaggttcacgctaatcagcgccaggaacatcagataataaatcaacccaaactccgctgacattccagccccctgagcgatagagatcggcccactgaggttgttcagtttgacatcaccggttatcaatttacccagcatcctgaccgtcagcgacatcagctgccaggttttatccgtggcttcagcgatggcggcaaacggtccgtactgacgtactgtcttgtattcttcaggcagcgggatgacctttggcaccacccctgcgaacccttccgccttacctttcaccgttttcgcatccggcgtcagggttaacggcagcgcactcccctgccgttcaatctccagcgccagcgctttgcccggattatcgcgcaccagattaacaaacgtcatccactgcgttaacggttgaccatcgactttaacgatccggtcgcccgcttgcaaacccgctttctgggctgccgatcccgcctgaacctcagccagcaccgtatcaatctgcgcgctgcgcggctggatccccagagaggtcacgggatcttgcttgtctggctcaaacgaccagtgccgcagatcgacgattttatcctggcgctgattggtcccgaaaggggcgacggtaactattgtttgcgggttgccgattttggccaccagctgcagacgcaccgcatcccaatcaggcgtttcgataccatctatcgctttaagttccgttccttttgcaatttgtgcttgcgcggcaaccgaattgggcgttatttcacccaccaccggccgcacgccgggaacgccgatgataaagaccagccagtaagcaaagatagcgaaaatgaagttagcgatggggccggcggcaatcaccgccgcacgctgaccgacggttttattgttgaaggcatagtgacgcatctccggcgccaccgcttcaacacgctcatccagcatcttgacgtagccgcccagtgggatcagggcgatgacgaactctgtgccctgcttatccatccgccgccacagcgctttgccgaagccgatagaaaaacgctcaacccggataccgcagcggcgcgccacccaaaaatggccaaactcatgcaccgtaatcagtacgccaagcgcaatgataaaagccgccagattccagagcacgctcagcatataaccttccgtcaaatcgtcctgaagaccaacagtagcagacaggcgaagaccggtaccgccgccgtcaggctgtcgatacgatcgagaataccaccatgtccgggaatcaagtgcccgctatccttaatgccggcctcgcgcttaaacatactttccgtcaggtcgcccagcaccgaagccagggccgccaccaccgaacagaccagcagcaccgtcggcgtgacgtcaagatgggcccacacgccgtaggcccaggaaatcactgccgcggtcagcaaaccgccaaaaaagccctgccaggttttacccggtgagaccttcggcgccagcttgtgcttgccaaacattttaccaaacatataggcgccagagtccgcgccccacaccaggatcatgacgtacagcagccacagcgcgccgctatagtggttatcggcatagtgccaggcgcgcagcgccagcatgccccagaaaaacgggacgatggtcagaatgccgaagatgaggcgcagcaccttagagtggcgccagaatgccgctgacgccgggtatgagagcaccagcagtaacgcgacgatccaccaggcaaaagaggcccatagcgacccttcaaccatcggttgatgaacgtcatagtggtattcaggcagcagaaaaagcatcgccgccagcagaaggccgcacagcaccgccagccaaacccgctgcgacgtcgaggtaaaaccgctcagttgtccccactcccaggcggcgagcatacagaccaccagggtgacgatagcaaagcccatcggcggcaataaaaacaatgccgcaatgacgatggggattaagacgaaagcagatatcaggcgatacttcagcaaaagtgacccccatcaggcatgactgccacccggctcagtgccgccgaaacgacgctctcgattaacaaaggcatggagtgcaccttcaaagtcctgttcagcaaaatcgggccaaagaacatccgtaaagtaaagttcggcataggcaatttgccaaatcagaaagttacttattcggtgctctcccccggtcctaataactaaatcaacgggagccagttcatgcatgcagacctgctgactcagcatgtcttccgtgatctgctcaggcagtagcgtcccgtcctgtacctgtttcgccagcaaacgaacgccctgggtaatatcccagcgaccgccgtaattggctgcaatattcagcgttaagccggtattgtttgcggttagcgcttccgctttgcggatccgctcctgcaggcgcgcattgaagcgcgtggtgtcgccaataatccgcagacgcacattgtgtcggtgcaggcttttgacttcgctatccagcgcccagacgaacagttccatcagcgcactgacttcctgagccggacggttccagttttcgctgctgaacgcgtataacgttaacgcctcaatcccattattcgccgcgaaggagaccgcgcgacgcacggatttcgccccggccttatgcccgaaagcgcgaattttaccttgccgtttcgcccaacggccgttgccatccataataatggcgacatgacggcagccatgggtgggcgatatttcgctgacagtttgattagcagacaacatcacgcgttttaagtccataataaggattaactagccaccaaacagaggccaccgggccgcgctggatacgcatttttatccggtgccggggctgcagccaatcgcagagaacaaccaaaagctttacgcaaaaaagccgtgttttgtcacggccaccgtaatctttaacaacaaaatgcaacgatcgggtggcgcagactatatcaccgaagccttgcgcccacaaatatcaccgcgttacgcctgcgcaaccaaccgcagcagctgctggtgagcgattgcgcgcgcctcggcgtcgataaccagaacatcatcaatgctttgcggctcctgcaggtccatcttatccagcaccgccaggttaaccgccgcaatatcggtaaagcggatatcgccatgcagaaacgcggcaaccgactcttcattagccgcattcagcgtcgtggtcgcggcctggccgacatcaaacgcgtccatcgccaacttcaggcacggatatcgcgtatagtccggcgcggagaagctcagattgctcaactgacagaagtccagcggtttaacgccggaattcagtcgctgcggccagcccatggtatgggcgatcggcgtacgcatatccggctccccaagctgggccagcacgctgccatcctgatagcgaaccatcgagtggatcaccgactgcggatggatcagcacttccatctgctgggccgaggcgttaaacagccagcgcgcttcaatatattccaggcctttgttcatcatcgtggccgaatcgacggagatcttgcgccccatcgaccagttgggatgacggcaggcctgatccggggtcatcgccgccagttcagccacggccgtctcgcggaaaggcccaccggagccggtcagcaggatagacgagacgccgttccgggcaagatcagcgtatcccagatgctgctgaattgtctccggcatactctgaaaaatagcgttatgctcgctatcgaccggtagcaatcgcgcccccgactgttgcaccgcctccatgaataagcgaccgcaggtcaccagcgattctttattcgctaacaataccgttttcccggcgcggatcgccgccagcgtcggcaccagccccgccgcgccgacgattgccgccatgacctgatcgacctcatccagcgccgcgacctctgccgccgcctgctggccgctcagcacctcggtgcgactgccatgctcatgcagacgggtgcgcaaccgctcagcgctttgcgcatcgtccatcaccgcgtaacggggggtaaattccaggcattgttcaaccatacggtcaacgtttttccccgcgaccagcgcggcgacggaaaagcgaccagggttatggcgcaccacgtccagcgtgctacagccaatggagccggtcgaaccgagaacggttaattgcttcatgagacgtccagaagagtggaaacagaataaaaagcaaaacgccgccagcaagcccctacgcagcaactatcggggatgagacggcggcattaggccttcaactaagcgctaaaggctacaaggccagcggttgcaacgcaatcccgagaattgagcgtacagtcttctgtacggcgtttcagattttactcaggccagagcctgtctggcctgagtaagggcagagcattagaactgcatcagttccgcttctttgtctgccagcgccgcgtcaacttttttgatggcggcgtcagtcattttctgcacgtcgtcctgagaacggcgatcgtcatcttcgctgatctctttttctttcagcagcgctttgactttatcgttggcgtcacggcgaacgttacgcacggcaacgcgcgcctgctcggcttcaccacgcacgatcttggtcaggtctttacgacgctcttcggtcagcggcggcagcggaacacgaatatcgctgccggcagagcttgggttcaaaccgaggtcggaggccatgatcgctttttcaacagccgcggacatagaacggtcaaagacgttgattttcagggtacgggagtcttcgacggtgacgctggccagctggcgcagcggggtcggagtaccgtagtattcaacaacaatcccgtccagcaggctcggagaagcacgacccgtgcgaattttgctgatttggtttttgaatgcttcgacgcatttttccatgcggatttcagcatcttttctgatatcgctaatcacgttacgaatccttgaaagcttgtctcagtcagaccagacggggcacccgtcggaaaatgagctaagtatagtcagatttaatgaaaatcaccgggcaatatccccgcgaaagtaaagcggaatattacccggatttggcgctgacgggaattattccgtgatcaatgtgccttctttttcgcccatcaccacgcgacgcagggcgccaggtttgttcatgttgaagacgcgaatcggtaatttatggtcacgcgccagggtgaaggccgccagatccatgactttcagctctttttccagaacttcgctgtaggtcagctgatcgtacatggtggcagaaggatcttttgccgggtcagcggtgaatacgccgtcaaccttggtggctttcagcaccacatcggcttcaatttcgataccgcgcaggcaggctgcggaatcggtggtaaagaacgggttgccggtaccagcggagaggatcactacgcggttgttgcgcagcaggctgatcgcctctgcccagctgtagttgtcgcatacgccgttcagcgggatggcggacatcagacgagcgttcacataggcgcggtggagcgcatcacgcattgcgaggccgttcatgaccgttgccagcatgcccatgtggtcgcccacaacgcggttcatacccgctttcgccagaccagcaccacggaacaggttaccgccaccaattactacgccaacctgaatacccagctcaaccagctctttgatctcctgagccatgcggtcaagtatgcttgcatcaataccgaagccttctgagccctgcagcgcttcgccacttaatttcagcagaatacgtttgtagacgggttttgcattggtagccatgtttctttcctgagactgtcaacgaatgagatgtgataattccggcgacattgtatgtcgcatttcagcgcggccactataagcagttggctgaatttacaaaatgggcgcaaaaagaagccgccctcaggcggctcctttttttaaaaattaagactgcttggacatcgcagcaacttctgctgcaaagtcagtctcaactttctcaatgccttcgcccacttcaaagcggatgaagccagtcacgtcagcgttgtgctctttcagcagctggccaacagatttgctcggctccataacgaaaggctgaccagtcagagaaacttcgccggtgaatttcttcatgcggccttcaaccattttctctgcgatttctttcggcttaccggactgcatcgcgatgtccagctgaacctggtactctttctctaccacttcagcagacacgtcttccggcttaacgaattccggcttgcttgcagcaacgtgcattgccagctgcttaaccagctcttcgtcagcgcctttagcggcaaccagaacgccgatacgcgcaccgtgctggtagctgcccagaacgtcgccttccagaacagcgatacgacggatgttgatgttctcgccgattttagcaaccagcgcaacacgttcttcttcgaactgcgctttcagaacttcaacgtcggagattttacctgcaacagcggcgtccagtactttgtcggcaaatgcctggaaaccaccatctttagcaacgaagtcagtctggcagttaacttccagaatgtaaccgtagttgccttcgattttggttttgatcacgccgtcagcagccacgttgcctgctttcttcgccgctttgatcgcgccggatttacgcatgttttcgattgccagctcgatgtcgccattcgcttcagtcagcgcttttttgcaatccatcatgcctgcgccagtacgctcgcgcagctcttttaccagggaagcggtaatttcagccattctaaaatcctcgggagatgtggatactgcccggccaacggccaaacagcgtaaattgaaaaaaggggccgataatgggcccctattcatacacggtactaataagggcttaaaccttattattcagcttctacgaagctttcttccgcctgagaagccaggtcctgagagcgaccttcacgaacggtagcagcaacagcgcccaggtacaggcttactgcgcggattgcatcgtcgttacccgggataacgaagtctacgccgtccggatcagagttggtatcaacgatagcaaataccgggatgcccaggttgtttgcttctttgatagcgatgtgctcgtggtcagcgtcgataacgaacagtgcgtccggcaggccgcccatatctttgataccgcccaggctgttttccagcttgtccagctcacgagtgcgcatcagcgcttctttcttggtcagcttgtcgaaagtaccgtcctgggactgagtttccaggtctttcagacgtttgatggactgacgaacggttttccagttagtcagcataccgcccagccagcgatggttcacgaagaactgatcgcagctcagagcagcgtcttttaccgcttcgcttgcagcgcgcttagtaccaacgaaaaggattttacctttacgagcagcgatcttgttcagttcagccagagcttcgttgaacatcggtacggttttctcaaggttgatgatgtgaactttgttacgcgcgccgaagatgaaaggcttcattttcgggttccagtaacgggtctggtgaccgaagtgaacaccagccttgagcatgtcgcgcatggaaacagttgccatgtttaaaacctctatagattaaattggggttatgcctccacgtatcccatattaccgaccccgaagggcaccccggaatatgtgccgatacgtgtgtgttattacacaaagtgagctatgtcgcttacgtccatccttgtgtatctgagatggaacggaagtccggcgcgctttataccacaaaatccatccagacaccaactcttgttgacgtcgcgtgctgttaatgattctcagtttggcaccagcctgcccggactgttaccattgacaggacttactctattattgtcgaaaatatcgacactgctggacatactccatggctatctctattaagacatctgaagacatcgaaaaaatgcgcgttgccggccgcctggccgccgaagtgctggaaatgatcgaaccctacgtcaaaccgggcgtcagcaccggcgaactggaccgcatctgtaacgactatatcgttaacgagcagaaggccatttccgcctgcctcggctatcacggctatccgaaatccgtctgcatttcggtcaatgaagtggtctgtcacggtatccctgatgacggcaagctgctgaaagatggcgatatcgtcaatatcgacgtgaccgtcattaaagatgatttccatggcgatacctccaaaatgtttatcgtcggcaaaccgacgattctcggcgagcgcctgtgccgcatcactcaggaaagcctgtacctggcgctgaagatggttaaaccgggcatcaacctgcgcaccatcggcgcggcgatccagaaatttgtggaagccgaaggtttctccgtggttcgcgagtactgtggccacggcatcggccgcggcttccatgaagagcctcaggtactgcactacgattcgccggagaccaacgtcgtactcaaaccaggcatgaccttcaccatcgagccgatggtcaacgccggtaaaaaagagatccgcagcatgaaagacggctggacggtgaaaaccaaagaccggagcttgtctgcgcagtacgagcatactattgtggtgacagacaacggctgcgaaattctgacgctacgcaaggatgacaccatcccggcgataatctcgcacgatgaatgatgaaaagccggcgcccgccggcttttttattagatagttttttcttatggtgacgcgatgagcaactcattacctgacacagcctcccctctcctgcccgtcccgccggaacacccggtgagttggccgcagggcgatctgaactgtgccgcaatcaaggcgcacatcgataccttccagcactggctgggcgaggcgtttgactccggcatcgtcgcggagcagctcatcgcggcgcgcaccgaatttatcgaccagttgctgcagcgattatggatcgcctgcggttttgaatccgtcagcgacctggcgctggtcgccgtcggcggctatggccgtggcgaactgcacccgctctcagacgtcgatctgctgatcctcagtcgtaaaaaactgccggacgaccaggcgcaaaaagtcggcgaactgctcaccctgctgtgggacgtcaagctggaggtgggccacagcgtacgcaccctcgaagagtgcctgctggaaggtctctcggatctgaccgttgccaccaacttaatcgaatcgcgcctgctgatcggcgacgtcgcgctgttccttgaactgcaaaaacatatttttagcgacggcttctggccatcggaaaagttcttcgccgccaaggtcgaagagcagaacgtccgtcatcagcgctatcatggcacaagctataacctcgagccggacgtgaaaagcagccccggcggcttgcgcgatatccatacgctacagtgggtggctcgccgccatttcggcgccacctcaatggatgagatggtcggcttcggctttctgaccgaagccgagcgcaatgaactcaatgagtgtctgcatcagctgtggcgcatccgtttcgcgctgcatctcgaactcacgcgctatgacaaccgtctgcttttcgaccgccagctcagcgtggcccgccggctaggctatgaaggcgacggcaaccagccgattgagcatatgatgaaggacttcttccgcgttacccgccgggtgagcgagctgaatcagatgctgcttcagctgtttgaggaggctatcctcgccctgaccgaggatgaaaaaccacgcccgatcgatgatgatttccagctgcgcggcacccttatcgatctgcgtgacgacacgctgtttattcgcgaaccgcaggccattctgcgcatgttttatatcatggtgcgcaatagcaccatcaccggcatctactcaacgacgttgcgccatctgcgccacgcccgccgtcatctcacccagccgctgtgctatatcccggaggcgcgcacgctctttcttagtatgctgcgccatcagggggcggtaagtcgcgggctgctgccgatgcatcgccacagcgtactgtgggcctatatgccgcagtggtcgcatatcgtcggccagatgcagttcgacctgtttcacgcctacaccgtcgatgaacacaccgtccgggtgatgctcaagctggaaagctttgccaaagaagaaacccgcagccgccacccgctgtgcgtggagctgtggccgcgcttaacgcacccggagctgatcttaattgctgccctgttccacgacatcgccaaagggcgcggcggcgaccactcgatcctcggcgcgcaggatgtgctgaagtttgccgagctgcacgggctgaactcgcgcgaaacgcagctggtcgcctggctggtgcgtcaccacctgctgatgtcagtcaccgcccagcggcgcgatattcaggatccggaggtgattaagcagttcgccgaggaggtgcaaacggaaaatcgtctgcgctatctggtgtgtctgaccgtcgccgatatctgcgccaccaacgaaaccttatggaacagctggaagcagagcctactgcgtgaactctatttcgccaccgagaagcagctgcgtcgcggcatgcaaagcaccccggacatgcgcgaacgagtgcgtcaccatcagctgcaggcgctggccctgctgcggatggacaatattaatgaagaggcgctgcatcagatctggaaccgctgccgcgccaactatttcgtgcgacatacgccgacgcagctcgcctggcacgcccgcaacctgctgcgccacgatctgaataagccgatgatcctgctgagctcgcaggccacccgcggcggtacggagatttttatctggagcccggatcgcccttacctgttcgccgcggtgtgtggcgaacttgaccgtcgcaacctcagcgtccacgacgcgcagatcttcaccacccgcgacggtatggcgatggatacctttatcgtccttgagcccgacggcagccccctttccgccgaccgccacgaggcgatccgccaggggctggagcagaccatcactcagcgcagctggcagcctccggccccgcgtcgtcaggcggcaaagctacgccatttttccgtggacaccgaggtgaatttcctgccgacccataccgaccgaaaatcgtttctggagctgatagcgctcgaccagcccgggctgctcgcccgcgtcgggcaggtgttcgccgacctcgggatatcgcttcacggggcgcgaattacgacaattggtgagcgagtagaagatttatttataatcgccaccgccgaccggcgtgcccttaataatgagctgcaacaagaagtgcaacaacggttgacagcggccctcaatccaaacgataaagggtgacgtattttttttagtaaatggaaagaaacaatgcagcagttacagaacgttattgagtccgctttcgagcgtcgcgccgacattacgccggctaatgtggataccgtgacccgcgaagcggttaaccaggttatcgcccttcttgattccggcgcgctgcgcgtcgctgagaagatcgacggtcagtgggtgacgcatcagtggctgaagaaggcggtactgctctctttccgtattaacgataaccaggttatcgatggtgcggaaagccgctacttcgataaagtgccgatgaaattcgctgactacgacgaagcgcgtttccagaaagaaggtttccgcgtggtgccgccggccgccgtgcgccagggcgcgttcatcgcccgcaacactgtgctgatgccgtcctacgttaacatcggcgcctacgttgacgaaggcaccatggttgatacctgggccaccgtcggctcctgcgcgcagatcggtaaaaacgtgcatctgtccggcggtgtcggtatcggtggcgtactggagccgctgcaggcgaacccgaccatcatcgaagataactgcttcatcggcgcgcgctctgaagtggttgaaggggtgattgtcgaagaaggctccgtcatctccatgggcgtttacctcggtcagagcaccaaaatctacgatcgcgaaaccggcgaagtcttctacggccgcgtaccggctggctcggtggtggtctcaggcaacctgccgtcgaaagatggtaaatacagcctgtactgcgcggtgattgtgaagaaagtcgatgccaaaacccgcggcaaggtcggcattaacgagctgctgcgcaccatcgactaaagcaaataaaaagcgggagatatcccgctttttttatatttgatgctggcgaaaatggattttttcgttaattattcaatggttatgatgctatcaaaggtaccgttatgtacgataatctgaaaagtcttggcattaccaaccctgatgagatcgatcgctatagcctgcggcaggaagctaacaacgacattctgaaaatctattttcagaaagacaaaggcgaattcttcgccaagagcgtgaagttcaaatatccgcgtcagcgcaaaaccgtcgtcgccgacggcgtcggccagggctacaaagaggtccaggagatcagccccaatctgcgctacgttatcgacgagctggatcagatctgccagcgcgatcgcactgaaatcgatctcaagcgtaaaatcctcgacgatttacgccatctggaaagcgtggtcaccaataagatcagcgaaatcgaagccgatctggaaaagctcacccgtaagtaagagcatcccggcggcgcgttgcctggccgggctggtggtctctatccactccagacagcatgcatcgtccaggccgggtatggcgcgtcgctacccggcatttttttgcctccacgtcttagcgttgttcgtccagctgcagcgcgatatacagcagcagcctgtcgtcaaagctaccgagatccaggccggtcagctccgagatacggttcaaccggtactccagcgtattgcgatgaataaacagcgcctttgacgtcgccagcggctgcacgttatggcgaaaccacgcctgcagcgtccgccgcagcagcccgttgttgtccatggccttcaaacgcgccagcggacgggccagctcattggcctgccagccgccgcgcaggctgtcgagcagcaccggcagcatcagatcctgatagaaataactgcggctctccggcatccgctgcttgccaaccatcattgtcgtccgtgcggtacggtaagagcgggcgatacttcctgggccggtgaagaagttgcccagcgccacgcgaaagcgcagctggccattctctttcatcctggcgataagctgctcgacgcgccggacgtgatcgtcagcgtcccagcggccaaagctgttcagcgccggtttcagcaccaccatttccgtgagcgagacaatggccaccagattattgcgatcgggggtggtcagcgcgttctgtaactgttgcagttccgccatcgcgctgtccacgccgagctgaccgctgtctacctcaatcatcgccaccacgcgcggctgattgagatcgatgcctaaacgctgagcccattcgttcagcgccggggtatgctcttccgcctgaatcaggttcatcaccagctcttcgcgcagacggctgtcctgggccaggagatgcatcagccgcgactgctccagcatcatctctgctgtcatgcacaccagctcgccatattttcgcagcgactccggctcgccggtcaggccgatcaccccgacgatctccccctccaggcgcagcggcaggttaatcccctggcgaaccccgtgcagatggcgagcgaccgcgtcgtcgatatccaccacccgcccctgggagaggaccagcagcgcgccttcgtgcaattcaccaatcctttcccgatcgccgctgccgatgatccgcccgcgggcatccatcacgttgatattggtatcgatgatgcgcatggtccgcgccacaatatcctgcgccattttggtatcaagatgccagccagccatgtagtcctcccctttgctgggcaccagcataaaagagtcatcgtcgcgctgcattgtgcatttgcactaagccggggtgagatatgtggagttgtgggggcggtcacagaacgaaaaaagcccctgccctcggcgagggaaggggctgggaagcgagcgctggcggttactgcaacagcagatagatagaggcgtcgccgcgctgaatgttcagcgccagtacggacggtttggcgtcgaagattttccgcagatcggcgatgtttttcaccggctgctgattcgccccgacgatgacgtcgcctttcttgaggccaatctgtgccgccggggtaccggctttcacattattgaccaccacgcccttatcctgacccttattgctcatttccgccccttcaatcccgttgaagatggtgctggagtcaacctgggtctggttgctctgctgcagttcgacggtcacggtcaccggtttgccgtcgcgcagcagaccaagctcaactttgctgccgataggcatggtgccgacctgggcacgcaacgcggcgaagctgctgatcgctttcccgttgagggaggtgatgacatcgccggctttaatgcccgctttcgcggccgccgaacctggcattacctggctgacgaaggccccgcgctgggcatcgactttcatcgctttcgccagctcagagttcagttcggtgcccataatgccgagctcaccgcgtttcacctggccatatttcaccatctgctcggtcaggtttttcaccatgttgctcgggatagcaaaaccgataccgatgttgccgccgtccggcgccagaatggcggtgttgataccgatcagctcgccgttgaggttcaccagcgcgccgccggagttcccgcggttaatcgccgcatcggtctggataaagttttcgtagttttccacgttgaggccgctacggcccaacgcggagacaatcccggaggtcacggtttcgcccagaccgaacgggttgccgatagccacggtgtaatcaccgacgcgcagcgcatcggagtcggcaagcttaatcgccgtcaggttttttggctcctgaatctgaatcagcgcgatatcagagcgcggatctttgccgacgactttggcatcaaacttacggccatcgctcagctgaaccttaatcgtggtggcgttgtccacgacgtggttgttggtcaccacataccctttggcggcatcaatgatgacgccggagcccagcgccataaatttctgctgctggccgccgtcaggctgaccgccctgtccgccgccctggcaaaacggcgaactctggaaaggagaaccatcctggcagaacggcgaattatcgccaaagaactgctggaagttgcgtggcatccgtggagtattaacggtggtgctaccttcaacgttaatgctcaccaccgacggcatcaccttctccagcatcggggccaggcttggcatctgctgtgcattagtggccgaagatgccgtttctgccgcgctcgcagagagcggggacaacgccagacctaaactcagagccagtgcactcattgctaacgtggtttttttcatcagtttcaatctcaatatcaggtaacgaaagttgctgtgtacgtgactatcagagtcattttataacgctaagttccggaattaagtttctggaaaaagtaaaaatttattgtccatctttacaaaactccagcctattccaccgccatgagacgccgatattcatcccacgcatacaaatccgtcatcccgctgatatagtcctgaatcagacggcagcgataatagtattccatcagcgcaaattcgggcgccgtacgcgccagtttatttaccgcttcaacataggccagccggtgacgggtcgaaagtttctgatacagccgggaggcaatgggtaaacgtcgtacccgctcctgcgctactaattcgctgaaatcctccagcgataatttcagcagcggctgatagatatccaacaggccgctgatcacccggtagccctgcaattccagctgctcaacatccggatggctaaagacctgtttcatcgccacatttttatagagctccagtagctgactgcaatcgctgtcgtcctccagcaacgcatgattaaagtcccccgtgaagattgccggcaggttgtcaataaatcggcgcgccgcgtagggcaccagcttattcagcgtattcacccgcaaatacataaaaaactgatcttccgcgctctgcttcagataattagctcgcgatttctcccaggcattttctactacctgcgaaaataacgagcctttttcatgactgccccaggcgtcgtaaagatgctgatagagctgttctgcgctaaaaatacgtttttccaccgcgtcctcgagatccgcgacgcaatatgagatgtcatccgcagcctccataatccaggttaatggaaaccgattgtaaggcgcgagatccagttctttacgcaaacgcgcgacatactcttcttcggctaaataatagccaggtttcttcattaaataactgtggctggccggcgtctcctcagaccaccacgccggacgagtatatttcaggatacatcccacctgcgcccaggtcaggttcatacgcattagcgtatggaccagacgaatgccctgcgcgttgccctcaaagctgcagagatcctggcgcactttacggcgcagcgcattaagcgatgtctctccgtcatgcaggcgtaaggcctgcacttcgcagcgatcgtcggtcagcggctgcccgagcgcatcgccgggcgccaggcgctgacggaaccagtcgttaatcgccgcttcgccaaaatggccaaacgggggattgccgatatcgtgcatcaggcaggccatctccaccacgctctcgaatggcccggtcagctcttccaggccatactcttccagcagcctcagctctttcagccggctcagcacctctttggcgatatagcgccccacctgctgcacctccagcgagtgggtcaggcgagtgcgcaccgccgcgttgcgctcgagcgggaagacctgagttttttgctgcaggcggcggattgccggcgagttgacgatccgtccccgatcgctttcaaagatccgcaggatgtcgcgctccgtctccacccgcggcggcgaacggaagcgtcgacgccagtttatcttgttgcgaaaatcaatctttgccatagcctctcccgcgcgagcaatacgcttccccttaagcgcatgatagactatgcaactaaacctgacacatcgcgagtaaatctatgaaaattggcattattggcgctatggaagaggaagttacccttctgcgcgacaaaatcgaaaaccgccagaccatcaccattggcggaagcgaaatctataccggccaacttcacggcgttgacgtcgctctgctgaagtctggtatcggaaaagtagcggcggcgatgggcgcgaccctgctgctggagcgctgccagcctgacgtgatcattaataccggttctgccggcggcctggcgtcgacgctgaaggtcggcgatatcgtcgtctccgatgaagcgcgctaccacgacgccgacgtcaccgccttcggctatgaatacggccagctccctggctgcccggcgggttttaaggcggatgaaaaactggtggccgccgcagagagctgcattaaagcgttagatctcaacgccgttcgcggccttatcgttagcggggatgccttcattaacggctctgtcggtctggcgaagatccgccataatttcccgcaggcgatcgccgtggaaatggaagcgaccgccatcgcccacgtctgccataactttaaggttcccttcgtggtggttcgcgctatttccgacgtggccgaccagcagtcccacctcagctttgaggagttccttgcggtcgccgccagacagtccaccctgatggtggagaatctggtacagaacctggcacgtggctaagtcgctatccttcgcgcttgccgcgctgctgttactcgccccggcgtggctgctggccgcgccgcgggtgatcaccctcccccccgccaataccgaactggcctttgccgccgggatcacgccggtcggcgtcagcagctattccgattatccttcgcaggccaaaacgatcgaacaggttgccagctggcagggaatgaacctggaacgcatcgtggcgctcaagccagacgtggtgctggcctggcgcgggggcaatgccgaacgccaggttaaccagctgcagtctctgggtattcacgtcctgtgggtacagacctcgaccatagaagagatcatcgctaccctgcgtgagctggcgcagtggagcccgcagccggaaaaagcacagcaggcggcgcaggcgatgcagcaggaatacgatgcgttgaaagcgcgctatgccaacgcgccgaagaaacgcgtcttcctgcagttcggctccgcaccgctgttcaccagcggccccggttcgattcaggatcaggtgctaaggctttgcggcggcgagaatatcttcgccaccagccgcgttccctggccgcaggtgagccgcgaacaggtgctggcccgccagccgcaggcgatcgtggtcaccggggatgccagccgcattgccgaagcgcagcgcttttggcaacatcagctcaccatttcgttgattgcgttacacagcgactggtttgaacgcgccggcccacgtattatcctcgccgccaaacaactttgtgcggcgcttgaccaggtaaaataatcatccggcacaccggatgttcagtgggaatcaacgatgcttgtctattggctggatattattggcacagctgtcttcgcgatctccggcgtactgctggccggaaaactgcgtatggacccattcggcgtgctggtgttaggggtagtgacggcggtaggcggcgggaccatccgcgacatggcgctggcgaatggcccggtattctgggtcaaagatcccaccgatctggtggtggcgatggtcaccagcatgctgaccatcctgctggtccgccagcctcgccggctgccgaaatggatcctgcccgttcttgatgccgtcggtctggcggtgtttgtcggcattggcgtcaataaagcttttctcgctggcagcggcccgctggtcgcggtgtgcatgggggtggtgaccggcgtcggcggcgggattattcgcgacgtgctggcgcgggaaattcctatgattctgcgtaccgaaatctacgccaccgcctgtatcgtcggcggtattgtccacgccacggcacacgacacctttcatctcccgctggagaattcggcaatgatggggatggtggtcaccctggtaattcgtctggcggctattcgctggcatctgaagctgccgacgtttgccctggacgataacggtcggtaataaaagcaaaacggtaaccttaaggttaccgtttttagggtttgctccctcccgctgggggagaactcgctttaaacgctgaacgaggagccgcagccgcaggtgcttttcgcgttcggattggtcacgataaagcgcgaaccttccagcccttcggtatagtcgacagagccaccgaccagatactgcaggctcatcgggtcaaccaccaggccgacgccctgtttctcaatggtcatatccccttcgttcacctgatcgtcaaaggtgaagccatactggaaaccgctgcaaccgccgccggtgatatacacgcgcagtttcaggttcggattatcttcatccgcaatcaggtgttttactttattggctgcggcttcggtaaactccagcggcaacgctacgtcatcactcattttctgctcccattgatacttccggccggttaaagaataaccggaccttttgagccattatctaataccctggtaaatcgttcaagtattctcccggggagcctgctgcgcttttgccgcctgctcggcttcctgcttcgccagagtacgctgcagaatggtcgaatacaaaggcttaccgccgaggaattgcgccagtagtgttgcgccaaggcaggtaataatcattggcaaaatgagctgatagttatcggtcatctcaagcaccagcacgatcccggtcagcggcgcacgcaccgaggcggcgagcagcgcccccatgccggcaatcgcgaaggtgcccgcatcgagatggtaggccggaaacagcggaatagccgccatgccgaacgccgtgcccagcagcgtgccgagcgccaacataggcgcgaaaatgccccctggcgcgccggaagagaagcagatcagcgtggtcaccacgcgggcaataaagataaacagcagcagtccgacggagaagttaccggcagcggcgatagggatcaagttaaagccaccgcccaccgcggagggctgcatcagccccagcagaccgcagagcccgccgattaatccgccaatcaacacccattttttgatgttgccgccgtggatgcgctggaacagatcctgagtgcgcagcaccagaaaattaaacagcgggccaaagcagccaaacagcatgcccagcaccagatacagccatagggtatttaccggggcgttgcttagtttacccacctcaatgatcgccgcttcgccgttgaaaatgcgaaacacaatgctcgacatgatcacgccggtaaacaccgctttaatggagatcaggttgtagcggaactgcgggcgcatctcttcgatgataaacagaataccggccagcggcgcattaaaggccgccgaaagccccgacgccgcaccggtcgccaacagcgtatgccgcgcttccggactgcgcatgcggaaaacgtccagcaccatgcgcccaatgttgccgccaagctgtaccatcggtccttcacgacccagcaccatcccggcgccaagggtccccatgccgccaacgaatttcaccggcagcacgcgccaccagcgcaccggccgcagctcctccagcgcgccctcaatttccggaatcccggagccgccggcctccggcgcaaagcgacgcaccagaaaatagccgaccatcgccagcagcgccgacaggataaacgccagcggccagaccagataccagtggtccgccacctgcgccagcgcgccgatccgctggttctgcacccagttcacgctcttttcaaaggcgacgcccaccagccccgccagcgtgccgaccactgccgccataaacagcaccgccagcggcgttttatcgcgttgaatcagacggcgcaccgcatcgccgcgacgcacccgcacaaactgatgtgcttcaaaagagggagtttctgctttcatgccgttatcaattattggtaatacaaatgaagagagcggcattttagccgtcccggcgcgctgcgtcgtcaaaaaaatgcccttgcggcacattgtttcaattgggcaaaactttcataaccatcctggaataacttagaatagccgataaaacatttttcacgaaccaggaccctggccatgagcaaatctgaaaatctgtatcacgctgcgcgcgaactgatccccggcggcgttaactcgccggtgcgcgctttcaccggcgtcggcggcacaccgctgtttatcgaacgcgcggatggcgcttacctctatgacgtggatgggaaagcctatatcgattatgtcggttcctggggtccgatggtgctgggccacaaccacccggctatccgcaatgcggtgatcgaggcggcaacccgcggcctgagctttggcgcgccgaccgaaatggaagtgaaaatggcggccctggtgaccgagctggtgccgaccatggatatggtgcggatggtgaactccggtaccgaagcaaccatgagcgccattcgcctggcgcgcggcttcaccggtcgcgacaaaatcattaagttcgaaggctgctaccacggccatgccgactgcctgctggtgaaagccggttccggcgcgttgaccctcggccagccgaactcgccgggcgtcccggccgatttcgccaaacataccctgacctgcacttataacgacctcgcctcggtgcgcgcggcgttcgagcagtatccgcaggagatcgcctgcatcatcgtcgagccggtggccggaaatatgaactgcattccgccgcagccggaattcctgccgggcctgcgcgcgctgtgcgacgaatttggcgccctgctgattatcgacgaagtgatgaccggcttccgcgtggcgctggcaggcgctcaggcttactacggcgtggagccggatctgacctgtctggggaaaatcatcggcggcgggatgccggtaggcgccttcggcggccgccgtgaggtgatggacgctctggcgcccaccggtccggtctatcaggcgggcaccctctccggcaacccgatcgccatggcggctggcttcgcctgcctgaacgaagtggcgcagccgggggtccatgaaaccctgactgaactgactaaccagctggcgcaaggcctgctggatgcggcacgtgacgccgggatcccgctggtggtcaataacgtcggcggcatgttcggcatcttctttaccgatgccgaaaccgtcacctgctatcaggacgtggtgaagtgcgacgttgaacgcttcaagcgcttcttccatctgatgctggaggaaggcgtgtacctggcgccgtcagcgtttgaggccggctttatgtccgtggcccacagcgaagaagatatcgacaacaccatcgacgccgcgcgccgggtatttgccaagctgtaaggtgcttgaatgcctggtggcgcagggattttcccggaggaggcgcattgcgccttatccgggctaccaaatcgcacagcgctgtagccccggtaagcgatagcgccaccggggatgttgaagccatccaggaccgttagcgactctgctttctcagcaaataaataaagtaaggcgcgccgataaaggtcgacagtagccccgccgggatctgatacgggaacatcatcatccgtccgcaccagtcggcgaagaccagcagcagcccgccagtcagccctgaaatcaccatatgcggtagggttcgccggaagcccatcatccgcgcgatatgcggcgccatcagcccgacaaagctcagcgggccgatggtcagcgtcgccgccgccgtcaggcaggccgccagcagcagcagaacaatccgcgatgacgtcagcgccatgcccaccgctcgcgccgcctccccgcccagcggcaggatggttaaccagcgacgacagagcggcgccagcgccagcagcgccagcattaccgcgccgctacgcactaccctctccggcgtcgcgctatatgtcgaccccgagatccacgtcaggatctgcgccatacgcggatcgccgctggcctgcagcatcatcagcagcatagtgaaggcggtgctcagcgccatccccgccagcagcatccgatgcggcgagaagccgccgcgcccggcggcgagcataatgatcagcaaggtggccgccgcgccaaggctgccggccggcagcagccagccaaaggcgtcgccaggcacgaagaacagcatcagcaccacgccaaaagccgcgccggagctgatgcccagcacttccgggctggccatcgggttgccggtcaggcgctggataatacagccggcgaccgccagcatgaccccggcgaacagcgccgacagcacccgcggccagcgccagggcagcagttgctccagcagatcgccgtgggcccacagccagccgtgggcatcgcgaccaaaggccagcaccacgctcaccgccagcagcagccacgcgacgcctgcgagaacaaaccattgcacatgatagcgctcaggctgcacattatcgccgccgttcatcaccggggcgctgatgctgcgcaaccgcggcagcagccacagcagcagcggcgcgccaatcagggcggtgaccgagccggtggagacttcccgccatacccggctcagccagaggatcacctgatcggaaagccacaggagcagcgcgccgatcagcgccgccagcagcagccgcgccagcagccgacgggcgccaagcattttcgccagcagcggcgcgaacaggccgataaagccgataatccctaccgcgttcaccagcagcgcgctgatgacgatcgccagcgtcagggcgccgaggcgcgccagggacagcgccagcccgaggttacgcgccaccccgtcatcgagccccatcagggtcagcggccgcagcagcagcaaggtgagtattgccccgccaagcagctgcggccacaggcgctgcgccacgctccagtcggtctgcgtcagcgtcccggtgctccacaggaacatgctttgcagctggtcgtgatggaaaatcaccatcagctggttaagcgcgccacagtaaaggctgaccaccagccccgccaggatcagcgttaccggcgacaggcgcttgccccacgagacgccaaacaccagcgcgcccaccagacaggccccggccagcgcggcgaattgcgacgccagcacgccgggaatagcccataacgtggtgaccgttatccccagctgcgcgccggtggcgacgccaagggtggtcggttccgccagcggattacgcagcacctgctggaacaggacgccaaccagtcccagcccggcgcccaccagcagcgcaacagccagcctcggtaacaaactgtaatgaaacagcatttgggcgatatcatcgacatccggctgccacagcgcctgccgccactgcgcatagggcaaggcgacattgaggttgacgatgctcagcgcgaaggcgacgcccagcagcccggccagcaggataatagctaacggcgagagacgcgtattcatgccggactcccctgggcatcagccagcacgcgggcaaaatgcatcgctgacagcgtcgcgccgtagaaccagaccgccggaacgcgctggaagcggcccgcgcgcacgaagggcatcgcctgccatagcggcgtcgccagcagttgagccatatctcgctcattgccatggtcgaaacagatgacatcggcttcgttaaatgccgccagcctgtcgatgccaacgctaacgcttccccagaatgccgcttcgccgtgccaggcgtttttaataccaaagcgatcaagcacctcctggaacaggcagttttcgccaaacaccagcacgtgccggggatcgagcagagagatcatcagcagcggacgatcgccgcgcccggcaaaacgcggacgcaggctctccatcagcgcgtcgaactccgccagatggcgcttcgcctgctgcgttttgcccagcagatcggccatttccagtagcgaacgctgggccatcgccagcggccgtttgccgtcgctgaaggtgaaaccgcggccgggcgcgatacgcgccagcttctccggcgacgggccgtagcccgccgaccagacgataaacgacggtttcatctgcgtcagcagttcaaggttgggttcggtacgcagaccaacatcgatcaccgagtcgggcagcgcgggttcgttcacccacaagcgatagttgggaatatcggccacgccatagggcgtcacgccgagcgccagcagcagctccgcgggcagccactccagggcgaccacgcgctgcgggtcgacgtcggccgcctgcgcgccgcgcatctgccacagcagcggcgagagcgccatcgcgatcagcaggcggcgtcgggttatcagagttgggttcatcatcaatagacaaagcttaccggcgccgcaccggccgggtgtggcaggatccccatcgggatgccatagatctgttccagagtgtcgctgcgcatcagttccgccggcgtcccctgagcaatcatttctccgccgcgcagggccaccagatagtcgcaatagcgggccgccatattaatatcgtgcaggacggcgatcaccgtcaggccgcgctgctggctgagacgatgcaccagcgccagaacatcgacttgatgagcaatatccagcgccgaggtgggttcatcgagcagcaggcagcgactgtcctgcgccaccagcatggcgatccacgcccgctggcgttcaccgccggagaggctgtccaccagacgatgagcgagcggcttcagccccaccagcgcaatcgcctcttctactttctcacggtccgctgcgccaaagcgacccagcgcgccgtgccatggatagcggccgatcgccaccagctcgcgcaccgtcataccttcggccggcggcagctgctgcggcagataggccactttgcgggcaaaggctttgctgccccagctctccagcggctgcccgtccagcagcacttcgcctgcggagggcggctgatgacggccaagcattttcagtaacgtcgatttgccggagccattatggccgatcaggcctgtgactttcccggacgggaaggtgagcgagagcggatggagcaatgtgcggccaggcacacggaaagtgacgcgatccagcgcgaaggtggtttctgcgtgcggagtctgttcctgcatagcgataacctgatagagggcgcggcgaaccgcgcccgtaggtggttagaaacggaaggtggcggtggcgacgacctgacgtccggcgccccagtagcaggcgtattcgctgtagcaactggagacatattcgcggtcgaacaggttgttgacgttgacgccgaccgacgatcccggcaggccaaagcgcgccagatcgtatttcaccgtcgcatccatcagcgcataaccggccacactaaaggcatcatttttcttaccggtgctggtgtcatttttgtagtagctgaccgttgaaccgatatagcgcgccccggccccaatcgtcagaccactcagcgcggtttcgtggaaggtataatccgcccacagggaggccatgttacgcggcacttccgccggacgtttgccgttgaacaccgtatcgtgagtgtactccgcatcggtgtagctgtaggctgcggtgacgttaatattagcgttcaccgccgccttcgcctccagctcaaggccgcgggagcggatctcgccggtctggatgctgaacgcctggttagccggatcagccgtcaggttcttgtctttggtcagctgatagaccgccgcggtgaccaccaccggcatatctttcggcacgtatttcacgccggcttcatactgcttaccgcgcgacggatcgaacggctggccgcggctgttggaacccgataccggttcaaacgattcgctgtagctgaagtacggagagatgccgttatcgaacaggtagttgatgccgccgcgccagctgaactgctggtcgtgattctccgccaggctgttggtggcgcgggttaacgttgaggtcgtggcgtaatcgtaacggccgcccagggtcatcacccatttatcccactccatctgatcctgcgcgtacaggccggtctgctccatccggttgaggaccgcgtacgggaaggtgacctgaatattcggattgccgtactgcggattgctcatgctgataggatccgccgtcccgtagtcggcatccacatcgttacgcatccgcgagtagtccacgccggtcagcagcgtatggctgaccgcgccggtggcgaaatcagactgcagctgggtatcgacggtgaaggtgttcaggtgctcgtcggagcgcacgtaggcgcgattcatgtagcccggcgcgacatagccgttgccgtataccgaacgatagagcgtatgcacatcggcatagcgcaggttctgccgcacggtaaaggtgtcatcgaactgatgggagaagctgtagcccaccatcttctggcggcgggagattttattatcggactcgccttcgttgaaatcggtcggcagcttgtgcgccttaccgttggcgtcgtaatacggcaccacggtgccttcgcgcggcagccagccgtagtagcccgcatccgggtcattctggaagttgctcaggaaggtgaagtcggttttatcgtccggacgccagctaaaggagggcgccaccgcgtagcgagtcgatttcgccatctgctgctgggcatcctgactgcggccaaggccggtcaggcgatacgaccaaacgccggcatcatcaatggcgtcgctaaagtcaaacccggtctgccacagattgtcggtgcccatcttaaactgcacttctttcagcggctcggtagtcgggcgcttgctgaccatgctgacgataccgcccgggttgctgttgccgtacagcaccgaggttggcccgcgcatcacttccacacgctcgaggaagtaaggatccatggagacttcagagtagttattcccctgcagcttcatgccgtccagatactggttggtgttgacggtcgtcgaggtggtgaagccgcgaatggtgaccacgtcataggtggtcgaactgccgcgagtggagaagacgctgggcgtataggagagcgcctcttttaccgtcgtcggctggcgcatctccatctcctggcgcgtcaccaccgacacagactgcggcgttttttcaatcggggtatcggttttggtcgccgtggcggagcgttttgccgcgatagtcggcgccggtccccaggcgctttcctgggcggccggggcggcaacgacggtgatggtttcttcttgcttcggttgttctgctgcctgtgcgtagacagacatgccgctaaccgccgtggctactacagctgcgactttacgcagcgagtgatttggctgagcagtttttggacgcgccatgggtatatctctgatgaaagtgaatgataacgtaaacgagaattattattatgacgggcgatataataggcgaaacgtcgaaggcaaggcaagcgatatgcctgtcgccgccggtcgaaggctgaattaataaccagatagttattatggagttaaagagccgttaacttttttacaggcataaaaaaaccccttaatactttcgtattaaggggtctggtcgtgcggtcaaaatcagttactgccgaacatatccttgatccagcccgcgacgccgtcgctcttttcctgctgcttcggcggctgttgctgctgttgctgttgctgctgttgctgctgttgctgctgttgctgctgttgctgctgcccggactgattaaacggatttttcgcttcctgttgctgcaactgctgctgttgcatcatttcgccctgacggcacagcgcatccggctgcgtggtccagaccggcagcgaacgcataccaccgctgcagacgaagttgccgttgctgtccacgcccatatcaaccacgtcttccggcaccgtcagcaccagcggcgttggcgtctggttcgccagatagcgctggtaaatcgacatcgcgccgctggcaccgtacagtttggtcggctggttattgtcgcgccccacccaggtgatggtcacctgactaccgtcgatgccggcgaaccaggtatcgacgttattgttggtggtcccggttttccccgccagatgcaggcccggatacttcgcccccagctgacgccccgtaccgcgctgcaccacctgctgcatagtccacagcgtcatgtaggccgcctgggcaggcaccgcgcgctccgcctgcggatagctctggtagagcacagtgccatcttcggcaatcactgaccgcagcgcggaaagcggcgcacggttcccaccgctggcgatggtctggaaggcctgagccacttcaatcggcgtcaggttcagcgcgccaagcagcatcgacggcaccgcgttgagctgattcttcggcgcccccagtttagtccaggtatcgactaccgccggcaagcccagcgccatcccgaggttaaccgtcgggacgttcatcgagcgagtcagggcatcgaccagcatcacctgaccgctgaaacgacgatcgtcgttctgcggggaccacgtctgaccgttggacaggcgaatcgtcaccggcgcatcggcgatccaggtattcaggcgatactgattcggctggctcagcgcggtcagataggtcgccggcttggccagagaaccaatcgatcggcgggcctgcatcgcgcggttataaccggcgaactgcggctccgcgccgccgaccatcgcccgcacttcgccggtgaagcggtcaaccaccaccatggcggtttccaggtctgccagcttacgctgtttcttcagaaccgggatcccttcggaggccgctttttccgccgcatcctgcgccaccgagtcgaaagtggtgaagatcttcacgccggagagatctttcactttatcgcccagcttcgcctgcagttcctgacgaaccatctgcataaacgccggctgcggtgaaatcactccgccgcgcggctgcacgcccagcggacgggcgctgagcatgtcgtacagctcctggtcgataacttgctgctgctgcagcagacgcagcaccagattgcgtcgttcaagggccagtttcgggttacgccacgggttatagaccgacgcccctttcaccatccccaccagcagcgcctgctggtcgaggctcagctcttccaccggacggccgaagtaatacaggctggccagcgggaagccgcgaatttcgttatcgccgctctggccgaggtacacctcgttcatatacagctcaaggatgcgatccttgctgtagcgggcgtcgacgatcagcgccatatacgcttcgttggctttacgccagtaggagcgttcgctggagaggaacaggtttttcaccagctgttgggtcagggtactcgccccctgcaccgttcggcctgccgtcaggttcgccagcaccgcgcggccgatggagtagagactgatcccatcgtgctcatagaagtggcggtcttcggtcgccagcagggtatccaccagcagatcggggaagccgctgcgcttcacgaacaggcgctgctcgccgttcggcgactgcagcatggtgataagacgcggatcgaggcggaagaaaccgaactggcggttattatccatattctcgatggtctcaagatggtcgccgtcgaaagtaagacgcgcgcgcacctgcccttccttactgtccgggaaatcgaacggacgacggatcatctcgatgctgttagcctgcacggtatattcgccggggcgcgtcatcgcgctgacctggcgatactgcgtggcgttgagcagacgcaccatctcgtttttgctgatctgcatgtccggctcaaggttgaccatccggccatagaccgcggccggcagctcccagactttaccgtcaatgcggctgcggattttctggtcgaggtagacgccataggcggcaatcagcaccgcgaagacaatccccagcttgaccagcagccacagccagctgcgcttccgacgaggcttgccacctttgcctttggcttttctcggcaccggtttctcatcctcataatcatcgtcatcatactcatcgtcgtagtcctcttcccggacccggcgacgggtgactttctgtttagtcggacgtgagggtcttcccttacgtccgataggctcgcggtcatctcccgccatgctttttctccgcaacgttcaggcgcaaaggcctgattctcaatacttcccctgttcagaggaagaagaaatctctcaaattaacgtccaggctgcttatccttcggacgacaacctgctggcaggcaggacgcgccgccagcctttcagagggttggtttgcttcatgttacatgatactaacaataaaaattcaccataaaatcattgtgttaaacgcatcatcggcagaataagtcagaacatagcacgtaatgttcagggcatacaggatagcactaaaatgcgacattcttaaccagcattttacctcctgcgcacgtaacaagatgggaaagagtatgttttttaataacataaaaaacggcgcgcttcctgccggtcaacgcagtggcatcatccgcggatgaaaatatattttcccagcgccaacgtttattattgataaaagtaaagtcgattaagcgcctttccgttgataaaaatgagagcctgttaacatttatgcagaataatattttatgatgacaccagggaaatatttgttaaactagcggccagtgattcattattttgattactctatgatgcgtattccgcttatatttccgctttgcatggtagcccttctctctggctgccaacaaaaacctgcctcaacgctcagcccggccatcagcagccaggcgcagctcgagcagctctcgtccgtggcggccgggacgcgctatctcaagaataaatgtaatcgtagcgatctccccgctgatgaaacgatatatcgggcagcggtgaatatcggtaaagcgcgcggatggggaaatattgacgtggcgacgttaagccaaaatagcgaccggctttaccaacagctattacaggacagtaccccggaagccacacagtgcagtcaatttaatcgtcagctcgcgccatttattgccagcttgcgcagcgactaagcgaaatatcctcagcgcgccggttattgtgcgcgcttttattcctctttcggctcctcgtcaatttttccgcccggccagtcctccagcgccgcgagggtaaaggtcgtgccgttgaagctgaagatcgtcacatcctgctggatctgctccaccaccagattgggcaggggtgaatcgccctccgtccacgctttgccgtttaacacaatgctgcgcttttccggtagcgaggcatagacatgggcgctgtagcgtagaggcggcagcgtatcgctgtccacttccggcgccgcgggcgcgctggcttttgccgccggcggcggcgtctttggcgcggtctccccggcggcggttaacggcaaaagcgccgcatgagccaccggcagaggcagcgtttgcggcggtgacggatggcgccactgctcgccgccaaaccagccgagcgcgataaataatccggcgtacagcgggataatccagccggggatctgcaccatccgaccgcgactcaccggcgcgtctgcctgcgcggacggcggctgatgcgccaccagcggcgggatgcctctttcactatcatcacgaacaatcacaaccgtctcctgttccctcacggtgcagagaaggcgcccttacgggcgccccagactgctgacaaagtgcattcttcagagattgcccggcggcgctacgctagtgcgggccgacagataaatgcataactgtttgatattgcagtctttcgtaggccgggtaaggcgtaagccgccacccgacagaaaggcgagcacaataacgaaacaggtttgtcatcagccagaggcgcccttacgggcgccccacgttatgttatttactgctcaccggcaggccagcgccctgcgactcgccctgcggcaactcgagaacggcaaccgaccaggccggcagcgtgaccgagccgtcagcggcaacctgcacgccgctcgccagcgaacggtcgcctgccgcctgctggatggcgctcagctggagcgatgtgccggcgaagtcctgcagcgtccggctttccggtgcggcgttgatcgccaccacgatgccgtcgacacggctgtccagactggcgccagcctgcatcccatcatcgatggtcatcaccagcagacccgtctgctgatcggcgccggtgttgcggaagtccacgcgcttcatcaccgtcgcgccgtcaccgagggtaaacagcggagacgatttacgcagcgcggtcagctcctgataaaacgcggtcatctgcttgagctccgtttcacccggagtagccaccgcgtctttcacccgggcgataatgtcatagttgctgccatcatcgctgctgcgcggcataccgacgttgtagttgttgtcctgcagggagtagtccacgcggttaaaccagtcgccggaatcatacgaatcgcgggtaaaggatttagagcgcagcagctccgagccctgctggtcaaaggcgatcccctggccgagcatcaccgtcgccagcgacaccgcctgcatccggacgcgggtatcgagatccgcctcctgagcggctttatagctgatcatgtcccacagcgtctggttatcgtgttttgacacatagttcacgacttccgtcggatcagccgcatagccgcctggcgcgccgttatagtcaatctcgctgcctctcttcaccgcgccgtctttgtcgatcagcacaaagtccgcaaggttaccggccatgccgagacgggtcagatcggcgaggtgacgcgcctgatcgtcggtcagggtggtcagctcattcggcagaacgccggccccgctgcccacgccctggttctggcgtaatgcgtcaccggagtcgaacggcccgccgccgcgcacggcgtcgcgcagacgatcggagaacgtgccgatcccggtgcctttgagattgatttgcgaggcaatttcaaagcgatcgctctggttggaatcccagccttcgccaaagaagtagatatccgggttcagcgctttaatgcgttcccaggccgagaggatctgcgctttcgggtggtagcccatcaggtcgaagcggaagccatcgatcttataatcggtggtccataccgccagtgaatcggcgataagcttggcgaacatccggtgctctggcgccgagtcggagcaacaggtagccgattccacgctgccggtggtttcgttcagacgctggtagtaccaggggacgatcttatccagtaccgaggtgcgatcggtcgggccggcggcgttggtgtggttgtacaccacgtccataatgacgttcattcccagatcctgcttgatcgcctgaatcatggtgcggaactctttaatacgcgccgtgccttccggatcggtggcgtaggatccttccggtaccgtgtagtggaacggatcgtagccccagttataggagtcggtctgcgccaccagcgtattcaacgcctgcacctgcgggttatccttgctgtcgttctgcttcagctgggtcagcacctcttcgaccgtcgaaccgctgtcgcaatagcccgcgaactcgctgctcttcaccgcgctattgacctcgcacaggcggctgaacggctgctgaatatcggcgaccttgtcgctgaactcattgaccgtcgccagatcgaagaccggcagcagctcaatatgggtcacgcccgaggccgacagctgtttcagatgctggaccatattgctttcctgggcggtgagcgccagatacttaccgcgcagctccgcaggcacggtttgatcccaggcggagagatcgcgaatatgcgattcgtgaatcgtcattttcgccagatcggctttggttttctgcgcgtgcggcatcgtcagcccgtcccagccttccggcttcagcgcgctgtcgttgagatcgaccacctggctgtactccgagttggtcgacaaactgtgggcgtagggatcggtcacttcgtactgctcgactttacgcgactgcgggtggtagaccgtcatcgcgtagcggtagaaggcgcccttcaggtcgcttcccccctgccaggaccaggcgccggaggcgctatcgcgggtcatcgggtgactggctatcactttcttgtccgcgctatagatcaccagctcgacctgctgcgccgtgggcgcccagacgcggaaggtcacgccgctatcggttagctgggcgccatagctcagcgcctcggcggcggcggcataggtatcgtccagcacgccggcggtctgcacctgggtggctgagctcaggatcccatcgctttccgcggctatcgccaccgtctcgccctgcagcaattcatcgacgttaacatcatccggcagtttaaaggctggatagctggcgagatgcgggaagcgcatgcttacctgctggctgacggtggtgggggtcagcttgacatatttatcgctaaattcgccgttactgtcggcggccaccttactgctgtggctgtaatagaggcgcacaatgggtttattttccccacccggccacagcagagtagtcttatcgacccagtgcgcatcggccagcgccacgccaaaggcggcgcggaaggcgtcggcgcgggagtcatagaccgcgctgttgccggcgatgaccgataccgtccgatcggtgaaatcactgaaagagacgcgcaggtcgctgtcgataagcttattggtgccatcgcggacgataacgttgatgcatccgctctctttagtcagcgggatcacccaataagggccatatttgtcgctgccggtcggggtggtgctgacatcattccagtccgccaccggcgcgctcagcgcgtcacaggtttcgttgtcccataaatagaggtttttcgtcgcatagtcggccggcgtgctgctggtgatgccggcgatatcgacgagatgaatgacagcttgcctggcggaagcctgcaccgcttcgcctgggacggcaacgtccggtaagcggacgacgacatcctgcgggtcgggcgtgccgggagtgcctgggttgccaggattgcctggtgaacccggtgagccagaggtagaagaggaagagctgttatcacagccactcaataatactaacgatccaagaaatagggcatgacaggtatatctgagcattcgatagtccctaatatgcttattaaattataaaaggtaagaaaggatgaatatctttacagcgcgctaattagatatttttgctttcccaggcgcaatcatcccccacaaatgagcggggggcgtaggaagccgggggagtaaatcaataaagggaatgacgacccgaaaccgcaaactgattatgattcgccacgcttatcgccactctccggcaataaataattcaaaagccaataatcacctacctgtttcggtagggtattacgccaacgtgcagaaaaataaattagcaaaggaattaaaatgccagtttctgtgatgaggttaacaaatataaataaagggataattaaattattaccacaaattgtgacgctcatcatattaataaccgctatcccacagctggcgaaattaacctggcgcgtggtattccctgtgagtcctgaggatatttccgccctaccgttaaccatgcctccgccggcagatccggaattaaaaaatgtgcggcccgcatttaccctgtttggcctggcggtgaaaattagccccacgccaacggatgctgccagtctcaatcaggtgccggtttccagcctgaagctacgcctggccgggctactcgccagcagcaacccggcgcgctccatcgctattatcgaaaagggaaatcagcaggttagccttagcacgggcgatcctctcccagggtatgatgcgcggatcgccgccattctgcctgaccggatcatcgtcaactatcaggggcgcaaagaggccattttattatttaacgacagtcgcgcgccgtcgccgccgcccaccgccgcgggcaacccgcccctcgtgaagcgactccgcgaacagccgcaaaatatcctcacttatttatctatttcgccggtactcagcggcgacaaactgctgggttatcggctgaacccaggcaaagacgcctcgctgtttcgccagtccggcctgcaggcaaatgatttggcgattgccttaaacggcatcgatttacgcgaccaggagcaagcgcaacaggcgctgcaaaatctggccgacatgaccgaaataacgctaaccgttgagcgggaaggccaacgacacgatattgctttcgcgctgggggatgaataattgccaaccatgaaacgcctgcgaaaaatgctgcctgcgctgctgatattaaccccgctgctattttctccggccgccgcggaggaattttccgccagttttaaaggcaccgatatccaggaatttatcaataccgtcagcaaaaacctgaataaaacggtgattatcgatcccagcgtacgcggtactatcaccgtgcgcagttacgatatgctcaatgaagaacaatattatcaattcttcctcagcgtgctggatgtatatggcttcgccgtgatcaatatgaataacggcgtgctaaaagtggtccgcgccaaagacgccaagacctcggccgtgccggtcgccagcgcggccgcgccgggcgaaggcgatgaagtggtcacccgggtggtgcccctgaccaacgtcgccgcccgcgatctcgccccgctgctccgccagctgaacgataacgctggcgccggcagcgtggtccattatgagccctccaacgtactgctgatgaccggccgcgcggcggttatcaaacgcctgctgaccattgtcgagcgcgtcgacaacgccggggatcgcagcgtggtgaccgtgcccctttcctgggcctccgccgcggaagtagtcaaactggttaccgagcttaataaagataccagcaagtcggcgctgccgggctcgatggtggcgaacgtggtggccgatgagcgcaccaacgcggtactggtgagcggcgaaccaaactcgcgccagcgcattatcgccatgatcaaacagctcgaccgccagcaggcggtacagggtaacaccaaagtgatctacctgaagtacgccaaagccgccgatctggtggaagttctgaccgggatcagcagctcgctgcagagcgacaagcaaagcgccaggccagtggccgcgatcgacaaaaatattattatcaaagcccacggccagaccaacgccctgatcgtcaccgcggcgccagacgtgatgaacgatcttgagcgggtgatcgcccagctcgatatccgccgcccgcaggtgctggtggaggcgattattgccgaagtgcaggatgccgatggccttaatctcggtatccagtgggcaaacaaaaacgccggcatgacgcagttcaccaatagcggtttgccgatatcgacggctatcgccggcgccaaccagtacaacaaagacggtaccatcagcagctcgctggccagcgccctcggctcgtttaatggtatcgccgccggcttctatcaggggaactgggcgatgctgctcaccgccctctccagcagtaccaagaacgatattctggccacccccagcatcgtcaccctcgataacatgcaagccacttttaacgtcggccaggaagttccggtattaaccggctcgcaaaccacctcaggcgacaacatcttcaataccgtcgagcgcaaaaccgtcggcattaaactgaaggtgaaaccgcagattaacgaaggcgatgcggtgctgctggagattgagcaggaggtatcgagcgttgccgactcggcctccagcaccagcagcgatctcggggcgaccttcaatacccggacggtgaataacgccgtgctggtcggcagcggcgaaacggtggtggttggcgggctgctggataaaaccgtcaccgataccgctgacaaagtgccgctgctcggggatatcccggtgatcggcgccctgttccgctccgacagcaagaaagtgtcgaaacgcaacctgatgctgtttatccgcccgaccatcattcgcgatcgcgatgagtaccgccaggcttcttccggccagtacaccgccttcaacaatgcgcaaactaaacagcggggtaaagaaagcagcgaagcgtcgctcagcaacgacctgctgcacatctatccgcagcaggagacccaggccttccgccaggtcagcgccgccattgacgccttcaatctcggaggccgcccatgacgccagccgccgaacgccgtccgctgttgcccttcgcctgggcccgcgcgcaccatcttgtgctgctcagcgacggcgaatgctgcgaagcgctgtgccgccccgataccgccgcccgggcgctgctggaagcgcgccgcctggcggacgggccgatgcgcgtcagccgtctggcgccggacgcgttcgagaaagtgctggtgctcagctatcagcgtgattcggcggaggcgcaccgcatgatggccgacatcggcaacgagctcgacctctataccctcgccgaagagctgccggacaccgacgatctgctcgacagcgaggacgacgcgccgatcatccgcctgatcaacgccatgctcaccgaggccatcaaagagaaagcctcggatattcatatcgaaacctacgagcgccatctgcagatccgctttcgcgtcgacggcgtgctgcgcgaaattctgcgcccgcagcggcggctggccgccctgttaatttcgcgcatcaaggtgatggccagcctggacattgccgaaaagcgggtccctcaggatggccgcatggcgctgcgcatcggcgggcgagcaatcgacgtgcgcgtctccaccctgccctccagccacggcgaacgcgtcgtcctgcgtctgctggacaaaaacagcgtcaacctggatctgctgacgctgggcatgccgcccgccctgctcgatcgggtcgatgcgctgatcgcccgcccgcacggcatcatcctggtcaccggtccgaccggctccgggaaaagcacgacgctctacgccgccctcagccgcctcgacgcccgggagcgcaacatcatgaccattgaagatccggtggagtatgagctggagggcataggccagacccaggtcaacgccaaagtcgagatgaccttcgcccgcggcctgcgcgccatcctgcgccaggatccggacgtagtgctggtgggcgaaatccgcgatggcgaaaccgcccagatcgccgttcaggcctcgctgaccgggcacctggtgctgtcgaccctgcacaccaacagcgcgctgggcgccatttcccgtctacaggatatgggcgtggagccttttttactctccacctcgctgctggcggtgatgtcgcagcggctggtgcgccaactctgcccgcactgccgtcagccctggcaggcggatgccaacaccgcccggcagatggcggtcccggtcggcgcgcggctgtggcagcccaaaggctgtccggagtgtaatttcatcggctatcgcggacgcaccgggatccatgaactgctgctggttgacgaccgcgtgcgcgccgccatccaccgcggcgagaacgagatcaccctgatccagcagctggggccagcctggcaaaccctgcgccatgccggacgcgacaaagcgctggcggggatcaccagctgggaggaggtgatgcgggtcaccgaacagcaaacgacggaaagcgtctaagatggccctgtttcgctatcaggcgctggacgcgcagggcaaaacccgccgcggccttcagcaggccgactccgcccgccacgcccgccagctgctgcgggacaagggctggctggcgctggaagtgacaactgccgacccggcgcggcgactgtgggccggcggatcccttacccggcgtaccagcgccggtgatttagccctgctcacccgccagctggcgactctggttgccgccgggatcccgctggaaaaggcgctcgatgccgtcgcccagcagtgcgaaaagccgtcgctaagaacgttaatggccggggtgcgcagcaaagtgctcgaaggccactcgctggcggaggcgatgcgcggctatcccgcctgcttcgacgggctgttctgcgccatggtggcggccggcgaaacctccggccatctcgacggcgtactgaaccggcttgctgactataccgagcagcgccagcagctccgcgcccgcctgctgcaggcgatgatctaccccatcgtactgacgctggtcgctatcagcgtgatcgccattctgctctccaccgtagtcccgaaagtcgttgagcagtttgtccatcttaaacaggccctgcccttctctacccggctgctaatgagcctgagcgacatcgtgcgcagcgcgggcccctggctggcgctgctgtcgttactggcgctgctggcgctgcgctatctgctgcgccagcccgcccggcggctcgcctgggaccgggcgctgctgcgcctgccggtcatcggccgcgtggcccgcagcgtcaacagcgcgcgctacgcccgcaccttaagcattctcaatgccagcgcggtgccgctgctgctgtcgatgcgcatcagcgccgacgtcctcagcaacgcctgggcgcgcagccagctggcggcggccagcgaatcggtacgcgaaggcgtcagtctgcatcgggcgctggaatccaccgccctgtttccgccgatgatgcgctacatgatcgccagcggcgaacagagcggagaactgaccgccatgctggagcgcgcggcggagaaccaggaccgggagctgagcgcgcagatccagatggccctcagcctgtttgagcctctgctggtggtcaccatggccggcatggtgctgtttatcgtgctggccatcctgcagccgatcctgcaactgaacacccttatgagtatgtaactgtattaatggagaaaactatgcaacggcaacgcggtttcacgttactggaaattatggtggtgatcgtcattctcggcattctcgccagcctggtggtgcctaacctgatgggcaacaaggagaaagcggaccgccagaaagtcgtcagcgatctggtggcgctcgagggagcgctggacatgtataaactcgacaatagccgctaccccaacaccgaacagggactgcaggcgctggtgaccgctccggccgccgagccgcatgcccgcaactacccggaaggcggctatatccgccgtctgccgcaggacccgtgggggaatgagtatcagctgttaagcccgggtcagcatggcgccatcgacgtcttcagcgtcggcccggacgggatgcccgacaccaatgacgatatcggcaactggaccctcgggaagaaatagtgtctcagcgcggtttcaccctcctggagatgatgctggtcctgctgctgatcggcgtcagcgccagcatggtgctgctggcgtttccctccgcccgcacccaagaggccacacagatcctggcgcgctttcaggcgcaactggattttgtccgcgagcgcgggcagcaaaccggtcagctcttcggcattatcatccaccctgagcgctggcagtttatgcgcctgcagcctgccgacgatagcgccccggcggcggctgacgaccggtggggcaacgcgcagtggctgccgctgcaggccggacgcgtcaccacggcggaaaccctcccgcgggccaggctgacgctgcgctttcccgacggccaggcgtggacgccgggcgagcagcccgacgtgcttatttttcccggcggtgaagtcacgccgtttcagctgcgaattgacgccgcgacgggcataaacgtcgacgcccagggcgacagccagccgctggcggcgcgggagcagccatgaagcgtgaagccggaatgacgcttatcgaagtgatggtcgcgctggtgattttcgccctcgctggcctggcggtgatgcagtccaccctgcagcagacgcgccagctcgggcgtatggaagagaaaatcctcgccagctggctggcggataaccagctggtgcagctgcggctggagaaacgctggcctgccctcagctggtctgaaaccaccgtggaggccgccgggacgcgctggtttgtccgctggcagggagtggaaaccgcgctgccgcagctgcgggcgctggacgtggaggtccggcggcaaaaaagcgatcccgcgccgctggccaccctgcgcacctgggtgacgccgccatgataacgaaaatgcgcggtttcactctgatcgaaacgctgctggcgctggctattctcgccgtcctcagcgccgccgccgtgatggtgctgcagaacgtcatccgcgccgatggcctgacccgcgagaaaagccagcagatcgcggccctccagcgcgcctttcgccagatcgccgacgatgtcacccacatcattccccgtcgcgccagaaacagcgacacgtttttcttcgccggacgtttccagttgcagagcgacgactggggactggccttcagccgcagcggctggccaaacccgctggggatcctcccgcgctcggagatccagaacgtcagctaccgtctgcgccagcagcggcttgagcgtctgagcttcgatcagcaggatccgctgaccggcagccagccgacggtccgggtgctgctgcgcgaggtaaccgcgtttcgcctgcggttttacgccgacgggcgctggcaggaaacctgggaccgcccgcagacgctgccccaggggctggagatcaccctgacgctggcgaacagcggggagataacccgcctgtttttactcaccccgggaggcggccagtgataaatcggcaacgcggcgtcgcgctcctgatggtgctgttcatcctcgccctaatgatgatcctcgccagcgccatgaccgagcgcaccgcggtcatgtatcaacataccgccgtgaccctcgataatttgcaggccagatggtacgccctggcggcggaaaatatggccgccgcgctgctgcaacgcgatgcgctggactcgcccagtcaaacgaatctggcgcaaacctgggcgcaggaggggcgccgctttaccctcgacgatggcgaaatccgcgccacgatccgcgacgggcacgcctgcttcaacctcaatgctattgaccatcgcgcggatgaggctggcgacggaacgccctacccgaccgacgtcttcgttcggctgctggcgctgctcggcgagccgccgctgcgcgccagccagatcgccgccgcccttggcgactggacggacagcgacggccagccgcggctgaacggggcggaggacgaggtctatatggcgcaaaccccgggctatctcgccgccaaccagccgatgcaggatgtcagcgagttgcgcctgctggccgggatggacgccgcgctctatcagcgcctgctccccttcgtctgcgtccagccggatgacgcgctgcaggtcaatgtcaacaccctgcgcccctcccaggccgccctgctggtggccctctttcccggcgatctgacgctgcaggaggcgcaacagctgctgcacaaccgcccgcgaaccgggtggagcagcgtcgccgcctttctcgcgcagccgacgctgcagaaaaccgataccacgcttgcccgtccctggctgacggtgcacagcgcacgctttatcgccgcttttaccgtggtgactggcaatctccgctttcagctgcacagcgtcctgcaacaatcggggcgcacgtttaccgtcgtccagcggcgatatggactctctatggtggtcgatgaacaagattaatgcttctccccaggccatgctgatcgtgcgcctcgccgccgcgcaggcgccgctgcactggcaactcttcgcccccggcgagccgcaccacgaggccagcggccggtggccgactgacgacgccagccctttcccggcgctggctgagcagtacccggcctgggtgctgatcccggccagcgactgcgcgtttcactcgctcaccctaccggcgggcctgcgtaagccgccgctgcaggtggccccgtttctgctggaagagcagctggcagacgatgtggaagccacccattttgctctgctccaccgccagcaggcccagtgcgagatcgtcgccgtacagcggcaaaaaatgcgcgactggctggcgcgctgcgaatcgctctccttacagcccctggcgttgacgcccgacgtgctggccctgccctggcaaccgccggcgtggagcgcggtgcaggtggacgagcagtggctgatccgccaccagccgtggggcggcatggcggcggaaaacgtctggctgacggagctgctgcagagcgaggcggaagagcacgtcatcgacagctattcgccgccgcccgcggcgccgggcgtttggcgggagcagcctgcgcagacattgctgacacttgccgcacgccatccggcagcgcagaaactcagtctgctgcagggggagttcgccgaccggcggcggtctgcgcaggcgagctggcgtccggcgcggtatgccgcgctggccctggcgttactggcaggggcaaacagcgtgctggaccatcgcgatctggcgcgtcaggccgaggcggcgcaacaggccagccgggccttctatcaccgctggtttccgacggagaaaaaggtgattaacccacgactgcagatgcagcagcacctgcaaaccctcacccgtcaggcgcagcatgcccccctcgtcgaccgcctcagcgccttgcaaaacatcctcagcgaaacgccggggatccgtctgcgagcgctgagctgggatgccgcgggcaatcgtctgcagctggatatcgccgcggtctcttcccgggcgctggagcagtttacccagcgggcgcagccgcggtttcgcgtccggccgggcgacatgatcacgaaaccggatggcattgagggacaactgacgctggaggaaaacgatggctaatctgcttatctggtggcggcagcgcacgccgtcggagcagcgcctgttgcttggtctgacagggctgctggcggcatgcgccttctggtatgggctgtggcagccctggcgagcccgcgaggcgcagtggcggcaaaccctggtgaaagagcaggccagcctgcgctggatgacggagcaggctccgcgcctgcagcagctcagccagcagcccgcgccggcggcaaaagaggcgctcaccgcgctggtgatgcgcgaggcggcgagccacggactgacggtcatccgcctgcagccgcagggaaaacgtctgcagatcacccttcagccctgcgctttccaggcgctgatcgactggctggacgctccggcgatgcgcggcgtcaacgcgatctcgctgtccgtgaccgggcagccgtcgcgacccggctgggtcacggtcaaccatctgctgctggagcgcgacgatgaaggctaactggatcgcgggcggactgctgctggtcctctatctgttgtggctcaccgccacggctccggcgcgcctgctggcccccatgctgccgcccggcgtacaggtggggcagtttagcggcagcgtctggcgcggcgcggcgcaaccggtctactggcatggggaacggcttgaacgactggcgtggtcgctgaccctggcgggctggcaggtctctctcagcgatccccgcggcgtgatgggtcaggcccggctgtggggccttcgcgatctgcgcctacaggaggggcggctcaccgcccccgccagcctgctcagccgctggttgatgtcgactatgcccgtcaaggccgcgggggaggtcaccttcagcctgaccgaagggcggttcagcgacggacgctgccggcatatcatcgccggaggcgcgcagtggcggcaggcccgactgcactccccggtcggcagcctggagctggcccaggttaatggcaccttccgctgtacggtggacggcgccgtggcgctgactctccgtcaggactctcgtcagctgagcctcagcggccaggggactctgtcgcccgatggccgctatctgtttcgcggcacgctacagccccggcaggggatgccgccgctgctggcgctgctggtcacgcgcccgacagcgaataacgccccgggcccgacgccgtggcagctgcagggaaaatggttaccccaggagcaaaaatgacgacactagccgcgttatcgctgcactttccctttgtctggtatggctttctactgctgttcggcctggcgctgggcagcttttacaatgtggtgatctatcgtctgccgcgcatgttgacccagaccgcggacgacgagcggataaccctcagcaccccgggctcttcctgcccgcagtgccgccagccgatcgcctggcgggacaatatcccgctgctcagtttcctctggctgggccgtcgcgcccgctgctgtcaggcgcccatcgcgtggagctatccgctgaccgagctggccaccggcctgctgtttatcctcgccggagctttgctggcgccgggcctgccgctggcgggcggcctggtgctgctctcgttcctgctgatactggcgcggattgacgcccggacccagctgctgcccgatcgcctgactctgcccctgctgtgggccgggctgctgttcaatcttaacgaggtgtacattgccctgccggatgcggtcgccggggcgatggccggttatctggcgctgtggtcggtctactggctgttccgcctgctgaccgggaaagaggcgctgggctatggcgattttaagctgctggcggcgctgggcgcctggtgcggctggcaggttctgccgcaggtgctgttgctcgcttcggccagcgggctggtgtggaccctactgcaacgcctgtggacccggcagtcgctgcagcagccgctggccttcggcccctggctggcgctggccggcgggggtatttttctctggcagcagatgatctagcgtttgcgaaccgactggccgggcaggatgccgcccggcagcggcggctacgagtattttttgctgcggcgggtcggggcggcgttggccggatcgtccggccagacgtgcttcggatagcgtcccttcatctctttctgcacctcgcggtagctcccttgccagaaggcgctcagatcgcgggtgatctgcagcggacgctgggcaggcgacagaagctccagcaccagcggcacccgtccctcggcgatcaccggcgtcgtggcctcgccgaacatctcctgcatacgcaccgccagcgctggcgggttctccgcatggtatcggatcgccaggcggctgccggtcggcacggtatagtgcgtcggcagctcgcgatccagcttctggcgcagcggccatggcagccagtcctgtagcgcctgacgcagatccagcgccttcagcgcccgcagggaatgaacgccgttcatctgcggcagcagccatgcctccagcgaggccagcagcgaagcgtcatccactgcgggccatgcctcttccggcagccactgcgccgcacagtacagccgcaggcgcagctgctcagcctctggcgtccagttgagcaccccgaggcctttctcacgaataccgttgagcatcgcctgatgcagctctgcctcagagggcttcgccagcggctgggtcttgatcaccaactggccgatcaccgtccgccgccaggctttcagcgtaccctgcgcttcatcccactccaccgtgtcggaacttttcgccagttcagggcgggcggcgatcagctcgccgatttccactggcagagccaacagcatgcgggcatccggcgaagcgctgccctgcagcagcagcggagcgataagccattcatgacggcccagcgcgtcgtcggcgtccagcatcgcgcccatgccgttcgccagctggtagcgcccctcctgaccgcggcggcgggcgatgcgatcggcgaaggccgacgccagcagccccgccattagcccggcatcgggctggccgccgcggcgggccaggcgcttcatcagctgctgcgatcgctgctgccagttggcctgctgacgggaaaagacggcccccaaatccaccagtccgccgcgcggcggctcctcgaggatcgccgccagctttgccgctgtcgccgcctcgtcatcggtctgcgcggtggccagcatcgccgccagccgcggctcgttgccaagcgctgccattttgcggccaaacgccgacagccgctcgccgtccagcgccgacagcgcctccagcaggcggcgcgcggcggccagattgaccgcgggcggctgatccagccaggccagcgcggccggatcgtggcagccccactgcagcagctccagcaacagcgccgacagatcgctgtgcaggatctccggctcgctctgcgccgccgcccgttccgcctgttctttgccgagcaaatgcaggcagatccccggggagagacgaccggcgcgtccggcacgctgcgtcattgatgcctggctgatgcgctgcgtcaccagccgggtcaggccggtgcgcgggtcaaagcgggcgacccgctcctgggcgctgtcgaccaccaggcggatcccctcgatggtcaaactggtctcggcaatattggtggccagcaccactttgcgcttcccggccggcgccgggaggatcgctttgcgctgttcgcttaagggcaacgcgccatacagcgggcagagaatgacatcctccgccacgcgctccgtcagctgttccagaacgcgctggatctcgccgacgccgggcagaaacagcagcatcgatccctgttcatgccgcaggagctccgccgccgctaccgccacagcctcatcaaaacgctggtgcgcggagagcgggctgaagcgacgctccaccggataagcgcgcccctccgagaccaccaccggcgcctccggcagcagacgctgcaggcgatcgttatcgagggtcgccgacatgatcagcagcttgagatcgtcacgtaacccctgctggacgtcgagcagcagggccagggccagatccgcctgcaggctgcgctcgtgaaactcatcgaggatcaccagccccacgcccgtcagctccggatcgcgctggatcatgcgcgtcaggatcccctccgtaaccacctccaggcgggtctgcggtccgacgcaggtttcggcgcgcatgcggaaacccacggtctcccccggcttttcgccaagcagttcagccagccgctgcgcgacattacgcgccgccaggcgcctcggctcgagcaggataatgcgtcccgcgatgttgccctcggcgaggatctgcagcggcagccaggtcgacttcccggcgccggtcggcgcgttgagcaaaacctgcggcgcatgctgcagggcggataacagttctggaaggacagcggcaaccggcaatgaggacacaaaaggctccgggggttaacattcaggggttcgcattgtagcatccccctaattcattaccgagtctctatcatgtctgagccgaaaaggctgttttttgcgcttgaactgccgtctgccgtccagaagcagattgtccagtggcgggcaacgcacttccccgaagatgccggcaggcccgtcgcggcggataatcttcatctgacgctggcgtttctcggcgaggtgagcgcggaaaaacagcgggcgctggccgctctcgctggtcgcctgcgccagccgggctttaccctgacgctggacgatgccggacagtggctacgttcgcgagtggtgtggctcggaacccgccagccgccgcgcggcctgctgcagctcgccagcatgttgcgcgctcaggcggcgcgcagcggctgctatcagagcccgcagccgtttcacccgcatattaccctgtggcgcgatgctcgccaggcggtgccgatcccggcccccggctttcgctggacatttccggtgaacgagttcgtgctctatgagtccagctttagccgggggcgcacgcgctacacggcgctggaacgttatccgtttgataaggaaagttgatgcagtttgatccgccgttgcagcccgccattttgcttaaacgttacaaacgatttcttgctgacgtggtcacccccgatggccgcgagctgacgctccactgcccgaataccggggcgatgaccggctgcgccgccccgggcgacaccgtctggtattccacctcagacaatgcgaagcgcaaatatgcccacacctgggaattaactgaaacccagcagggcgcagttatttgcgtcaatacgctgcgcgcgaattctttggcgaaagaggcgatttccgccggaataattcctgaactttcaggctataaccagctgaaaagcgaagtgaaatatggcgaagagaatagccgtatcgatattatgttacaggcagatgaccgacaaaactgctatattgaagtgaaatcggttacgttggcggagaaagaatacggttattttcccgatgcggtgaccacgcgcggtcagaagcacctgcgggaactgatggccgtcgcggcaaatggcgaccgcgcggtgattttatttgccgtcctgcattcggcaattgaccgtttttctcccgcgcatcatattgatgccagatacgcacagctgttaacagaagcccaggacaagggggtggaaattctcgcctggaaagcggaactttctacgacgaggatgactctgaataagccgatcgccgtggtgttaaaccccggtaaataagtggctaaatagtgttcgggtcgcaagcgcgaatacgcttttcttcacagggttgtcaagtgtaacgtttagataattgctatccggaaaagcatctgctatttatagcggcctgattttcccccacatggggatcgatagtgcgtgttaaggagaagcaacatgcaagaagggcaaaaccgtaaaacatcgtccctgagtattctcgccatcgctggggtggagccgtaccaagagaaaccgggcgaagagtatatgaacgaagcccagctggcgcacttcaagcgtattcttgaagcatggcgtaatcaactcagggatgaagtggatcgcaccgtatcgcacatgcaggatgaagcagctaacttcccggacccggtagaccgtgccgcccaggaagaagagttcagcctggaactgcgtaaccgcgaccgcgaacgtaaactgatcaaaaagatcgagaaaacgctgaaaaaagttgaagacgaagacttcggctactgcgaatcctgcggcgtggagatcggcattcgccgtctggaagcgcgtccgacagcggatctgtgcattgactgcaaaaccctggcggaaattcgcgaaaaacagatggcgggctaatcccctgctgcctcactctctggcgggagtctctcccgcctggttctgttgtccgtaccatgactgactcacgctatatagggcgcttcgccccctccccctccggcgaactccacttcggctctctgatcgccgcgctcggcagctacctgcaagcccgcgcgaaccagggcatctggcgtgttcgtattgaagatatcgacccgccgcgcgaagtccccggtgccgccgataccatcctgcgccagcttgaccactacggtctgcactgggatggcgacgtgctgtggcagtcgcaacggcacgaagcctaccgcgaggcgctgacgtggctgggcgagcaagggctgagctattactgcacttgcacccgcgcgcggatccacgccgtgggcgggatctacgacggccactgccgcgacctcgggctgggggcggaaaacgccgcgctgcgcctgcgccaaacccgtccggtactgcagtttagcgaccgtctgcgcggcacgctcatcgccaatgagccgctggcgcgagaggattttattatccaccgtcgcgacgggctgttcgcctacaacctggcggtggtggtcgacgaccactttcaggggatcaccgagattgtccgcggcgcagacctgattgagccgacggtgcggcagatttcgctgtatcagcattttggctggcaggcgccggattacctccatctgccgctggctctcaatggcgacggcaataaactctctaaacaaaaccacgcgccggcgctgccggaaggcgatccgcgccccgaaatcgtccgggcgctccgctttctgaatcaggcgatccccgaggagtggcaggccctgagcatcgatgatttactcgcccaggccgtcgccaactggcagccggcgaaaatcgagcattctcaaatggctcccgctgagctatgattagccgctatttttacactgtacagttgatctgaagtccgtctgacactacgaggtgcaccatttttacccgagtcgctaatttttgccgtaaggtgctaagccgtgaggagcgcgaggcagaagccgccgtcgaaccaacgcctatgacggtgatcccgcgtgagcagcatgctatttcccgcaaagatatcagtgaaaacgccctcaaggtcatgtaccgcctcaacaaggcgggctacgaatcctggctggtcggcggcggcgtccgcgacctgctgcttggcaaaaagccaaaagattttgacgttaccaccaacgccacgccggatcaggtacgcaagctgttccgcaactgccgtctggttgggcgacgtttccgcctggcacatgtgatgttcgggccggaaatcattgaggtcgccaccttccgtggccatcacgaagggcataccaccgatcgcgtcacctcccagcggggccagaacggcatgctgctgcgcgacaacatcttcggctcgatcgaggaggatgcccagcgtcgcgacttcactatcaacagcctctattacagcgtggcggactttaccgttcgcgactacgtcggcggcatgaaggatctccaggacggcgtgatccgtctgatcggcaacccggaaacccgctatcgcgaggatccagtgcgcatgctgcgcgcggtgcgctttgccgccaagctcaatatgaccatcagcccggaaacggctgaaccgctgccgcgcctggccgccctgctccacgatgtgccgccagcgcgtctgttcgaagaagtgctcaagctgctgcaggccgggtatggctaccagacctacatgctgctgcgggaatacagcctgttccagccgctgttcccgaccatcacccgctactttaccgagcgcggcgacagcccgatggagcggatcatcagccaggtgctgaagaataccgatacccgcattcataacgatatgcgcgtcaatccggccttcctcttcgcggtgatgttttggtatccgctgctggagacggcgcaaaaaatcgctcaggagagcggcctggcgtactacgacgccttcgccctggcgatgaacgatgtgctggacgaagcctgccgtacgctggcgatccctaagcgcatcaccacccttattcgtgatatctggcagctgcagctgcgcatgtcccgtcgtcagggcaaacgcgcctggaagctgatggagcatccgaaattccgcgccgcctatgacctgctggagctacgcgccggcgccgagaacaaccacgaactgcagcgcctgaccaaatggtggggcgaattccaggtcgccgcgccgccggcgcaaaaagatatgctcaacgacctcggggacgatccggcgccgcgccgtcgtcaccgtcgtccgcgcaagcgcgcgccgcgccagggtagcgcatgactctggtctatatcgcacttggcagcaaccttgcttctccactggagcaggtacaggcggctatccgcgccctgggcgaaattccgcacagccgcgtggtcgccgtctcttcgttctaccgcacgccgccgctgggcccgcaggatcagccggactatctcaacgccgccgttgcgctggaaaccgccctgccccccgagacgctgctcgatcatactcagcgcatcgaactgcagcaggggcgggtgcgcaaagccgaacgctgggggccgcgcacgctggacctcgatatcatgctgtttggcgatgctgtcattaacagcgagcgcctgaccgttccgcactacgatatgaaaaaccgcggctttatgctctggccgctgttcgagatcgccccggaccttcactttcctgacggcctggcgctgcgcgccgtgctggataatctcggcgcggcaaagcccgccagctggtaatcccctctcccttttttagcatttgcggcgatcgtcgtaatcggttgcccaaaatcattgcccctctgaatgctgctgttagaatgccggttaatatgactttcatcatcaggaaatgttatgaaaccgaccaccattgccctgctgcagaaatgcaaacaggaaaagaagcgctttgccaccattaccgcctacgatcacagcttcgcgaagctgttcgccgatgaaggcataaatgtgctgctggtaggcgactcgctgggaatgacggtgcagggtcacgactccaccctgccggttaccgtggaagatatcgcctatcacacccgcgccgtccgccgcggcgcgccaaacagcctgctgcttgccgacctgccgttcatggcctatgccacccccgagcagacctttgcaaatgccgccatcgtgatgcgcgctggcgccaatatggtcaaactcgagggcggcgcctggctggccgacaccgtgaggatgctggcggagcgcgcggtgccggtttgcggccatcttggcctgacgccgcagtcggtgaacgtattcggtgggtataaagtgcagggtcgcggcgatgcggcgcagaccctgtttgaagacgcgttagcgctggaggcggcgggtgcgcagctgttggtcctggagtgcgtgccggttgaactggcgaagcgcatcaccgacgctctgaccattccagtgatcggcatcggcgcgggcaacgtcaccgacgggcaaatcctcgtgatgcatgacgctttcggcattaccggcggccacattcctaaatttgccaagaatttccttgccgaagcgggcgacatccgcgccgcggtgcggcagtatattgccgaagtcgaatccggagtctatccgggcgaagaacacagtttccattaaggagtcttgttgtgctgattattgaatccgtactgctgctgcggcagcatatccgccgtctgcgtcaggagggtaaacgtatcgcgttggtcccgacgatgggcaacctgcatgatggtcatatgaagctggttgatgaagccaaagccagtgcggacgtggtggtggtcagtattttcgtcaatccgatgcagtttgaccgcgtcgacgacctggcgcgctacccgcgcaccttacaggatgattgcgaaaagctgaacaaacgtcatgtcgactttgtcttcgcgccgacgccggcggaagtgtacccccagggtactgaaggccagacctacgtcgacgttccgggattatccaccatgctcgaaggcgccagccgcccgggccatttccgcggcgtgtcgaccatcgtcagtaagctgttcaaccttgttcaaccagacgtcgcctgcttcggcgagaaagacttccagcagttggcgctgatccgcaagatggtcgccgacatgggctacgacattgagatcatcggcgtgccgatcgtccgcgcgaaagatggcctggcgctgagttcgcgtaacggctacctgaccgccgaccagcgcaaaatcgcgcctggtctgtataaagtgctgagcgcggtggcggaaaagctggccgccggcgatcggcagctcgatgagatcatcgctatcgctgaacaggagctgaatgagaaaggcttccgcgccgacgacattcagatccgcgatgccgacaccctgcttgagctgaccgatgccagccagcgcgcggtgatcctgatggccgcctggctggggcaggctcgcctgatcgacaaccggatcgtcacgctcgctcagtagacagcgggtaaaaatcgggcaatactgcccgggcttttctcagggcgggcgccgtgtccgctctgctacattaaggttgaagggtagaagttatgatgcgtaatatgctgcagggcaagctccaccgcgtaaaagtcacgcaggcggacctgcactatgaaggttcttgcgccattgaccaggacttcctggatgcggccggtattctggagaatgaaactattcacctctggaacgtcaccaacggcaaccgtttctccacctacgccattgccgccgagcggggctcccggatcatctccgttaacggcgccgccgcgcactgcgccagcgtcggcgatattttgatcatcgccagcttcgttaccatgtcggacgaagaggcgcgcagctggcagcctaacatcgcctacttcgaaggcgacaacgaaatgaagcgccaggcgaaagctattccggtacaggtcgcctgatggccgcgacgctgcgctcaggcgcagcgtcggtattacccctgcggctggttactgatcagccgcgacatcgtctccagcgaatccgtgcgtaagatatataaccgctttaacagaaacggattgtcccccggcttcaccttcccacgcaccgtcgttaccgccatatgaaacccggcgtcattcgccgcctgcaccgccgtagcgttatagccgccgaagggataggaaaggtagagaacgtgcggattaaactggctcagcgcccggcgcgagcgggcgaaatcaaacagaatattatggtaattgcgactgaataaaatcggccgccggccggcgtcaacccgatgcaggaagtgagtatgcgactgaatatcaaagacgtcctggatctggcgtagctcggaaatgctcataaactgcagggatttcggatcccacttctgtggatggcgcttaatacgcgaggagataataaacgcggtggcatggaaaccgtactgtttcagcaccggataggcgtagcggttcaccgatttcaagccatcatcgaaagtgatcgccaccgcccgcgccgggagattgattttattacgcacatagccttccagctgatacagggtcagcgtggtatagccctgatcgcgcagccaggtcatctgattcgtgaaggcgcgaaccgaggtggtggtcgacgtatgacgaaaacgggtgttctcttcatcgcgcagaatatggtgataggtcagcacgggaataccgtgatcctcctgcgcgtccagactactgacccacgccagccggtcgccaatgcggatctgaaaccaggtctgattgagccggtccttcagcttgctgaggatcggatagcgcagattgttggccagcgtgccgaacggcgcgctgcttaccgagggagcgtcatagagcggtgtatctttccaggtgagtaaattttggttactcagcggtttattaagatcccccaaacggtcctccacccgctgcttgccctgcaccggctcgagatgccctttatcaataaacccggtgccaaagccgaaacgaaactcatagtagtcagccgccgtcgggacgactgcgaggatctgcccggcacgaacattgccgacgctgaccacatggtttcccacctgcgcccagatgaccgcgtcttcggtggtttgcatatagcgcacagccttgccctgctggctaagcaggctggcggaggcgctgagtgaggtcaggaaaagaagcagggtcaaaaatcgggcaagcatacgcatcaaaccgttataccatcaacggcggttattgtaacaaaagcggtatctgtcccgctgcttaatttccccaggcatcatggcgcaaccggaacggggggttcttctgctgctgatgccacaggctgctcaccatcggcccgcccgcgctgacgatcgcctggcgaaacgccacgctgcttaacgtgcctcgcaggagatacattcgctcaaggagtggatagctgacgccggagatcacttcgcagtgggtatgtttgtggctcatcagcgccgcggcccgataaggcgccgcaccggttttgtcagtgagaaaaatgaccccgtccccggagtcggtggcatgcagcgcatcgcacatcatccggctcaacatattgctgctgagattgcgccagtaattgaccgcccggcactgggccagcggaccaaacttttgttcaagacgatccagcatctcctgcgccagctcatcgtgacaggtaatgacccatccgagcatgcttccctccttagccagcgaataatgtagcaaggtgaagatgacgtatcggtgatgggagtcaaagataagcggttagcgcttcgcatatttacttcaggaagcgctaaccatgatgagtatcagctacgcaggccgcgaccgcgctgaattaacgaccagcacagcagatagaaggcgacaatgaacaccaccagcacggcgaaggtggtcgccagcgggacgtcgttgataccgaggaagccgaagcgaaaaccgctgatcatgtagacgatggggttcagatgcgacagcccctgccagaacggcggcagcagggtcagcgagtagaacaccccgccgagataggtcagcggcgtcagcacaaaggtcgggatcaggctaatgtcatcgaaggtcttggcaaacaccgcgttcagcagcccggccagcgagaacagcaccgcggtgaggagcagcgtcagggcgacaaacagccaggagtgaacctggaacggcacaaagaatagcgacaccgcagtcaccaggatacctacgcacagtcctcgcgctaccccgccgcccacgtagccggcgataatcacatgcgtcggcactggcgccaccagcagctcttcaatattgcgctgaaacttggcgctgaagaaggatgaggcgacgttggcgtaagcattagtgatcaccgccatcatgatcaggcctgggacgataaactgcatataggtaaaaccatgcatctcaccaatgcgcgagccgatcaggttgccaaagatcacgaaatacagggtcatggtgatcaccggcggcaccagcgtctgtacccagatgcgcataaaacggtggatctctttggtccagatgcttttcagcgcgacccaataaagctgcatcatgctgattctccttttcgctcatgcaccagcgtgacaaacagctcttccagacggttggctttgttacgcatactcagtacctgcaccccctgggcgctcagctgcgcgaagacgctgttaattccctgctcacgcagaacctccacttccagcgtcgaggtatcgaccagctggtactggtagccttcgagcttcggcaccgggctttttggcgcgaggtcaagaataaaggtctctgacttcagcttcgacagcagcgctttcatcgaggtgttttccaccagctcgccgtgctggatgatgccgatgttgcgacatagcatttcggcctcttcgagatagtgggtggtcaggataatggtggttccgcgatcgttgagatccttgagaaagccccacatcgagcgacgcagttcaatatcgacgccggcggtcggttcgtcgaggatcagcagcttcggctcatgcatcaacgcgcgggcgatcatcagacggcgcttcatcccgccggagagcatccgcgcgcgttcgttgcgtttttcccacaggtcgagctgttttaaatacttttcactgcgggaaagggcttctttacgctcaacgccgtagtagcccgcctggttaacgacgatctgctgcacggtttcgaacgggttgaagttaaactcctgcggcaccaggccaagctggcgcttggcattgacgacgtctttctccagatcgtagccaaagacattgacctgaccagaggttttgttcaccagcgagctgatgatgccgatggtcgtggattttccggccccgttcgggcccagcagggcataaaaatcccccgcttcgacctgcaggtcgatcccccgcagcgcctgaaccccgccgggataggtttttttgagctgttttaattccagagcaatggtcattaaatatctcttctcgtgtcgtgacacgtcattaacccgcctgactcacgtttgcgctggaccggcgctgacgccgccaacgcatctgcagcctgaagtatcacgggttaagatggttttaaaaaaggtgagcttaccctatattagcgcaacgcacttacttggttacaggccgataacgtccatgaatgatatagatacactcatcagcaacaatgcactatggtcaaaaatgctggtggaagaggaccccggcttttttgagaaactgtcgcagacgcagaaaccgcgcttcctgtggattggctgttcggacagccgcgttcccgctgagcgactcaccggcctggagcctggcgaactgttcgtgcatcgtaacgtagcgaacctggtgatccacaccgatctcaattgtctgtcggtggtgcagtatgccgtcgatgtcctggaagtcgagcatattattatctgcggccactacggctgcggcggcgtgcaggcggcggtggagaacccggagctggggcttatcgacaactggctgctgcatatccgcgatatctggtttaagcacagctcgctgctcggtgaaatgccagaggagcgccgtctggataccctttgtgaactgaacgtgatggaacaggtgtacaatctgggacattcgacgattatgcaatccgcgtggaagcgcggacagaaggtgaccatccacggctgggcttacgggattcacgacggactgctgcgcgatctggatgtcaccgctgtgagcagggaaaccctcgaacagcgctatcgccacgggatctccaacctcaagatcaagcacatcaaccacagatagccttcagacttcgccaccctggagagcgcggcgcgcgctgtccagagtgggatatccccttactcgtccagcagggtgactttgccgatatacggcagatggcggtagcgctgagcatagtcgataccgtagcccaccacgaactcatccggaatcgcgaaaccgacgtattcaaccgggacgttcacttcgcggcggctgggtttatcaagtagcgtacaaatggccagcgatttcggctcgcgcaggctgaggatttcgcgaactttagacagggtattgccggagtcgatgatgtcttccacgatcagaacgtctttaccacggatgtcttcatccagatctttaaggattttcacatcacgagtggtggacatgccgctgccgtagctggaggcggtcataaaatcgacttcatgcggcacctgcacttcacggcacaggtcggccatgaacataaacgagccgcgcagcagccccaccagcaccatttcgctgccgctgttctgataatgttcgttgatttgacgacccagttccgcgatacgcgctttgatctcggattccgggatcatcacttctacagtatgtttcataatactaaccatttgattctaaatataaatcatcaaagccgctgctttcgccccgacgatgaccggcaagccatccagtataccagcaaaaagaaatcttcggtgcagggattaataaagccatatttgtgattccgatcacacttgttaaatcctataattaattgcagttaaaaaatttaacaaacacatgagtaactttttatggctgaaacaaagtctcaacaatcaaggctcctggtgacgctgactgcgctatttgcagcgttctgcggcctctatctattaatcggcggggcatggctggtcgtgcttggcggctcctggtactaccctatcgccgggctggtgatgctgggcgtgaccgtaatgctgttccgcggcaagcgcgctgcgctgtggctgtacgccgcgctgctgctggcgaccatgatctggggcgtctgggaagttggtttcgacttctgggcgttgacgccgcgtagcgatatcctcgtcttctttggcatctggctgatcctgccctttgtctggcgtcgtctgccggtgccttccgctggcgccgttggcgcgctggtcgtcgccctgctgatcagcggcggcatgctgacctgggctggttttaacgacccgcaggaagtcaacggcaccctgagcgccgacgctacgccggccgcaccgatttccaccgtcgccgacggcgactggccggcctatggccgtaaccaggaaggccagcgcttctccccgctgaagcagattaacgccgataacgtgaagaacctgaaggaagcctgggtgttccgcaccggcgacctgaaacagccgaacgatccgggtgaaatcactaacgaagtgacgccgattaaagtcggcgatacgctcttcctgtgtaccgctcaccagcgcctgtttgcgctggacgccgccaccggtaaagagaagtggcattttgacccgcagctgaacgccgatccgtcgttccagcacgtcacctgccgcggtgtttcttatcacgaagcgaaagcggataacgcccctgccgacgttgtcgccgactgtccgcgccgcattatcctgccggtgaacgatggtcgcctgttcgcggtaaacgccgacaacggtaagctgtgcgaaacctttgctaataaaggtattctcaatctgcagaccaacatgccggtcaccacgccgggcatgtatgaacccacttcaccgccgatcatcaccgataaaaccatcgtgattgccggcgcggtcaccgataacttctctacccgcgagccgtcaggcgtgatccgcggctttgatgtgaataccggtaaactgctgtgggccttcgatccgggtgcgaaagatccgaacgccatcccgagcgatgaacatcacttcacgctcaactcgccgaactcatgggcgcctgccgcctacgacgctaagctggatctggtctatctgccgatgggcgtgaccactccggacatctggggcggcaaccgtacgccggagcaagagcgttatgccagctcgattgtggcactgaacgccaccaccggtaagctggcctggagctatcagaccgtccatcacgatctgtgggatatggacatgccttcccagccgacgctggctgatattgaggtcaacggcaaaaccgtaccggtcatctatgccccagcgaaaaccggcaacatcttcgtgctggatcgtcgtaacggcgagctggtggtcccggcgcctgaaaaaccggttccgcagggcgctgccaaaggtgattacgttaccaaaacccagcccttctccgatctgagcttccgtccgaagaaagatctgaccggcgcggacatgtggggcgccactatgttcgaccagctggtgtgccgcgtgatcttccaccagctgcgctatgaaggtatcttcaccccgccgtctgagcagggcacgctggtgttcccgggtaacctggggatgtttgaatggggcggtatctccgtcgatccgaaccgtcaggtggctatcgccaacccgatggcgctgcctttcgtctcaaaactgatcccgcgcgggccaggcaatccgatggagccgccgaaagatgcgaaaggctctggtacggagtccggcgtgcagccgcagtacggcgtcccgtacggcgtaacgctgaacccgttcctgtcgccgttcggcctgccgtgcaaacagccggcctgggggtatatctccgccctggatctgaaaaccaacgaagtggtatggaaaaaacgtatcggtactccgcaggacagcctgccgttcccgatgccggttaaactgccgtttaccatggggatgccgatgctgggcggtccgatttccacggccggtaacgtcctgttcatcggcgcgactgcagataactacctgcgcgcgtacaatatgagcaacggcgagaagctgtgggaagcccgtctgccagccggcggtcaggcgactccgatgacctacgaagtgaatggcaaacagtatgttgtcatctctgccggcggtcacggctcgttcggtaccaaaatgggcgattatattgtcgcctatgcgctcccggatgacgccaaataaaacgcaaaacggcaacgaaagttgccgttttttttggtgttccgtccttcttcccgtaggggatggcagcaggtcgcagagacttaaaccgtgaaccccaacatcatcccggtgtcttcatgttccagcaggtggcagtgggccatataggcaaactccttcggcgccggatgatcaaacttcactaatacttcactcacgttcccttccacacgaacggtgtctttccagccgcgacgatgcgccgctggcggcttgccgttttcgctgaggatacggaactgggtgccgtggatatggaacggatgcaacatcatgtcgcccttaccagaaatcacccagcgctcatactggcctctggcggcggcaaacatcggctcattcatgtcgaaggctttgccgttgatgcggttggcgttatggaaatcaaagcccttgcctgacgacatgccatgctccatgccggatccgtggttcatgttactcattttgctcatgtcgccgtgatgcatattccccatgtcgctcatgtcgccatgccccatcatgccgtgatccattccggccatcgcctggtcgccatacttctccatcagcgcctgcatgcccatccggtcgagcatcggatccatagacagctggagctgacgctgcgtcagccccgtcagggacggtaacgccgggagagcggccagagtatccagcagcttgccggaggcgggaatgaccagcggctggacgcgcagtaccggctgtggtttatcaaaaggcgcaatcgccatgcccatctggctcaccggcagggtcaccagatcgaaaggtttaccgtcgctggtgtccaccagcacctcaaagcgttcacccatcaagaccggcaattcatcgaccttgaccggctcggccaacagaccgccatcgctggccaccacgtacagcgggcgcttatcgctggtggcaaaattgagggaacgggcattacagccgttcagcaagcgcaggcgcagccagccgcgcggcgcggcatgttcgggatagagggccccattggtcagtagcgtatcgccaaaccagccgacggcggcgctcatcacatccagctgatagtcgatctcgccggcggcggtgaacttcttatcctggacgatcaccggcacatcatcgattccccactgcttaggcagcagcaggcgcccgctctcttcatcctcgatcagcaccaggccggccagccccatcgccacctgccggccggtgctcccatgctgatgcggatgaaaccagcaggtcgccgcccgctgcgttggcgtgaagcttaccgtgcgggtggcacccggcgcgataaccccctgtggccccccgtcgacctcgcccggtacctccagaccatgccagtgcagcgtggtctcttccgccagctggttagtaatatccaccgtgacggtcttcccctgcgtcaactgcagcgcagggcccagcagcgacccgttgtagccccaggtagtggcattcagggcgccaaaccgcgttttgcccgcctggatcctgagcgcgatgcggttgcgcgcatcggcggctaacagcgacggtatcggcagagccgggcgactggcggcaaagaccgcccggctccataacggcaatgcgctggccatgccgaccgcggcggtcagtttgaggaagtctcgacgttgcatattcacatccttttattctgcgggcgaatatttgagcttaaaccctaccgtaacgggaaggtcaagcagaagagtaagaataaagatcggcgctgtgtaaagaagtatgctaatttgaagcgtcggtgatctaatggtagaaaaaatgaagacgcttttcagaacaatggtactcggcagcctgcttgctctctccgccaacagctacgcgctcagcgaatccgaagcggaagatatggctgatttaaccgcggtttttgtgtttctgaaaaacgactgtggctaccagaacctgcccaacacgcagatccgtcgcgcgctggtgttctttgcccaacagaaccagtgggacctgagcaactatgacagctacaacatgaaagcgctaggcgaagacagctatcgcgatcttagcggcattaacattccgacggcgaaaaaatgtaaagcgctggcccgcgattcgctcagcctgctggcttacgttaaataattccctgcgcgggcggcaacgctccgcgcctttagcatttcaatttccccctttaaatatttatatttattattgtatataaacaaaccttatttaattgcgaacctatcaatttgccaaataaagtaaacccataataatgaagaatgactaaaaaactaataaaatatcattattcatatattgcaaaataaaaagcacccttctagaatccggtaaaaatatacctacttcatggactgaaattgtgaatatctcgctgactcttcgtgttatcccactcgccgcgctgttagtagccggctgtagcaatacctcttcccgccagccggttaaaccgatcgccacgccgctgacgtcacagcagcaggcagagcaggagcgggcggccagcgaacaagcgcgcattgaatcctgtcgccaggcgttggattcgctaaaagaggttaacccacagcaagccactaaactcagcaatgactttaacgctttagtgcgcgcggcgtcacaatacaatagcgtgcgcgagaaagtggcggatcctacccggcttggcattgactccatgtatcagtttaaatccatcaaactgtgcgccgatatccagaaaacgctgatcgatagcctggtacagcgtggtgaaagcaaacaaccatgaacagagccgccacgctgaccctcaacgcgcccctgctgatgctcgtcgctgcgctggcgctttcaacccccttcaccgccggcgccgcgccggcctttcttgattacgcccaacagcaaacccagcaatctcaggcgcaagaaaaaaacgatgccgcaagcgcaaaacaaacacaagaaagccgccagagcgcagataataaaaaaaccggtaccaacacctcacaattacaaaaaagaatcaccagccagcaggcggcgattgcacaaaaagataagcttatacagcaattaaaaaaacagcttgccgctacgccgcaaacggatactgccggagcgaatgagcaagcggcgttgaataagagaattaatgaattacaggtcgccttaagcgccgctactgcagaaaaagaggcattaataaaaaaagcaggcgttgtgcagaataataatctacagcaaagcaaggccgcggcgcgtcagcagatccagcaattaacgacgcagattcagcaagccgaagctgaaaataaacgcctcagcgccagctttaccacgcttaataaagataaacacgcgctaatgacccaactggccgcaacggaaaaagagaaacaggccgtcctcgagcaggttaaggcccttaacgccgataagcagtcgctgactattcgcctcgccgctgcggagaaggcgcagcaggccgctcttgaccaggctaaagcgcttaacactgacaaacagccgctggctacccgactggccgccgcggaaaaagagaaacaggccgtcctcgagcaggttaaggcccttagcgccgataagcagtcgctgactattcgcctcgccgctgcggagaaggcgcagcaggccgctcttgaccaggctaaagcgcttaacgctgacaaacagccgctggcgacccggctggccgccgcggaaaaagagaaacaggccgtcctcgagcaggttaaggcccttaacgccgataagcagtcgctgactattcgcctcgccgctgcggagaaggcacagcaggccgctcttgaccaggctaaagcgcttaacgctgacaaacagccgctggcgacccggctggccgccgcggaaaaagagaaacaggccgtcctcgagcaggttaaggcccttaacgccgataaacagtcgctgactattcgcctcgccgctgcggaaaagacgcagcaggctgccctcgatcaggtcaaagcccttaacgccgataaacaatcgctgtccacccggctggccgccgcggataaagcgccgcatggccccgctaacgacgccgctgcgccaaaaaatgagccaccagagatggcggccatagtggcagcctatcgcctgcaggcggataaagacaacgcccagctacggatgaaagaagatgaaatcgaactgctgagaacgcagctttctgtacagtccaaaacgcgcagcggcgagagcgccgctgccaaactcagcgcatcgggagaacagcaggcttatgcgatcggcgcctcgatgggaagcgaggcgctcaacgtccttaccacccgtcgcactcagggagttaccgtcgacgcaggcctggtgctgcagggcatcgaagatgcctttcgcggccagcttcgtctcggagagcaggaacgtaacaaggcgctgtttgatgtgtcgcagcaggtttttcagaacctgaataaaatagagcagaaaaacatcagtgccggcaagaaatatcagcaggcatttgcgcgcaaaaaagatgtggtctttaaagagggcgtctacagccgcatcgattacccgggtaaaggaaaaataagcggtaacgacctggttaccgtggtgatcaaagagatgctgacggacgggacggtgatcaacgatatggaagcgaaagatcaggcgcttacgcaaaagctggatgcctatcccccggtgtttcgcgaaccgctgaagcgtctacagaaccacggctccgtgacgctcgtcgtcccgcctgaaaaggcctatggcagtaaaggattaccgccaaaaatcccgccaggcgccaccatggtttattccgtgcggatagtagatagccaacccgagccggcaaaatagcctcatcctctccaccgcccttccggggcggtggctgttattcctgcctcattgctgcaataaccgccgtgcatcctcatctatagttgtctatgatgttgcactcgttttacgggtgtaacagatgttaacgaaggaggagccttatcgtggccgataatccactgtggcatgaaacgctgcatgaccattttggtcagtattttagcgttgataacgtgctgtaccacgaaaaaaccgatcatcaggatctgatcatctttgataaccgcgcctttggccgggtgatggcgctggatggcgtcgtacaaaccaccgaacgcgacgagttcatctatcacgaaatgatgacccatgtgccgctgctggctcacggcaacgcgaagcatgtgttaatcattggcggcggcgatggcgcgatgctgcgcgaagtctctcgtcaccgtagcatcgaaaccatcaccatggtggaaatcgacgccggggtagtttcattctgccgccagtacctgccgaaccataacgccggcgcctatgacgatccgcgctttacgctggtgattgatgatggcgtcaattttgttaatcagacgacgcaaacgtttgacgtgatcatttcggactgtaccgaccctatcggcccgggagaaagcctgttcacctcggctttttatgaaggctgcaaacgctgcctgaacccgggtgggatctttgttgcccagaatggcgtcagcttcctgcaacaggatgaagcggtaggcagccatcgcaagctaagccactattttcgcgacgtcagcttctaccaggcggcaattccaacctattacggcgggatcatgacctttgcctgggcgagcgacaatgaggcgctgcgccatctctccagcgaaatcattcaggcgcgctttcacaaagccaacctgacctgccgttactacaatccggcaatccatacggcggccttcgccttaccacaatatctgcatgatgctctgtccgcaccgtgacgcgaaataagggggtgaactaaattgaaaaaattgaagctgcacggctttaacaacctgaccaaaagcctgagtttttgtatctacgatatctgttacgccaaaacggcagaagagcgcgacggctacatcgcctatatcgacgaactctataatgccaatcgcctgacggagatcctgacagaaacctgttctattattggcgccaatatcctgaatatcgcccgtcaggattatgaaccccagggcgccagcgtgaccattctggtcagcgaagagcctgtcgatcccaagctgattgaccagaccgaacatcctggcccgctaccggaaaccgtggtcgcccatctcgataagagccatatctgcgtgcatacctacccggagagccatccggagggcggcctgtgcaccttccgcgccgatatcgaagtttcaacgtgcggcgtcatttccccgcttaaagcgctgaactatctgattcaccagctggaatcggacattgtgaccattgactaccgcgtgcgcggctttacccgcgatatcaatgggatgaagcattttatcgatcatgaaatcaattcgattcagaactttatgtccgacgatatgaagtcgttgtatgacatggtcgacgtcaacgtttatcaggaaaatatcttccataccaaaatgttgctcaaggagtttgaccttaagcactacatgttccatacccgaccggaagagttgactgccgaagagcgcaaggtcattaccgacctgctatggaaagagatgcgcgagatttactacggccgcaatattcctgccgtgtaatctatgaaatgcccggcggcgcttttgcttgccgggcctgtagttctgcgccacccgacataaaaggcgtcattaacgctgctgcataaactcacgataggcggcgaccacctgcaggaaatcctcaacaccgcacagagagagactttcttcgtcgtagtagctcatcccctcctcgatttcgtcgccggaaaactccagctgattggcgcggatcatcacctcttcgccatccagccacagcgtatattcatgcccggcacgctgccaggaacgctcgctgcccttcacggtgcgcgcagcctgctccacttcgtccagcagagcaagattgcctttcacctcctcgttgaaccagtggccgatcgcctcgtgatccatcgacattcgcacctttaccactccggtaatatcgcgcagaaattcgtaatccatagtcttttcctctgcaagggcaatgcgtcaccgctgcactgtacccatgcagtaattatcgcagcagacagaaagaaaaaaagcgtagcgggcgggaggtttggaaataaaaatgcccggtgatgcaatgttcaccgggcattggagagtttatcgccaaacggtcagccgggctgaccgaatggtttacaccgcggtctggaagatcacgccgtcagctttttcagtgtactgatccagctggttgaagttcagataacggtaggtatcttccgccgtcttatccacctgcgccacgaaggtctggtactcttccggcgtcggcagtttgccgagcagcgaagccaccgctgccagttcggcagaggccagatagacgttagcgccggtacctaaacggttcgggaagttacgggtagaggtggaaaccaccgtcgcgccgtcggccacgcgcgcctggttacccatacacagagaacagccagggatttcgatacgcgccccgctcttaccaaacacgctatagtagccttcttcggtcagctgcgcggcatccatacgggttggcggcgccacccacaggcgagtcggcagttggcctttgtggctgtccagcagcttaccggcggcacggaagtggccgatgttggtcatgcaggagccgatgaacacttcgtcgatcttctcgccctgcacatcagacagcaggcgggcatcgtccggatcgttcggcgcgcacagaatcggctctttaatatccgccagatcgatgtcgatcactgccgcgtattccgcgtcagcatcggcttccagcagctgcggatccgccagccatttttccatgccctggatacgacgctccagggtacggcggtcgccgtagccttcggcgatcatccacttcagcagaacgatgttggagttcagatactcaacgatcggctctttattcagtttgatggtgcagccggcggcagaacgctcagccgaggcatcggtcaactcgaacgcctgctcgactttcagatccggcagaccttcgatctcgaggatgcgaccagagaagatgtttttcttacctttcttctccacggtcagcaggccctgcttgatggcgtacagcgggatggcgtggaccaggtcacgcagggtgatccccggctgcattttacctttgaaacgcaccagcaccgattccggcatatccggcggcatcacgccggtcgcggcggcgaaggccaccagaccagagcccgccgggaaggagatgccgattgggaaacgggtgtgggagtcaccgccggtacccacggtatccggcagcagcatgcggttcagccaggagtgaatcacgccatcgcccggacgcagagaaacaccgccgcggttcatgatgaagtccggcagagtgtggtgcgtggtaacgtcaaccggcttcgggtaggccgcggtgtggcagaaggactgcatcaccaggtctgcagagaagcccaggcacgccaggtctttcagctcatcacgggtcattggaccggtggtgtcctgagaaccgacggaggtcattttcggttcgcaataagcgcccggacggataccggcaacgccgcaggcgcggccaaccattttctgcgccagcgagaagccgcgggtgctttccgccacgtctttcgcctgacggaagacatcgctgtgcggcaggcccagcgcttcacgcgctttggtggtcagaccgcgaccgatgatcagcggaatacggccgccggcgcgcacttcgtcgatcagcacatcggttttcagctcgaagctggccagcagttcgttggtctcgtggttacgcacttcgcctttgaacgggtaaacgtcgattacgtcgcccatgttcaggttagatacatcaacttcgataggcagcgcgcccgcatcttccatggtgttgaagaaaattggcgcgattttaccgcccagacacaggccgccaccgcgcttgttcggcacgttcgggatatcgtcgcccataaaccacagcaccgagttggtggcggatttacgtgaagaaccggtcccgaccacgtcgccgacgtaggctagcgggtagcctttctgctgcagggcttcgatctgtttgattgggccaaccacgcccggctgatccggctcaatgccttcgcgggggtttttgagcattgccagcgcatgcagtgggatatccgggcgcgaccacgcatccggcgccggagagagatcatcggtgttcgtttcgccggtgaccttgaagacggtaacagtgattttctctgccagctgcggacggttcaggaaccattcggcgtcagcccaggattgcataacctgtttagcatgctcgttacccgctttggctttctcttccacgtcgtagaagttatcgaacattagcagggtatgggagagcgctttcgcggcaatcggcgccagtttcgcgtcgtccagcgcatcgatcagcggatggatattgtaaccgccctgcatggtgcccagcagttcaacggctttttcaggggtaaccaggggggaggtcgcttcgcctttggcgatcgcggcaaggaatccagctttaacataggcggcttcatcgacgcccggcggtacacggttaatcagcaggtctaacaggaattcttcttcgcccgcaggcgggtttttcagcagttctaccagcgcggccatttgggttgcatctaagggtttggcaacaatccccatggcggcacgctcagctacgtgcttacggtattcttctagcacgacggttctcctcgctctcattgtcataatgcggcctacacgtcttcaatcaatctgcctctgtcctggcttagcttgccgcgtgacgcatcttgaaggatttagtggctgggcgattttcttcacgctcctgtgagacagcagtttgtagggtaaatgcccgataccgcgtcggcagcatagcaggatttttgaaaggtgttaatctgtttacaaaaaagcaacattaaaatttagctgaatcgttaagggcaggatattgcaggctttctgttcaaatcccacgacaaaaattcctttccgcgtacaacgccacgggccgatcccaacaataatcaataaaaagccataccgcttacttatactcagcaaacgcgccgttttcgcagatactttagcgagatgggttactttttgggtcaggagtttccatgtcactgccgttcaaaccccatattatcgccctgctctgtagcgctggcttactcgcggcggcaggaacactctatgtgcaaagccgaaccccagcgacgatcgctgaaccgcctgcgcagcaagcgccagcgcccgcagcgtcgacgacacagccggtggccgccacttacacccaggcgcaaattgatcagtgggtcgcccctatcgcgctctacccggacagtctgctgtcgcaggtgttgatggcctccacttatcccgacaacgtcctgcaggcggtccagtggtcccaggataaccccgcgatgaaaggggatgcggccgtgcaggcggttgccagccagccgtgggaccctagcgtcaaatctcttgtcgctttccctgccctgctggcgatgatgggcgagaatccgccctgggtggaaaatcttggcaatgcgtttttggcccagccgcatgatgtgatggattcagtgcagcgtctgcgcgccattgcccaacagaccgggacgctgaaatccacaccgcagcagaaagtgattgtcacccctgccgcaccggtttcggccagcagcagcacgacagcaaccgcaaccgcccacacagcggcgcctgcgcccacgcaggtcattaaaatagagccgaccaatccacaggtggtctatgttcccagctataacccctccaccgtctatggtacctggccgaacagcgcctatccgccggtctatctgccaccccctcccggggagcagtttaccgatagcttcgtcaaaggcttcgggtacagcctcggcgtggccaccacctgggcgctgttcagcagtatcgactgggatgatgatgaccatcaccatcacgatgacgactaccaccacggcgattactcgcataatggcgataacatcaatattaatgtaaataatttcaatcatataacaggagaaaacctgccgggaaaccacgttaactggcagcacaatcctgcctatcgcggacacacaccgtatcccgataatacggtagctcagcgcttccatcagaccaacgtttccggcggactgagcgcgacccaacatgcgccagtcgatcgcgaagcgcagcgccaggcagcgatgacccagctgcagcataacgtaccgacggccacagcgggcaatctggcggcaaacaacgcctcacgcgacgcccagcgtcaggcggcctcggcgcagctgaagcaagccacccaacgcagtaattaccgcggttacgacagtacgccgacccaacagcagcgtcgagaagccgccaggagccacgagcagaaccgcacacctcagcagcagcagcgccggcagcagttccagtccgccacgccagcccagcgtcagcagacgctcagccatctgcgcgccaacgcccttagcggcaacgaaagccgcgccccctcctggcaagcgcagcaggaacgaggactgcagagccgccagttatccggcgtaaaccgcgagttacgcgagggcgccagagaacgtctttccgaacaccatgaactgcgtcgccgctaaggatgagcagaatgagatacccattatccgttgccctgtttacgttaatgctgtcgccgcttgccgccttcgcccaacagcagtttgccacgccggaacaggccgcaactgcgctggccgaagcgatcagccagcctaatgaagccgcgctgagcgaagtactcggcgataactggcagcagtttttacccacggacgggatcgaccctgccgccgtcgatcgctttcaacgcgactggcaggtgaaacatgtcatcatccagcagggtgacaaagcctggctcgatgtcggtagcgaggcatggcgtctgcccgtgcctatcgtaaaagcgtctgagggatggcgctttgatatggccgctggcgaagaggagatcctcacccgcgccatcggccgcaatgagctttcggcgatcgccgccatgcatgcctatgttgatgcccagcaggactattatcatctgaaccaccgctgggcgcagaaaatcatcagtagcgaaggcaaaaaagatggcttgtactggccaacttcgccgggcgaagcgccaagcccgctcggtccggcctttagcccgacggtgcccggtagcggctaccatggctatcgctttcgaattatcgccggtcgcgatgaccagagcgtcgccttgctggcctggccgatagcctggggtgaaaccggtgtgatgagctttatgatcgatcaacaggatagggtctatcaggccaatctcggtgaagagagcgccgcaaaggcacaggagataacgcgctttacccccgacgctgacgccggctggcaggtggcagaaccttaaaaaaaacgcccggttgcactcacgcaaccgggcgttttcattcacttagccctggtgaggcatcagagaaggatcgccggcaaaggctggttttgtgctggataatgccgcttcgtcagcgctgatgctaccggaattcgccgcccataccccttcattggtcttcgtcacctgctgatgctgggcattcagatcctggcccatcgccgcaatgtgggtcgtttccgtaccgccgctgttgtccgcccagggaatgttggcgtcagcggcgtaagccacaccggtaaaaaacgttgcagcgaccagcgctgtggttaaaaagcgtttcatctcacacctcatcgatatcattaactacctataagtttactgagttactattttcaaagtatgtatgaggtgtagcggtttatgaacagtgacatagttctaaacatcaggcataaaaaaagcggctcccggagccgcttttgcttttttcctgaaagaaaaagttactttttcttcgctttggcgtttggcaggtcggtgatgctgccttcgaacacttccgccgccaggccaacggactcgtgcagagtcgggtgagcgtggatggtcagggcgatgtcttcagcgtcacagcccatctcgatagccaggccgatctcacccagcagctcgccgccgttggtgccgacaatcgcgccgccgataacacggtgggtctctttgtcgaagatcagtttggtcataccatctgcgcagtcagaagcgatagcacggccggaagcagcccacgggaaggtggcggtttcgtagctgatgcctttctctttcgcttctttctcggtcagaccgacccatgccacttctggttcagtgtaggcgatggatgggatcactttcggatcgaagtagtgtttcagaccggagataacttctgcggcaacgtggccttcatggacacctttgtgcgccagcatcggctgaccgacgatatcgccgatagcaaagatgtgcggcacgttggtgcgcatttgtttgtcaacgcggatgaagccgcgatcgtcaacttccacgccagctttacctgcatcgaggtttttaccgttcggtacgcggccgatagcgaccagcactgcgtcgtaacgctgcgcttccgccggtgcttttttaccttccatggaaacgtaaataccgtcttctttcgcttcaacggcagtcactttggtttccagcatcaggttaaatttcttgctgatgcgtttggtgaagactttcaccacgtctttgtcggcagccgggataacctggtcgaacatttccaccacgtcaatctctgaacccagcgcatggtatacggtacccatttccagaccgatgataccgccgcccatcaccagcatgcgtttcggtacagatttcagttccagagcgtcggtggagtcccatacgcgcggatcttcatgcgggataaacggcagctgaatcggacgggaacccgccgcgatgatagcgttgtcgaagttgatcacggttttgccgttttcgccttccacttccagggtgttagcgccggtaaatttacccagaccgttaaccaccttcactttacgacctttggccatgccagccagaccaccggtcagctgagtgatgactttttctttccaggtgcggatcttgtcaatgtcagttttcggttcgccgaaaacgatgccgtgttcggccagcgctttcgcttcttcgataacttttgccacgtgcagcagcgctttagaagggatacaacccacgttcagacaaacaccaccgagggtgctgtaacgttctacgatgacggtttccagacctaaatcagcgcaacggaaggctgcagagtaacctgcggggcctgccccaagtaccacgacctgagttttgatttcagtactcatcatgacctctgtaatttatatccggcgggtctgacgctattattcttacgcccaagtccaccgggacgttctatccgcgtgtattttacaaaattgttaacaatttttaaacaacaaacggcaaacgattttgtcctttgttgctgataatccccaacagcctgaggttatcagaaaaaagccggccgtcaggccggctttttcgattacatcaccaggcggcgaatgtcgctcagggtgttgttaatgatggtaatgaagcgggcaccatcagcaccgtcgatgacgcggtggtcgaaggacagagagattggcagcatcaggcgcggcacaaactctttaccattccataccggctccatcgcggacttagacacgccgaggatggccacttccggcgcgttaacaatcggcgcgaagtgggtggtacccaggccgccgatgctggagatggtgaagcaaccgccctgcatttcgccagccgtcagtttgccatcgcgcgctttcttcgagatggtggtcaattcacgagacagctcggtgatgctcttcttgttcacgtctttgaagaccggaaccaccagaccgttcggggtatccaccgccacaccgatgttgatgtatttcttcagcgtcaggcgctgaccatcttcggagagcgagctgttgaagcgcggcatctgctcaagcgcagcggcaaccgctttcatgatgaagaccactggagtgaatttcacgtccagtttacgcttctcagcttcggcattctgctgcttgcggaacgcttccagatcggtgatatcggttttgtcgaagtgggtaacgtgcgggatcatcacccagttacggctcaggttggcgccagagattttctggatacgacccagctccacttcttcgacttcgccaaacttgctgaagtcaaccttcggccacggcagcatgcccgggataccgccgccagcggcagccgcaggtgcggattcagcgcgtttaaccgcgtctttcacgtaagcctgaacgtcttcgcgcaggatacgacctttacggccggtgcctttcactttcgccaggttaacaccgaactcgcgcgccaggcggcgaatcagcggggtcgcgtgaacgtaggcatcgttttcagcgaattcgcttttaccttctgctttcgcagccggcgcagcggcaggcttagcggcctgagccggggcagcagctggtgccggggcagcagcctgagccggagcggcggcaggcgcagcgccttccacttcgaagaccatgatcagggaaccggttttgactttatcgccggtgctgattttgatctctttaacggtacccgcgaacggcgccggaacttccatagaggctttgtcgccctctacggtgatcagggactgttccgccgcgactttatcgccgactttaaccatcacttcggtgacttcaacttcgtcgccgccgatgtccgggacgttaacatctttcacgcctgctgcggcagccggagccgcagcagccggcgcggcagcctgtgcctgagcggctgctggcgcagcgcccgccacttcgaagatcataatcagggagccggtggaaactttatcgccggtattgattttgatctctttgacggtaccggcgaacggcgccggaacttccatagaggctttatcgccttctacggtgatcagggattgctcagcggcgatggtgtcgcccactttaaccatgatctcagtgacttcgacttcatcgccgccgatatccgggacgtgaacttctttcgctgccgcggcagccgctggagcagcggcggccggagcggcttctttcttctcttcctgcgcaggtgcagcggcggctgcaccttcggcggaatcgaaaatcataatcagtttgccagtctcggttttgtcgccgacggagactttaatctctttcacgacgccagcctgcggagacgggacttccatagaggctttgtcgccttctacggtgatcagcgactgttcagcttctactttgtcgccaactttgaccaggatctcggtgatttcaacttcatcagccccgatgtccggtactttgatttcgatagccattattcttttacctcttacgccagacgcgggttaactttttctgcatcgatgtcgaatttcgcgatagcgtcagccaccactttcttatcgatttcaccacgtttagccagttcgcccagcgctgctacgaccacataggaagcatcgacttcgaagtggtgacgcaggttttcacggctgtcggaacgaccgaagccatcggtacccagtacgcggtaatcatcagccggtacgtaagtacgaacctgctcagcgaacagtttcatatagtcagtggatgccactgccggagcgtcgttcattacctgagcgatatacggcacgcgcggggtttccagcgggtgcagcatgttccagcgttcgcaatcctggccatcacgcgccagttcggtgaaggaggtaacgctatacacgtcggaacccacgccgtagtctttcgccaggatctgcgctgcttcacgcacgtgacgcaggatagaaccggagcccagcagctgaactttacctttgctaccttcgatggtttcgagtttgtagatacctttacgaataccttcctcggcgccttccggcatggccggcatgtggtagttttcgttcagcgtagtgatgtagtagtaaacgttctcttgcgcttcgccgtacatacggaccagaccatcatgcatgatgacagccacttcataggcgtacgccgggtcgtaagagatacagttcgggatagtcagcgactgaatgtggctgtgaccatcttcgtgctgcagaccttcgccgttcagggtagtacgaccggaagtcccgccaatcaggaagccgcgagcctgctgatcgccagccgcccagcacagatcgccgatacgctggaagccgaacatcgagtagtagatgtagaacgggatcatcggcaggttgttggtgctgtaagaggtcgcagcagccagccaggatgcgcctgcgcccagctcgttgatcccttcctgcagaatctggcctttctcgtcttctttgtagtaagcaacctgctcacggtcctgcggggtatactgctggccgttcgggctgtaaataccgatctgacggaacagaccttccataccgaaggtacgcgcttcgtcggcgatgatcggcaccagacgatctttgatcgacttgttcttcagcatcacgttcagggcgcgaacgaaagcgatagtggtagagatttctttgttttgctcttccagcagcgcgctgaagtcggccagggtcggcagctcgagtttctcagtgaacttcggctgacgagtcggcagatagccgttcagcttctgacgctgagcgtgcaggtaagtgtgctcttcggaaccttccgggaaggttacgtacggcagtttttcgagatcggcatccgccaccggcacattgaaacgatcgcggacgtagcgaacaccgtccatgttcattttcttaacctggtgcgcgatgttcttaccttcagcggtatcgcccataccataacctttaatggtatgcgccaggatcacggtcggctgacctttggtctcctgcgctttcttcaatgcagcgtagactttcttcggatcgtgaccaccgcggttcagagcccagatctgctcgtcagtccagtcagcgaccagggcagcggtttccggatatttgccgaagaagtgctcacgaacgtaagcgccgtctttggatttgaaggtctggtagtcgccgtcaacggtttcgttcatcagctgaatcagcttaccgctggtgtctttacgcagcagctcatcccaacggccgccccagataaccttgataacgttccagccagcaccaccgaagatgccttccagttcgttaatgattttgccgttaccggtgaccgggccgtccagacgctgcaggttgcagttgatgacgaagaccaggttgtccagtttttcacgggtggcgatggtgatagcgccttttgattccggctcatccatctcgccgtcgcccaggaaggcgtaaacggtttgttcggaggtgtctttcagaccgcggtgttccagatatttcaggaatttggcctgatagatagcgcccaacggccccagacccatggatacggtcgggaactgccagaattccggcatcagtttcgggtgcggataagaggacagacccttgccgtgaacttcctggcggaagttgtccatctgctcttcggtcagacggccttccaggaacgcacgtgcatatacgcccggagagatgtgaccctggaagtacaccagatcgccgccatctttctcagtgcgcgcacggaagaagtggttgaagcagacttcgtagaaggtcgcggaagactgataggacgccatgtggccgcccagttcgagatcttttttcgacgcgcgcagaacggtcatgatggcgttccagcgaatcgcagaacgaatgcgacgttccagatccagattgcccgggtattccggctcatcttcaacggcaatagtgttgacgtagttgccggcggaagcgcctgcagcaaccttcactccgcctttacgggcttcagaaaggagttggtcaatcagatactgagcgcgctcaacaccttcttcacggatgaccgattcgatcgcctgtagccagtcgcgagtttcgatcggatccacgtcattgtgtaaacgttctgacatgggggtattccttatctatctaatcgttgattaatctggaacctgtcccattgaactcttcgttcttcacgctggaacaaccaaaaattcaataagacaggttctgcgtttagttgccgcgctctaaaaatggcgcttaagaaccggagttctcgtcctttcgttgctgtaaacgacgcagtgagcgctctcgacggctctgctcacgactacgatccagcaaaatttcctcaatgaacgccaggtgacggtgcgacgcttcacgcgcctgctccggctccccggccattatcgcctcgaaaatgcgagtgcgatggttgctgaccaacgggagcatttcccgccgggcatacagcaattcaaagttctgacgcacgttttgcgccaacatcggctccatacaccttagcagatgaagcaacaccacattgtgtgccgcctcggtgacggcgatttgatactggacgacggcgccggactcagcgtccaaatcgcccgactgctgagcgcgttcaatagcctgatgcagctcacggatacggtcgcgatcctcatcattgctgcgcagcgccgcgtaataggccgcgatgccttccagcgcgtgacgggtctcaagcagatcgaattgggattcagggtgatcggacagcagctcaaccagcggatcgctgaagctctgccacaggcggctctgaacaaacgttccacctccctgacgacgaagcaacaagcccttggcttcgaggcgttgaatcgcctcacgcagcgaggggcgggaaacgtcgaactgtttagccagttctcgttctggcgggagtttttcaccggggcgcaaggtcccctcaagaatcagaaactccagctgctgctctatcacatcggataattttggttggcggattttgctgtaggccatattccctgtctctgccattagcccggagtcaattggtcttaccaatttaaagttcgtagcgctaaagtaacaaagtattcaccttctgtccatacaggttttgattgaaatcagtaaacccgggacattttaacaaccttacagaaataacatttcagaaatgtaaccttgcacaaatgttacgtttactcacaaagaggtagccttaactttatagaaacgaaaaattacgctttctgaaccgattcaacgctgcaataaatgaatacagagtcatttacagtgaataaataatgacaaagcagcatgcatcaaaatacgacagattgtgactattgatgtctttttagacacatcgtcatcatcccttcataaagcaggtgcattcaaacgcgcttaccactattctgccggagacgaaaggcctttttcggaattaccacacagccttccgtaaacaaaacaatacagaaacggaagttcctgaatacacaaacacaacaatatgtgcgcgccatcactcaggtaaaaagtgggccacttcgcccaaattttcgctggctatgctttcaggcagggacagcagtgaagcagcaacctgacggatgacgtacacaaaaaataaccacacacgaggtttcatatggaaggtcaacagcacggcgatcggctgaagcgcggcctgaaaaaccgtcacattcagctcatcgcgctgggcggggctatcggcaccggcctgtttctggggagcgcgtccgtcattcagtccgccggcccgggtatcattcttggttacgctatcgccggttttatcgctttcctgatcatgcgtcagctgggcgaaatggtggtggaagagccggtggccggctcatttagccactttgcttacaaatactggggcggttttgccggcttcgcctccggctggaactactgggtactgtatgtcctggtggccatggcggaactgaccgccgttggcaaatatatccagttctggtggccggaaatccctacctgggcctcggcggcggtcttcttcatcgccatcaacgccattaacctgaccaatgtcaaagtgttcggtgaaatggaattctggttcgcgattatcaaagtggtcgccgtagtggcgatgattttgttcggcggctggctgctgttcagcggcaacggcggcccgcaggcgacggtacgtaacctgtgggaccaggggggcttcctgccgcacggcttttacgggctggtgatgatgatggcgatcatcatgttctcctttggcggcctggagctggtggggatcaccgccgcggaagcggataatccggagcaaagcattcctaaagccaccaatcaggttatttaccgtattctgatcttctatgttggttcgctggcggtgctgctctccctgctgccgtggacccgcgtcaccgcggacaccagtccgttcgtcctgatcttccatgaacttggcgatacgctggtggcaaacgctctgaacgtggtggtgctgacggcagcgctgtcggtttataacagctgcgtctactgcaacagccgtatgctgttcggccttgctcagcagggcaacgcgccaaaagcgctgctcagcgtcgacaaacgcggcgtgccggtgaataccattctcgtctcggccctggtcactgcgctgtgcgtgctgatcaactacctggcgcctgaatctgctttcggtctgctgatggcgctggtggtctcggccctggtcatcaactgggcgatgatcagcctcgcgcatatgaaattccgtcgcgccaaaaagcagcagggcgtggtcacgcgtttcccggccctcttctatccgctgggcaactggctgtgcctgctgtttatggcggcggtgctggtgattatgctgatgaccccggggatggcgatttccgtctggctgatcccggtatggattgcggtgctgggcgtgggctacctgtttaaagagaaagccgccgccaccataaaagcacaataatacatctcatcaatacttcactttgctctgcgccctcccctgaataatgggcgcagagcattgttatctgcttcacactttcccctccatagcttatttatccatatcgtcaacgagttcctgcaacgtatttctgccaaccgcagccaataattctctccatactgcaacggagagaccgcacatggcagagaacacgctttcaataagagaaaagattggttacgggatgggtgatgccggatgcaatattatctttggcgccatcatgctgtttgtgaactatttttacactgatatattcggactggcgccggcgctggtcggcgtacttctgctctcggtgcgagtcatcgatgcggtaaccgaccctatcatgggcgctcttgccgaccgcacccgtagtaaatatggtcgctttcgtccatggctgctgtggatcgccttcccctacgccctgttcagcgtcctgatgttcaccactcctgagtggacctacaatagcaaagtcatctatgcgtttgtgacctactttctgctgtcgattacctataccgcgattaatattccctactgctcgctgggaacggtgatgaccgccgatccgaaagagcgtgttgcctgccagtcttatcgtttcgtcatggtgggtatcgccacgctcctgctgtcattgacgctgctgccaatggccgactggttcggcggcgccgataaagcgaagggctaccagatggcgatgaccgtgctggcctttatcggtatgtgtatgttcctgttctgcttcgccaccgtgcgcgaacgtatccgcccggcggtgcagacgaatgacgaactgaaaaaagatctgaaagacgtctggaaaaatgaccagtgggtgcgcatcctgctgctcacgctgtgcaacgtctgtccgggctttatccgcatggccgccaccatgtactacgtcacctgggtgatgggacaaagcacccattttgccaccctgtttatcagcctcggcgtagttgggatgatgattggcagcatgctggcgaaagtcctgaccgaccgctggtgcaaactgcaggttttcttctggaccaatatcgtgctggccgtgttctcctgcgccttctatttctttaatccacacgccaccacgctgattatggtgctctacttcctgctcaacattctgcatcaaatcccttccccgctacactggtcgctaatgtccgacgttgacgactacggcgaatggaaaaccggcaagcgcatcaccggtatcagcttctccggtaatctgttcttcctgaaggtcggcctggcggtcgccggggcaatggtcggtttcctgctgtcatggtacggctacgacgccggcgcgaaagcgcaaagcgcctccgcgctgaacggtatcgtgctgctattctcagtcattcccggcgtcggctatctgatcaccgccggcgtggtgcgtctgctgaaggttgaccgtaccctgatgcgccagattcagagcgatctggagaagcgccgcagcaactacagcgagctgaacgaataccaggaactgaaaaccagtgaacacgtaaggaaagcctgatgaacaactggccaaacccctttattgaacagcgtgcagacccctttatcctgcgccatcttagccactactactttattgcctcggtgccggaatacgaccggctggagatccggcgcgcggtaacccttgaaggattacgcgatgctgagccggtcgtggtttggcgcgcgccgcaaagcgggccgatgagccagctgatttgggcgccggagctgcatgaaatagacggtaaatggtatatctattttgccgccacccatactcacgatctggatgcgctggggatgttccagcatcgcatgttcgttctcgagtgcgctgacagcgatccgctgaccggccgctggcaggaaaaaggccaggtggtcacgcctttcgataccttcgccctcgatgccaccacttttacccatcaggggaaacgctggtatctgtgggcgcaaaaatccccgcatatcgaaggcaactcaaacttgtatctcgccgaaatggctaacccgtggacgttaaaaggcgagccggtcatgctgagcaagccggagttcgactgggagtgccggggatttaaggtcaacgaagggcctgcggtactgatgcatggcgataagctatttatcagctattccgccagcgccaccgatgaaaactactgcatggggttgttatggatcgaccggcaggccgatccgctgcagccggcaaactggcataaagctccgcagccggtgttccgcaccagctatgaaaaccgccagtatggcccaggtcataatagttttacccaaacgccggaaggggaagatgtgctggtgtatcacgcgcggaattacactgagatagaaggcgacccgctgtatgatcccaatcgccatacgcggttaaagctggtcagctggcgggaagacgggatgcccgacttcggtattccaccggcggatacgctgtagcggttcggaatgttacccgctggcgcgggttctccaggccgggtcaggcgaagccgccacccggcaacatgaccagcacggcgtctgatatatcgcccggcggcgctgttgcttgccgggcctacgtgacgtgagcctgcgggtgactcgccaggccggataagcgcagcgccatcaggcaacaaaagccccgcaggtacgtacatcgtggcaggcagcgcgcgggctcaggccgttaaaccagggtaccgtaaatcgtcagcagcgccataatcaccactaccaccagcgaagtcttcttagccatcgataccgcagccttcggcgtcgctactttatccacgtgcggctcacgggccagggaatactgcgccaggcgggtcaacacctgatactgcgacgaatggcggtcgcccagcgaagcaaaccacgccgggagcgctttttcaccatggcccaccagggcatagaccacccccaccagacgcaccggcagccagtccacaatatgcaggataccatcgatcccggactgcaaccggtggtgcggcgtctggtagcgcgccagccatgtctgccaggcgcgcagtacgctgtaggcgataagcgtcagcgggccccaggcgccccccacgacaaaccagaaaagcggcgccagatagtatcgatagttaatccacagcagcgcattttgcagttcgctaaggtactcacgctcatcacagcccggcggcacgccgtgaataagcgtcagctcgctggccatggcatcgcaggcgcgactgtcattgcgcgacgccgctttcagataggcatggtagtgcagccgaactttgccggcgccaatgcatagcaggcccagtaaaatccagaacaccagcagcggtatgttaaacagctgcccctgcagcagacgctgaatgatatacacgaccgcgacagccaccagcgtcatcagtagcgtgcccggtaacgagaaatgttttatccggcgaaacgccacctccagccgatgatcaagctgccagtgttcgcccagcttaaacagccgttcggcgataagcaccaacagcgtcgtaaacagcgtcatgaggtctccttttctgacggggcgctgagcagcgcacggtattttatccagtcaaaggccggtcctggatcggttttccgcacgggcgcgatatcgctgtggcccgcaatgttttcggcgatagccggataaagcgcgatcagcagatccgtcaccgccgccagctgccggtactgcgcgtcggtatacgccagagtatcggtgccttccagctctatgccgatggaaaagtcattgcagcgttcgcgtccctgataacaggagacgcccgcatgccacgcccgcttatcgaaaggcacatactgcacgatttcgccatcacggcgaatcagacaatgcgccgaaacgcgcagatgagcaatctcggcaaagaaaggatgcgcgtgcggatccagggtaccagtgaacagcgcatcaatccacggaccaccaaattcccccggtggcaggctaatgttatgcaccaccagtaaggaaggggtctcttcatccggacggcagtcatggtgcggcgagggaacccgacgcgcgccgaccaaccacccctcgttcaactgcatgcgggatctcctttcgcgaactcatgcttccgggccacacgccggcccaaaggatgaagtgtgtatggtactgaaacgtcgttcaggttagcatgtttcccacttctgaatcttatctatctggagctttatcatgtcgcctcgtcgttacaaccccgaccgccgccgtgacgtgctgctggaacgtattaatctcgatattaccgatgctgtcgcacactccctgcgggaagatctgggcggcgaagtcgacgccaacaacgatattagcgcgcaattattgccgcaggatgcacgctcccatgcggtggtcattactcgtgaagatggcgtcttctgtggcaaacgctgggtggaagaggtctttattcagctcgccggtgacgacgtgaatatcacctggcacgtggccgacggcgatgcggtcaaagccgaccagccgctgttcgaattggaaggcccgtcgcgtattctgctcaccggcgaacgcacggcgctgaactttgtgcaaaccctctccggcgtcgccagcgtcgtccgtcgctatgtcgacctgctcgccggcaccaaaacccaacggctggatacgcgcaaaacgctgccagggctgcgtaccgcgctgaaatacgcggtactctgcggcggcggcgccaaccatcgactgggcctgttcgacgcgttcctgattaaagaaaaccacattatcgcctccggatcgatccgtcaggcagtggaaaaggcgttctggctgcatcctgatgtgccggtggaagtggaagtggaaaccctggatgaactggagcaggcgttaaaagccggggctgatatcattatgctcgataacttcaccaccgatctgatgcgcgaggcggtgaaaattaccgcaggccaggcggcgctggaggtctccggcaacgttacctttgacaccatccgcgaattcgccgataccggcgtcgactatatttccgtcggcgccctgaccaaacatgtgcaggcgctcgacctgtcgatgcgcttccgctgagcaacaggccttcacgcttccgggcgtgaaggcctgaatttgcggcccgcctcgcagtcgcccgtgctcaccatgaaatccagataaaaaccctggaacccgctttcccggatcgttttcgccccctcgcctgcgcccctcaatcccttcacagtgctcctgtcacaacaaggagcgacttatggataaacaacgaggttttaccctgattgaactgatggtggttatcggaatcatcgccattcttagcgccatcggcatcccggcctaccagaactacctgcgtaaagccgccctcaccgacctgctgcagacctttgtcccttaccggacagccatcgaactttgcgcgctcgatcatggcggcctaacgccatgcgacggcggcagcaacggcattccctcgccgacaaccacgcgctacctctccgccatgagcgtggccaaaggggtcgtcaccctcaccggtcaggagagtctgaacggactgggggtcaccctgacgccgacctgggacaatgccgagggcgtcaccggctggcagcgcgtctgcaccatcaccggcaatagcgcgcttcagcaggcctgcgaagacgttttccgggtgaagtgagggctaatgcatgaaaacagaacagctgatccccctctgccgtcgctaccacgccatgctgctgcatagcgatgaacagacaatctctattgcggtggttaataccccgccggcggagttgatggaggcgctacgcttcgcgacgcaaaagcggatcgacattgaatgctggagccaggagcagatggataagcgtctgcaggcccaggaaaagcaggcgcaactggcgcagaacgacgggccggaaaatatcgccgaacgggtcaaccagatcctcgaacaggccctgcgtcagcgggcgtctgatattcatatcgagcccacggaaacgcacttacgcatccgcctgcgggtcgatggcgtccttcacgccctaccgttgctggcccccgaactggccgccccggttatcgcgcgactcaaggtcctggccagtctcgatatcgccgagcaccgtttaccgcaggatggccagttcgcgctgaatcttgcgggacgaccgctctcttttcgcatcgccactctgccctgccgctatggcgaaaagattgtcctgcgccttctgcatcaggttgaccaggcgctggatctggaagcactcggactctcatcctcccagctggcggcctttcgccaggcgctgaaccagccgcagggtctgctgctggtcaccggcccaaccggaagcgggaaaacggtgaccctctacagcgccctgcaggccagaaaccgtgagcaagtgaatatctgtagcgtggaggatccactggagatccccatcgccgggatgaaccagacgcaaatcaatccccgcgccggactcacttttcacagtgtgctgcgcgccctgttacgccaggatccggatattgtcatggtgggcgagatccgcgatgccgagaccgctgaaatcgcgctcaaagccgcccagaccggtcatctggtgctctccaccctgcacaccaattccaccagcgaaaccctgacccgcctgcagcaaatgggcatcgcccgctggatgatttcctctgcgctctcgctggtcatcgcccagcgtctggtccgcaagctgtgtccccactgtcggcgtaatgccggcagcgccgccgacctgccgcacagcctgtggccccgcccgctgccacgctggcaggcagcgggctgcgaacattgttaccacggatattacggccggctggcgctgttcgaagtgctgcctgttacccccgggctacgccaggggatagtccagggacttaacgccattgagattgaatctctggcgcgagccgcagggatgatgacgctttttgaaagcggctgtcaggctatcgaacagggattgaccagcctcgaagaggtggtgcgggtgctggggatcccccatggcgactaagcgtctctggcgctggcgcggtatcgatgtgcagggcgccccttgtcaggggatgctatggcaaaccaagcgtctggaggtcctgcagcacctccaacagcagcgagttataccgctggctgtacgccgctgtgcggtgaagcagagcctctggcacccgcgctacagttgcgaaacgatccgccagctggcgaccctgctgcaggccggcctgccgctggcggaagggttatcgctgctggcgcagcagcagtcgcatgcccagtggcaggcgctgcttgaggcgctaggccgcgagctggcccagggcgtggcgttctctgccgcgctggcgcagtggccccaggcttttccgcccctatatctggcgatgattagcaccggcgaactgacgggcaagctcgatatctgctgcctgcagttggcgaatcagcagcaggagcagcagcggctcgccagcaaagtcaaaaaagcgctgcgctacccgctgatcgtgctctctctggcgctgttggtggtgctggggatgctctattttgtcctgcccgagttcaccgccatctaccagacgttcagtacgccgctaccgctattgacgcggatggtcgttgcggcaggcgacatgctaagtcgcggctggccgctgctgctggcctcgctgctgagcccgctgctgctcaaccagctgatccggcggcgcagcgactggttgctgcgccgccagcggttgcttaacgcgctccctctcattggctccctgatcggcggacaacagctgagcctgatcttcaccatcctggcgttaacccaaagcgccggtattagctttctgcaggggctgcaaagcgttgaagagtccctgtcgtgcccgctgtggcgccagcgtctggcgcaggcccgcgcgctgatcgttcagggggagccgatttggcaggcgttaagccgctgcggcggttttacaccgctgtgcctgcagctcatccgcacgggggaaagcgcgggagcgctggatcagatgctggaaaacctggcgcatcaccatcgccagcaaacctatcagcgagccgatagtctggctgcgcatcttgaacccatgatgctggtgataaccggctcgctggtcgggattctggtggtggcaatgtatttgcccgtttttcacctgggcgatgccattggcggggcgggaggatgagaaacactggcgccgcgcaggcgccagtgcagccgattacaggctattgaatacccggttctcttgttcctgaacgcggataaagggcgtacgcttggtcagctctttcagacgcgaggcgccaacgtaggtgcaggcagaacgcaggccgccgagaatatcacgtgcggtattctccaccggtccacgcaaaggcagcttaacggttttgccttccgccgcgcggtatttcgcgacaccgcccacatggcgggtcatcgccgactcggagctcatgccgtagaacagcatgaatttctctccgttctcttcaacgatggttccgccgctctcttcatggcccgccagcatgccgccaagcatcacgaaatcagcgccgccgccgaaggctttcgccacatcgcccggcatggtgcaaccgccgtcgctgatgatctggccgccaaggccgtgcgccgcatcggcacactcaatcacggcggagagctgcggatagccgaccccggtcttaacgcgggtggtgcagacggatcccgggccgatgccaactttgacgatatcggcgccggagaggatcagctcttcgcacatttcaccggtgaccacgttcccggcgatgatagttttttgcggccaggcttcgcgcgccttcgccacgaactgtacaaagtgctcggagtagccgttggcgacgtcgatacacacaaaattcagctgtgggttctgagagaggatctgctgggttttttcgaaatccgcatcggacgtgccggtggaaaccatcacatgcttgagtacgtctgcggatgcgccctgggtaaacgccagccattcttcagcggtgtagtgcttatgtaccgcggtcagaataccaaaagtggccagcgctttagccatgctgaaggtgccgacggtatccatgttagccgcaataatcggcacgccggaccaggtcaggcctgaatgtttaaaggtgaattcacgttccagctcaacatcagaacggcttttgagggtagagcgtttcgggcggataagaacgtctttgaaaccaagcttcagatcttcttcaatacgcatgtgcgaattcctggggttaatggcatgaatgtgagagcacaactccagtgacgttatcatacgcgcgaatcaggcccgcgcaagactgcgattttcactttttttacgctacaatcgtataaatttacctggtgaatggagaaaaaggcgcctatgccttcccctgccggagtattgtttttaaccatttgatttgcttgattaaaacaaacagtatagcggacggcgatcccggttggcgcggggtcctcacgacatgctcactgtcgcctccccggcgcgctgccagtcatcgctgtctgcctgcaaaaaatacgagcaatccgtttcagggtcagaagatatggggtacacagtcgcgttaacaggcgggatcggcagcggtaaaagtacggtcgccgacgccttcgcgcagcttggggttaaggttatcgatgccgatgttatcgcccgtcaggtggtcgagcccggtaccccggcgctccaggccattgtcggccactttggaccacagatgattgcccccgacggcacgctgaaccgccgcctgctgcgggaaaaaatttttgctcacgtggaggaaaaagcctggctcaatgcgctgttgcacccgctgattcagcaggaaacgcgccgccagatgcaggccgccacctccccttatctcctctgggtcgtacctttgctggtcgaaaaccgcctgtccggccaggccgatcgcgtactggtcgtcgatgtgccgaaagagacgcaaatcgaacgcaccatgctgcgcgataaggtcagccgcgaacatgctgaacatattcttgccgcccaggccacgcgccagcagcgcctggccgtcgcggacgatgttattgaaaacactggcacgccggatgcagtggcatcggatgttgcccgcctgcacgaaaagtatttaacgctggcatcgcaggccgcctcacaggaaaactcgtaatgcatacccccgttctgtttgaacatcctcttaatgagaaaatgcgcacctggctgcgcatcgaatttctgatccagcagatggctttccatccgcagattgccagccatgccgatgcgctccattttttccgtaacgccggcgatctgctggatgtcctggagcgcggcgagttgcgcactgacctggttaaagagctggaacgccagcagcgtaagctccagtcatgggcagaagtgccgggcgtcgatcaggagcgcattaacgagctgcgccaccagttgaagcagtcctccagcaccctgatggccgcgccgcgcattggtcagtttctgcgtgaagatcgcctgattgcgctggtgcgtcagcgcctgagtattcctggcggctgctgcagcttcgatttaccgaccctgcatatctggctccatatgccacaggcgcatcgcgacgagcaggtggccagctggcttgccagcctcgatccgctggtccagtccctgagcctgatcctcgatcttatccgcaactccgcgctgttccgcaaacagaccagcctcaacggcttttatcaggataatggcgaagatgccgatctgctccgcctgcgtctcgatctggctcaccagctttatccgcaaatttccggccataagagccgtttcgccatccgtttcctggcgctggacagtgaatatggaatcgtgccggagcgctttgattttgaactggcctgctgttaaggagataacatgtcagaagagactatcgtcaactgcccgacctgcggcaaaactgtggtgtggggcgagcagagtccgtttcgtccgttctgtagcaagcgctgccaactgatcgatctgggagaatgggctgcggaagagaagcgcatccccagcgcgggggatctctccgatagcgatgactggagcgagcagcaaccctgatttgatggcaagctaacccggcgcctggcgggttagcctcgcgccccggggctcagccctgggcgataagtttgctgataaccggttcattcgccggaggaaacgccgccggatccaacgttggtcccgccatccaccgacccggctgcccttctttaccccacggctcgccttgccaactttccacgaggaaaaaccacagcgtaatatggcgatcggggaactgatactccagcttatcaaagagcgaagaggtggtgaccgtaatcccaacctcctcctgcagttcgcggattagcgcctgctcaggcgtctcatcagattcaatcttcccgcccgggaactccagcttattcgccatatgggcatcggcggcgcgctgggtaataaagatttcgccttgcggattgcgaattatcccgacggcgatttgcagttttttcattgaatgcgctccataaaaaaggcgcagaactctgcgcctttgtttgttttatcagaccttagctcagacggccgtgacactgtttgtactttttgccggagccgcacgggcacggatcgttacggcccactttacgttcgccggtttgcgccgccagatcctgggctgcggcttcatcatcgctctgatggctgagctgctgcatctgcgccaggcgctcggcctcttcacgacgctgctgttccatcgcctcgacttcttccggcatccgcacctggactttgctcagggtgctgatcacttcatacttcagtgactccagcatcgcggcaaacattgagaacgattcgcgcttgtactcctgcttcggatctttctgcgcatagccgcgcaggtggataccctggcgcaggtaatccatcgccgccaggtgctctttccacagcgaatccagagtctgcagcatcacgcctttctcgaagtggcgcatcatctcggcgccgaccacttcttctttacgctggtaggtttctaccgcgctctgcagaatacgttcgcgcagggtctcttcatgcagctccggctctttatccagccactctttgattggcaggtcgagatcgaagtcgtttttcagacgctcctgcagaccttcgatatcccacatctcctccagcgactgcggcggaatatgggcatcgatcgtcgccttaaagacgtcttcgcggatgctgttgatggtttcgctgacgtcagacacgtccagcagctcgttacgctgggtgtagatcgcccggcgctggtcgttggccacatcatcatattccagcagctgcttacggatatcgaagttacggctttccactttacgctgggcgttggcgatcgccttggtgacccacgggtgctcaatcgcctcacctggtttcattcccagtttacgcatcatgccagacacgcgatcggaggcgaagatacgcatcagggcatcttccattgacaggtagaagcgggaagaaccggcatccccctgacgaccagcacggccgcgcagctggttatcgatacggcgagattcatgacgctcggtaccgatgatgtgcagaccgcctgcggccagtaccgcatcgtggcgtacctgccagtcggctttgattttctcaatctgctctggcgttgggttttccagcgcagcgacttccgcctgccagctaccgccgagcataatatcggtaccacgacccgccatgttggtggcgatggtcaccgcggaagggtagcccgcctgggcgacgatatccgcctcgctggcgtggaatttggcgttcaggacgttgtgcttgatgccagctttagtcagttcgcgggaaaccacttcagatttttcgatcgagatagtccccaccagcaccggctgaccggcagcggtacgagttttgatatcttcgataattgcctgaattttttccgcttcggtcatatagaccagatccgccatgtctttacggatcatcggacggttggtcggtacaaccacggtatccagcttatagatagagctgaattcaaaggcttcggtatcggctgtaccggtcatccccgccagcttctcgtacagacggaagtagttctggaaggtgatagaggccagagtctggttctcgttttggatctccacgccctctttggcctcaacggcctggtgcagaccatcggaccagcggcggccctgcatcgtacggccagtgtgctcatcgacgatgataacttcgccatctttgacaatgtagtcaacgtcgcgggtgaacagcgcatgggcgcgcagcgcggcggtaacgtggtgcatcagcataatgttggttggagagtacagggactcaccttcatccataatgccttcctgtaccagcagctcttcaatcagcaccagaccacgttcggtcaggttaacctgacgcgctttttcatccaccgagaagtggccttcgccagtgaaagtgtccgaatcctctttttcctggcggatcagatgcgggatgattttgtttaccttgcggtacatttcagagctgtcttccgccgggccggaaatgatcagcggcgtacgcgcctcatcgatcaggatggagtccacctcatccaccagcgcatagtgcagtttacgctgaacgcgctcttccgggctgaaggccatgttgtcgcgcaggtagtcgaagccgtattcgttgttggtgccataggtgatatcggcagcgtaagcttcacgcttcgccggcgccggcaggccggacatgttgatgccaactgtcatgcccaggaattcaaacagcgggcggttattttcggcgtcacgctgggccagatagtcgttgacggtcactacgtgaacgcctttgccggttagcgcgttgaggtacgccggcagggtcgcggtcagggttttaccttcaccggtacgcatctcggcgatgcagcgatcgttaagcaccataccgcccagcagctggacgtcgaagtggcgcatgccgaatacgcgcttactggcttcgcgaacgacggcgaaagcttcagggatcaggctttccagcgtttcgcctttttccaggcgcgcgcggaattcagtggttttcgctttcagctcgtcatcagagagcttttccatcgccggttccatgccgttgatgatattgacgactttgcgcatacgacgcagcgtacggtcgttacggctgccgaaaaccttggttaacattttgataagcataataaaatctcaaacgccccgcggtgcggagtcacaaaaaataggatggtccgtggttattttcagctgagacgttgaggccctgcgcggatccccgccacctggcttatccaggcgctgacgcggaaggcagaatatgaagaagggatgtaacccgcctggcggatcaccaccggcggcgtgctgtcctgcgtcagcagcgcgctgagggtgtcgagcagcgccagatgctgagcctgcagcggggaagtttcttccgccaccggcagcgcctgcggcgccatggcgaaggagagatgacgaataacggtgcgaatggcgtgctgatgccagtagtcgacggtaaagctgggccggcgattcgtctccagaagcgccagctgagagaaattaaccttgctcggattgtgattgctggcggtcgccttcgctggcgccgcggtctcgtgaccgttgcttagcgcaggcaggccgaggctggccgcgaccatccccaacaggagatgcggccaaaaataccgtctgccaaactgtcgccagcgcgtcagcaatccactcacgttcattacctttctttgctagacccgtcgtcgttcaggctgtctctttattaatgtttttcgcaggacaacctgatgtccacggggtaaagcaaccctgagaaataattttgcgctcaaatactaacattaataccggcctgaggcagcatgaatgaaggcgattgcccggcgaaaacgcttaataaagcagcgaacgcacgctaattattatccagggatcgcagcgaaaataactggagggtgctataaaagaaaaacgactggctccctggtcggagagagtaccaggttaccagtcgaatttactgaatggtcaggcttacgccagaaccattgacggtgcgcggaacgccattggcagttttgcgtcgtcttcgaaggtcacatactcccaggcttcctgttttgccagaaccgcctgcagcagtttgttgttcaacgcgtgacccgatttgtacgccgtgaatgcgccgataatgttgtgaccacacataaacaggtcaccgatcgcatccagcattttgtggcgaacaaattcgtcttcaaagcgcagaccgtcttcgttcagtacgcgataatcgtcaacaacgatggcacaatcgaagctgccgcccaggcacaggccgcgggactgcagatattcgatatcgcgcataaaaccgaaggtacgcgcacggctaatctgacgcatgaacgcatcggccgagaagttcagcgtatagcgctgggtgctggcatcaatcgctggatggttaaaatcgatggtgaagtccagcgaaaaaccattgtacggtttgaattcagcccatttgtcgccatcttcgacgcgaaccgtctctttgatacgtacaaatttcttggcgcagttcagttcatcaatgccggcgtccagcaacagataaacgaacggagccgcactgccgtccataatcgggatttccggcgcatcgacttcaacaataatgttgtcgatacccaggccagccaatgcggcgttcaggtgttcaaccgtagaaatccgcacgtcatgctcattaaccaggcaagtacagagcatggtatcacgcacagatttggcatcagccggaaaatctaccggtggattcaagtcggtgcgacgatagatgaccccggtatttgccggcgcagggcgtaacgtcagtgtgactttcttgccggtatgcaaaccgacgccagtcgcctgaacgatacgtttaagagtcctttgtttgatcatcgtataatctcgccaatttacctatccaaccgaagtgtacaccactatcgggaggccagtttagcacaaagagcgcagatgcccaacttccagtcgattcttaatcggcttgcttacgcaggaaggctgggatatccagataatccggctctttcgcggtttgcggcgtattgtcgttcaccactttggctgccggcttctgctcttgcgtcagcggcgacataccatgctgctggtaacgatccatcaccggctgctgaacctgcttgttggttaccagggtgatttccggacgcttatccatgccaataccggtcgccactacggtcacgcgcagctcgtcgttcatatccgggtccagagaggtaccgataaccactgtcgcattatccgaggcaaaagcacggatggtgttacccacagtttcgaactcgtccagacgcaggtcgaagcccgcagtaatgttgaccagcacgccgcgcgcgcctgacaggtcgatatcttccagcagcggagaagagatagccatttcagccgcttcttccgcacggtcttcaccgctcgccaccccggagcccatcatcgcgtagcccatttcagacatcacggtacggacgtccgcgaagtcgacgttcatcagacccggacgggtgatcagttcggcgataccctgcaccgcgcctttcaggacgtcgtttgccgcgccgaatgcgtcgagcagggaaattccacgacccaggaccttcagcagcttgtcgttcgggatggtgatcagtgagtcaacgtgcttggacagctcggtgatcccctgctcagcgaacgccatgcgcttcttaccttcaaaattaaacggcttagtgaccaccgcaacggtgaggatccccagatctttcgccacttccgcgactacgggcgccgcgccggtaccggtaccgccgcccatgcctgccgcgatgaacaccatgtctgcgccatcaagggctgcgcgcagcgcttcacggtcttcatcagccgcgttacggccgacttccgggttcgcgcccgcgcccagacctttggtaataccgctaccgatctggatagtctggccaaccgccgtcttacgcagcgcctgcgcatcggtatttaccgcgaagaattcaacaccctcaatgcgctcgcgcaccatgtgttcaacggcgttaccgccgccgccaccgacgccgatgactttaatcaccgcgtcgttggtcagttccataggttcaaacatagtttctctccgtcttgtgcctgtcgcctgagaacgctaattgtctgcgttctcttaaaaaattaaaactcttttcgcagccagctgttgagtcgcttaatccacgagcccactgaggccgtcacgcgtttttctacttccgcttcaccactgagatgtgactcttttccgtagtgcagcagccccaccgccgttgaataatacggctcctgggcatagtcggttaaaccggtgatgttcagcggcgcgccaatgcgcacctgagtatggaacacgcgctgcgcacaggccgccagaccttcaatttgcgccgcgccgccggttaacacaatccccgccgccagatgatgtttaacaccctgctggcggagctgttcctgcagctgcaggatctcttcattgaccaggttaagcagctcggtatagcgcggttcaatcacctctgccaacgtctgacgctgcaggctacgcggcggacgtccaccaacgctcggtacttcgacgttttcgtctttaccgacgatggaacccaatgcgcatccgtgacgaaccttaatcgcttcggcatcgctcggcggcgtaccgaaggcataggcgatatcgctggtcaccacgttaccggcatacgggatcactttggtgtgacgcaatgcgccgccggtgtagacggcgatatccattgtaccaccgccgatatccacaacgcagacgcccagctcacgttcgtcttctgttaataccgaataactggccgctaacccggcgaaaataagttggtcaactttcagaccacaacgttccactgctttaacaatgttttttgccatatcgttatggcaggtgatcagatgcaccttcgcctgcatacgcacgccggacagccctaccgggtttttaatcccttcctggtagtcgatagcatattcctgcggaatcacgtgcaggacacgatgttcatcgcgaacgcgaaccgacttcgcggtgtggaccacgttctcgacgtcgtcctgcgtcacttcttcttccgaaatcggtaccatcccgatttcattctgacagcttatatgtttacccgaaagtgccaaataaactgatgaaatctggcaatccgccatcagttcggcctggtcgatggcgcgctgtacgcatttcaccaccgactcgaggtcgttcacaccgcctttatccataccacgcgatgggcaactgcccacgccgatgatattgatcatgccgtcgggcagaacttcccctactaaagcggccaccttggcggtgccaatctccagtccaactaccagttttctgtccgtcgccttgatcattgttgttctgcctgtgcctgattctgttgttgattagtttcctctgcgggagcaggtacccagcccactgccgcacccgagtcataacgcaaatcaacgtagctaatccgtttgccgtcggtctgcgcctgctgctgaagaaccgggtagagttccataaagcgctgaagccgtttcatggtatcgccacggccaaggttgagcttgatgtcattattaagcgtcaactgccaggagcgacgggcggtcatcgccgccactttcaacgtgaatttatcctttgccagcacctgccccatgtcacgatacccctgcagcacttcgttctcgctgccttcgggaccgtataacatcggtaaattctgtttgctggtgcgatccgccggcacgctgaaggcatttccttctgcatccaccatatgttgatcattccagcgcgcaatcggcacatattcaaccagatgaatcttcaattcatcgggccactgctttcggacgctcgcctgcttaatccacggcagacgttcaatctggctctggatgatgttcacatcctgagtcataaaggtacccggcgaacccagcgccaggatcgcctgacggatgtcatcattgcgcgtatagtgacgctcgccggtcaccaccatcttcgacagcggtaagcgctgcgcatcttccatccagccaagaaccatccacccgctgaccagcacggtaaacagcaccgccagcaggaaaacgatccctgccagccgcgttccattactccgacgcgaagaagaagcctcttcttcatggttccgcgtattcagcgcagcctgcgacatatcaccccgccaggtccagaattcgtacaacaagctgggagaagctcattcctgcctgacgcgccgccattggcacaaggctgtggctggtcatgcccggggaagtattcgcttccagcagataaaactggccatcgctgtccagcatcacgtcaatacggccccagcctttgcaacccagaacattccaggctttaagcaccaggttctgaatagcggactcacgcgcgggatcttcaaatcctgggcagaaatattgcgtctcatcagagagatacttcgcctcataatcatagaaggttcccgcggcctggatacgtattgacggtaaaatttcttcaccgactatggcgacggtaaattccggtccactgagccatttttcgaccaaaacttcatcatcatgctgaaaagccaacgccaatgcacttgctaaatcacaactttcgctgactttcgacatcccgacgctggagccttcacggctcggcttgatgatgaccggcagacccagcgccgcaatttgctgttcgacgtcagtagacagcccggcggcaaactgggcgcgggtcagcgccacccacggcgcgaccggtaatccggcgccctgccacagccacttgctgcgcagcttatccattgaaatcgccgaagccatcacgccgctgccggtataaggcagctggattaactccagcagcccctgcagagtgccatcttccccgccgcggccgtggagggcaataaacgctttcttaaagccctgcttttttagctgggtaatatcaacatcgcgcgggtcgaccggatgggcgtccaccccgccttcacgcagcccggccagcaccgccgcgcctgaattcagcgacacttcacgttcagcggaggttccaccgaaaagcaccgcgattttatcagccatggcgctcctcctccgttttttgcgggatcagtttgatttcagccaggtggcgggcgattttaccgatgttaccggcgccctgcaccagtactaaatcgttgccggtcaggactgacgccagcatctccgcggcctgggccgaatcgggcaccaggatcggatccactttcccgcgaccgcgaatggtgcggcacagcgagcggctgtcggcgcccgggatcggcgcttcgcccgccggatagacgtccagcatcagcagggcatccacctgggtcagcacgttggcaaaatcatcatacagatcgcgggtacgggtataacggtgcggctggaataccatcaccaggtttttatccggccagccggcgcgcgctgctttaatggtggcgtccacttccgtcgggtggtgaccgtaatcatcgatcagcatcgcgctgcccggtttgccgttgacttcggccagcggaaactcgccaagaaaatcaaagcggcgtccagttccctggaagctctccagtgcgcgcagaatagcccgatcgtcaatcccctcttccgtcgccacggcgacggccgccgccgcgttcagcgcgttatggcgtcccggggcattgagcgtcacctgcaggatcgctttatcctggcgtaccaggcggaaatgcccctgcgccccaacctgacgatagtcctcgacgcgcacgtcggcgtcgtcgctaaaaccgtaggtggtgatctgccggccaacgcgcggcagcagttcccggatcaccggatcgtccacgcacatcaccgcgcgtccgtagaacggcaggttgtgcaggaagttgataaatgtctgcttcagattctcaaagtcgccatggtaggtatccatgtgatcggcttcgatgttggtgacaatggccaccatcggctgcagatgcagaaacgacgcgtcgctctcatccgcttccgcgatcaggtaacggctatggccaagacgggcatgtacgcccgccgcttttaccagtccgccgttgacgaaggtcgggtccagcccggcctcggcgtaaatgctggataccatcgcggtggtggtggttttgccgtgggtcccggcaatggcgatcccgtggcgaaagcgcataagttccgccagcatttcggcacgacggatcaccgggatacgcgcctcatgcgcggcaacgatttccgggttatctgccgaaatcgcgctggaaacgacaaccacgctggcatcacgcacgttttccgggcgatggttgaaataaatggtggcgccaagctgcgacagctgctgggtcaccggattcggcgccaggtcggagccgctgatctggtaaccttcgttagccaacacttcggcaataccgcccataccggcaccgccgatgccgacaaagtgaatgtgccgaacgcgacgcatctcgggcactatggaacgcagttttgccaaatcttgtgtattcattctttacgccatcaacttctgtattcgggcggtgaaaatcaccgcaattagcgcgccaaagctacggcgctgacctcttctgctacccgctcggtagcgtccggaatcgaagcgccacgcgctcgttccgccatatccagcaaggtttcccgatcccagctcgccagggtagaggcaaccgcctctaccgtgaactcaggctgttcaagaattttcgccgcgccggctttctccagcggcagcgcattccagtactgctgacgatctttgtgctggaacgggacaaacagcgctggtaaacctgcggccgcgatttcgctaaccgtcagcgcgccggaacggcaaaccacaacatctgcccaggcatacgccgcggccatgtcatcaataaattccgtcactttatgctgcggctgtccggcggcggcataggcctgctgcacggtttgctggccgcctttgccgctttgatgccagatggtcaccgtagcgccgagcttcgccgccacctgcggcatcgtctggttcaggacgcgcgcgccctgagagccaccgaccaccagcacgcgaatcggtccctgacggccaaccagacgctgacctggcagcggtagcgccagtacatctgtgcgcaccgggttcccaacgacgtccgcatgcgggaacgcgccgggaaacgcctgcatcactttcttcgcaatcttcgccagccacttgttagtcaggccggcaatgccgttttgctcgtggaggaccaccgggatccccagcgaccacgccgccagaccgccaggcccggaaacatagccgcccatgcccagcaccacgtccggctggaaacgcttcatgatcgcccgcgcctgacgccaggcgttaaagatacgcaccggcgccagtagctgcgctttgatacctttgccacgcaggccggagatgcggataaaatcaatttcgatgccgtttttcggcactaaatccgcttccatacgatcggcggtacccagccagcgaacctgccagccctggtccattaaatggtgcgcgaccgccagtcccgggaacacatgcccgccggtaccgcccgccatcaccatcaaccgcttttcctgaccgctcatcgcacaccccgtgtaaacgcctgggctttttccagacgcgtttcataatcaattcgcaacaacaacataatggccgtcgacataatcaacagactggaaccaccataactgatcagcggcagcgtcagacctttcgtcggcagcatccccgccgccgcgccgacgttaactaacgcctggaagctaaaccagataccaatcgcacaggcgaggaagccggaaaagcgatgatcgatctccagcgctttacggccaatcgacatggcgcggaaagcgacgaagaataccattaaaagcgccagtaccacaccgatataaccgagttcttcgccgataatggcgaagataaagtcagtgtgcgcttccggtaaatactccagtttttgcaccgagttgccgaggccctgcccccacatctcgccgcggccgaaagccatcagcgactgggtcagctggtagccgctgccgaacgggtcttcccacgggttccagaaggaggtcacgcggcgaatacggtatggttcggcgaggatcagcaggaccaccgccgaaatacccatgccgataatggcgatgaactgccacagcttcgcgccggcgagaaacagcatcgccagcgtggtgacgaacaggaccaccacggtaccgaggtcaggctgcgccagcagcaggatggccagtacgaaaatcacgcccatcggttttaagaagccgcgcaggttgttacgcacttcgtcggctttacgcaccagatagttggcgatgtagcagaacagcgacagcttggtgaactccgccggctgaatacgcagcggaccaagggctatccagcgcgatgcgccgtttaccgagctgcctactaccagtacgatcagcagcatgacgatcgaggcgatcagcatcgcggtactgtggcgctgccagaaatccatcggcagacgtagcgtaatcatcgccagcgcgaaggccagcacaatgtacaggccgtcacgcttggcgaagaggaaaggatcgttcgccaggcgctgtccgaccggcatcgacgccgaggtcaccataataaagccgatcgccgccaggccgaaggtcagccatagcagcatccggtcatacatcaccagactgtcgttatctttcgggcgcgagcccatcacccagcctttcagcgcagcgaatagccaggcgaaaataaacatccccggcaatcgcggcagtctcagccgaggcaggctcagctgcggcattctcaggcgtgggagagagaaacgcatcaacctaactccttcgccagacgggcaaacatctcgccccgttgttcaaagttcttaaactgatccaggctagcgcaggccggcgacaggagcaccatgtcccccgctttcaccaggggagcaatctgacgcatcgcctgttccatagtctcagtttgtaccgccacctcaggacgcagctcagcgagctcggcgccatcgcgaccaaagcagtacaggcgaatacgatcgccgccgaggtagcgcttcagcggggtaaaatcagcggacttgccgtcgccgcccagcagcagatagagcgtgccgtccagctgcaggccgttcagcgccgcctcggtgctgccgacgttggtcgccttcgagtcgttaatccagcgtacgccgttgtgatccagcaccagctggaaacggtgcgccagaccggtaaaggtggtcagcgccttcaggctgctggcccgcggcagacccgcggcatcggccagcgccagcgccgccagggcgttgctgtagttatgctgaccggtgagaggcatctctttcacattgaggactttctcacctttaacgcgcagccaggtttcgccctgctggcggttaaggtggtagtcaccgacatcgacgccaaagctaatgcagcgttcgtccgccccgcgtaccggcatggtgagcgcatcgtccgcgttcaccacgcaggtcttcgcattctcgtaaatccgcagcttcgccgcgcgatactgctgcagtcccagcgggtagcggtccatatggtcctcagtcacgttgaggatggttgccgccaccgcctgcaggctggaggtggtttccagctggaagctggagagctccagcacatacagctctcgatcggtgtccagcaacatcagcgccggcaggccgatattgccgcccacgccgacgttaactccagcggctttcgccatctcgcccaccagggtagtaacagtgcttttgccgttagaaccggtaatggcgataatcggcgcctgcgcttcgcggcagaacagttcgatatcgccaacgatctctacgccagcgtcggccgctgcgctgagcgaaggatgggccagcgcaattcccggactggcgacaatcaggtccgccgccagcagccaggtatcattgagtccgccgacatggcattcgaccgattcgggtaatttatccagccccggaggcgcgacgcgggtgtccatcacgcgcggggttacgccgcgcgccatgaaaaagtccacgcatgacaggccggtcatgcccagcccaattatgacgacttttttaccctgataatctgccatgattaacgtaccttcagcgtcgccaggccaatcagcaccagcatcagcgaaataatccagaagcgcacgataacgcgcggctccggccagcctttcagttcatagtggtggtggatcggcgccatgcggaagatgcgctgaccgcgcagcttaaaggagccgacctgcagaataaccgacagcgtttccaccacgaaaaccccgcccatgatcaccagcaggaactcctgacgcagcagcacggcgataatgcccaacgcgccgccgagcgccagtgaaccgacgtcgcccataaagacttgcgccgggtaggtgttgaaccacaggaagcccagccccgccccgacaatcgccgtacagacgatcaccagctcgccggcgtggcgcagatacgggatatgcaggtagttggcgaaattcatgttgccggtggcccatgccaccagcgcaaagcctgccgcgacgaaaacggtcggcataatcgccaggccgtcgaggccgtcggtcaggttgacggcgttgccggtaccgacgataacgaagtaggccagcaagatatagaacagccccagctgcggcattacgtctttaaagaacggcaccaccagctcggttgccggggtatctttccccgccagatacagcgcgaaggccacgcccagggcgatcaccgacatccagaaatacttccagcgggcgatcaggcctttggtatctttgcgcacgactttacggtaatcatcaacgaaaccgatgatgccgtagccgattaataccgtcagtacgcaccagacgtacgggttagatggataggcccacagcagaacggaaacggtgatcgcggtgaggatcatgatcccgcccatggtcggagtaccgcgtttactgaaatgagactccgggccgtcgttacgtacgacctggccaaaggcgagtttttgcagacgggcgatcatgcgcgggcccatccacaacgagatgaacagcgcggtcagcaggctgacgatggcgcgaaacgtcagataagaaaagacgttaaagccggaataatatttgaccaagtgttcggccagccatactaacatgtcccagtctcctgtaatgcgcgtactacctcttccatggcggcactacgtgaacccttcactaaaatggtcattattttgtgctccgccagcagctcgcgcaggcgagccaccacggcggctttatcgttaaaatgttcgcccacgccgctggcgcggctgatatccgcgctcaaggcgccgacgctgaggacgcaatccagccccgccgctttcgccgcttcgccgacttcgcgatggcaggccgcgctctccgcgccaagctctgccatatcgccgaccaccatcgtgcgaaagccgggcatctctgacagcacctgcaccgccgcggtcatcgaaccaacgttagcgttataggaatcatccagcagcagctggctctcggtcagccggatcgggaacagacgtcccggaacggcctgcagctgcgccagtccggctttcaccgccgccaaatcggcgcctaccgccatcgccagcgaagtggcggccagcgcattagcgatgttgtggcgtcccggcagcggcagcagtacgtcaacgttgccggttggggtctgcagcgtaaattcggtgccgtggctggtgatctgcacgttggtcgccgtgaaatcgctgttcgccgcgttcggcgagaagcgccacactttgcgatcgccaatcaccgcctgccagttcagccagtcgttattgtcggcattgaggatggcgatgccattttccggcagaccggtatagatttcgcccttcgccttcgccacgcccgccagcgaaccgaaaccttccaggtgcgccgcagcaaggttgttgaccagcgccgcttccggacgcgtcaggctgacggtccaggcgatttcgccctggtggttggcgccgagttcgatcaccgcgtactgatgctctttggtcagccgcagcagcgtcatcgggacgccgatatcgttgttcaggttgccggcggtatacagcgtgttgccgcactggctgaggatcgccgcggtcatctctttaaccgaggttttaccggacgagccggtcagggcgacgacgcgagtcggcacctgctgacgcacccaggcggctaactcaccgaaagcctgccgggtatcgttcacaatcacctgcgggagatcgcaggccagcggacgactcaccagcagcgcgccggcgcccgccgctttcgcctgttcggcaaaatcatgggcgtcgaaacgctcccctttcagcgccacaaacaggcagcccgccgtcactttacgggtatcggtggtcacctcgtcgatagcgacatcgctaccctgccgttcgccatgggcgatcgcggcaagttgacttaacgtaaagcgaatcatgctaccgctcccagcagacgcgcgacggtcacgcggtcggaataatccagacggcggttgccgacgatctggtaatcttcatggcctttacccgccaccagcaccacgtcgttctctttcgcctgcatcacggcgttggtcaccgcttccgcgcggccttccatcaccttcgcctgacctgcatcgagcatgccggccagaatatcgttgataatcgcccgcggctcttcggtgcgcgggttatcgtcagtaacgaccacgatgtcggcaaattcttccgcgatagcgcccatcaacggacgtttacctttgtcgcggtcgccgccgcagccgaagacgcaccacagcttgccgctgcagtgcaggcgtgccgcctgcagcgctttttccagcgcgtcaggcgtatgggcataatctaccaccacggcaggtttacccggcgcgctgaacacttccatacggccgcacaccggctgtaaacgcgctgcgctcttcagcagatcggccagcggatagcccagcgccagcagcgtggccagcgccagcagcaggttgctgacgttaaatgcgcccatcaggcggctttcgatttcgcccttgccccagctggagtcaaactggatggtcgccccgctgtcgtgatagttcaccgcggtggcctttagccagcggccgtggcaattcgggttgatatgatcttccatcgataccgccaccgcgtccggcagttttgccagccagcgacgaccgacttcatcgtcagcattgacgatggcctgaccgcaatgatgggtggagtacagcatccatttcgccgcttcgtagtgctccatgtcgccatggtagtcgagatgatcgcggctgagattggtaaacaccgaggcggcaaactgcagggccgctacgcggtgctgtaccagaccgtgggaggagacttccatcgcgccgaaggtagccccctgcccgaccagactggagagcacatgttgaacgtccaccgcggaaccggtggtgttttcagttggaacgactttatccagcagaccgttaccgacggtccccatcaccgcgctggtttcgccgagcagctttgcccactgcgccagcagctgagtggtggtggttttcccgttggtgccggtgacgcccaccagacgcagctgctgcgacggctgatgataaaaacgcccggccagcgccgataagcgttcgttaagctggctcaggtagataaccggcacgccgtgtatttcacagatctcaccgtctttagcttcgccctgcgcttcagcaataatggcagccacaccttgcgctatcgcctgcgggatataacgacgcccgtccgcctgatgaccctgtaccgcgataaagagatcgccggaagcagccacccggctgtccagcgtcatctctcgcagaatgcgctccggtgcgtttggcacccatggagcgagtaggtcgcgcaaattacgatctgccacctgttccctcgccttgattaattacaaattcacttttttcgcccgttgccagcgcatccggctcgatgttcatggtgcgcaatacgccgcccatgatggcaccgaagaccggcgcggaaacggcgccaccgtagtatttacctgcctgcgggtcgttgatcaccaccaccagcgcgaagcgcggatggctggcgggcgcaacgcctgcggtgtaagcaatatatttgttgatatagcggccatccggccccacttttttcgccgtaccggttttaatcgcgatacgatagcctttgatcgccgctttcacaccgccgccgccgggcagcgccacgctttccatcatatgaacgacggtacgaacgagtgattccgggaagacgcgctcgcccggaaccggaggatcaaccttggtaatcgacaacgggcgatagatgccatagctgccaatcgttgcgtagactcgcgctaactgtaacggggttaccattagcccatagccgaaagaaaaggtggccctctctatgtcagaccaccgttgtttttgaggatataagccactgcgttctccgaccaaccccaaattggtcgcctttccaagcccaaaacgtgagtaagtatctactaacgctgaggacggcatcgctaacgccagcttagaaacaccgacgttactcgacttctgtagcaccccggtcagggtcaattcgctgtagcgcgccacgtctttgatttcgtggccgttaattcgataaggcacggtattgagcacggtattttcgttgacgataccgcgctgcagcgccgtcatgaccaccatcggtttcaccgtcgaacccggctcaaacacgtcggtaatcgcacggttacgcatggtgtcttttgccgtaccggcgaagttgttcgggttataggatgggctgttggccatcgccagcacttcaccggtgttaacatccactaacacggcgctgcccgactcggctttgttaaaggccacggcgttgtttagctcgcgatagaccagcgcctgcaggcgttcgtcgatactcagcgccaggttgtgcgctgcctggctatcggtagaagagatgtcttcaattacccggccatagcggtctttacgtacgatacgctcgcccggctgaccggtaagccatttatcaaagcttttctcaaccccttcaatcccctggctatcgacgttggtaaagccgatgaggtgagcggttacttccccggaagggtagtaacgacgggattcttcgcgcagatgaatgcccggcagcttcagcttcttgatgtaatcggccatgtcagggttaacctgacgcgccagatagataaaccgcatccgcggattggtattgatgcgcgtcgccagctgatccagcggcatattgagggcatccgccagcgctttccagcgcgtatccagggtaaccccgccggcgtcatggagctctttcgggtcggcccagatagccttcaccggcacgctgaccgccagcggacgtccggagcgatcggtaatcatcccgcgcgcggtggacacttcctgtacgcgcagagaacgcatatcgccctggcgcaccagcatatcggggctgatcacctgtagccaggcgacgcgacccagcagaaaagccagcgccagcagaatacagccgcacagcaacgcaaaacgccaactgataaagttggcctgttcttcctgacgttttgctttaggcgtttttggcgctgctttcatccgtcgcaataatccttatttctgtacaacgatattttcttgtgatggatcgacgtgttgcatctgtaacttctcggtcgcgatccgctcaacccgactgtgatcgccgagcgcgttctcttcgaggatcaggttgcgccactcaatatccagggcgtcgcgctccagaaccagctgttcacgctgcgcggtcaacaggcgcgtgtgatgcgcagtggtgaccacggtaatcgccgtaataatgatgcaaatgaacaggcagagtggcagtttcccaaaccgcagaaggtcgtccccgatcacgccaggcaaagcatggcgctcgttgcttccaatcgaccctttaaccttgcttaaggcctctgtcactctgccgatcatgcgttcgtcctctctgcgatacgcagcactgaactacgggcgcgtggattctctgccacctcttcttcgcccggcatcaacttgcctagtgctcgcaactcacggccgcccagttttttgagctgcgcttcggtcatcggtattcccgccggaacctgcggaccgcggctttgctcacgcataaagcgcttcacaatgcgatcttccagcgaatgaaaactaatgatcgacagccgcccgcccggggccagcacgctgagcgagctttttagcgcctgctctatctcctccagttcactgtttacccatatgcgcaccgcctggaaggtacgggtcgcgggatgtttgtgcttatcttttaccggcatcgccgcggcgatgacttccgccagctctttggtgcgggtcatcggctgaatgcgattacgttcgacgatcgcgcgggcgatacgtttgccgaaacgctcttcgccaaaggttttaatcacccaggcgatatcgtcttcttcagccgtctgcagccattcggccgcggactgaccgcgcgtcggatccatgcgcatatccagcggcccgtcacgcataaaggaaaagccgcgttccgcatcgtcaagctgcggggaagagacgccgagatcgagcagaatgccgtcgatcttaccggtaagattgcgctcgccgacgtactcagcgagttgtgaaaagggaccatgtacgatggaaaagcgggggtcatcgatggtttgcgcgacggcaatcgcctgcgggtcgcgatcgatagccagcaagcgtccttccgcacccagccgggagaggatcaggcgcgagtgaccgccgcggccaaaagtaccatcaatatagataccgtctggacgaatattgaggccgttgacggcttcatccagaagtaccgtagtatgtttataattttccatcatttttataaggacaaatcctgcaggcgctccgacagttcaccggtcgcggactgctcagcgtcgatatcttccttgacccgttgataccaggtcgtttcatcccacagttcaaatttattaaactgcccgaccagcatcacttcttttgtcagcccggcatgctgccgtaacaccggcgcaatcagcaagcggccggcattatccatctgacattcgctggcatgacccaaaagcaaacgctgtacgcgccgctcaacgggattcatgctcgataaacgcgacaatttctgctcgatgacttcccattcaggcaatggataaagcagcaggcacgggtgatgaatgtcaatggtgcataccaattgaccggcagcgtcctcgatcagcccttcgcgatagcgcgttggcacggccaggcggcctttgctgtcgagattgactaacgttgctccacggaacatgccagcctcaccccttttcgccactttaccccacaaattcccaccagaaggagtttacggagcggaggaaaagcttgtcaagccagcacggatgccaacggagctcaaaaacccattatttacagccgacattagccctgatgaaaaaatcatcaacaggcgaggcaaattaacgttatgaatacgtgtaagaaaataaccaacaaactcgtaacagttataaacaacagaatatcttcggcgggaaaatataaagtgtcagtttgcgacgcgagcggcattttaggccattatgccggccgttaacagtacctgttgctggcagagggactggccaggcgcgggatatgacggggaagaaagcgtggcgcgtacaaaatgagtgttaattcagcaattaacctgatgaatgtaacaaaataatacaattaaagtccgcgcagtcattttttgtaccccatttggagtcacaaaacgatggtcagtgaataaaataaaataacgagtaaagaagtttagggatttgtctgaaatatattcagttttgcattttgcacgtcaattgcctgatttatcgccagcggcctgcttacggtcaggcctgccaggtttatacctgggcgctggcgatatggcgcccttagcggcgattcaggctaccgcgacgatagagattacggcgaatacggctaagacccggcttcggcttgcgaggttcgtcgaggctggcgaggacaatctccagcacccgctcagcgacatcgcgatgacgctgggccacggccagtaccggacactgcagaaaatcgagcagctcattatcaccgaaggtggcgatcgccagctcggagggcagtttaccctcgcgacgcaaggtcacatccattacgccctgcagcagcgggaaagaggtggtaaacagcgcctgtggcatcggatgggtttcaagccatttctcaaacagctgggccgccgcttcgcgctcatagctgttggcatagagataatgcacctcacgcggatcgtcctgccaggctttacggaagccctgttcgcgcaggaagctcaccgacagctccggcagcgcgccgagatagagcaccgtttcgccaggaaacgtccgcagctcagctgcgagcatctcggcgtcatcctggtcagcgccaaccacgctggtgaagtgctcgcgatcgagggcgcggtcgagggcgacaatcggaaacgggtcgttagcccagcgctgataaaaaggatgctccggcggcagcgaagtagagacaatgatagcgtccacctggcgctgcagcagatgctcgatgcagcgcatctcgttatcgggctgatcctccgagcaggcaatcagcagctgatagccgcgctgacgcgcctgacgttcgagataatttgcaatccgggtatagctggtgttttccagatccgggatcaccagaccgatagagcgtgtgcgtcctgcacgcaggccagcagcgaccgcatttgggtgatagttgtgctctcgcaccacagccatcactttttcgaccgttttatcgcttacgcggtactgcttcgctttgccattaatcacatagctcgcggtggttcttgaaacaccggccagccgggcgatttcatccagtttcacaattgccccttgggtaagaagtgccaaacataaccattattcaggtatggaatcctttttataacatctaagcgcagaatagttagcgcagcaaccgctttcgcttacagttcctactgatttcgcaaaaaaaaagcccgacagtctctgccgggctatttttacagcagttcccgatccttagcgcatgattttatcaccgcgagacaggccgaccacgccggagcgagccacttccacaatccgagcgacatcgcgcagcgaggccagaaatgcatccagcttatcgctggtgccggcgagctggacggtatagatagaaggcgtcacgtcgataatctgtccgcggaagatttcggtgttgcgcttcacttcttcacggccatagccgctggcctgaaccttcaccagcataatttcgcgttcaacatgagccccctgccccagctcgctgacccgcaggacatccaccagcttgtgcagttgcttttcaatctgctcaatcgctttttcatcgcccacggtctgaatggtcattctggagagagtgggatcgtccgtcggcgcgacagtcaggctttctatattatagccacgctgggaaaagaggccgataacgcgggacaatgcacccgattcgttttccagtaataccgataatatccggcgcataatcaggtcctctccgttttgctcaaccacatttcatccatgccgccgccgcggatctgcatggggtacacatgctcactgccgtcgacggtcacatcgacaaacaccagccgacgctggcgcacctgctccagagcttcagcaagcttcgtctccagctcctgcggctcgctgatgcggatcccgacgtggccataggcttccgccagacggacaaagtccggtagcgattccatataggactgcgagtgacgcccggaatagagcatatcctgccactgcttcaccatcccgagatagcggttgttgaggttaagcaccaggaccggcagctcatactgcagcgcagtggagagttcctgaatgttcatctggatactgccgtcaccggtcacgcagaccaccatttcgtccggcagagccattttgacccccagcgcagccggtaggccaaagcccatggtgccgagaccaccggagttaatccagcgccgcggtttatcgaaggggtaatacagggcggcgaacatctgatgctgacccacatcggaagtgacgtaggcatcgccctgggtcagccgccagatagtttcaattaccgcctgcggtttgattttatcgctctggtcgtcgtagcgcagacaatgacgggcacgccactgctcgatctgttgccaccagtcgcgaatgtcgtccagcggctgctgcgcttcctcctgctccagcagctccagcatctgctccagcaccagccgggcatcgccgacgatcggcacatctgccggcacggttttcgagattgaagtcggatcgatatcaatatgcagtaccgtcgcgttcggacaatacttggccaggttattggtggtccggtcgtcaaagcgaacgccgacggcaaaaatcacgtccgagtggtgcatggtcatgttggcttcataggtgccgtgcatccccagcatccccagcgcctgcgagtgtgtcgccgggaaagcgccaagtcccatcaaggatgaggccaccggcagcttcagtttttccaccagctcgcgcagctgaggttcgcaatgcgcattgatcgccccgccgccgacgtagacgaccggcttacttgcggccaccagggtctgcagggcgcgtttaatctgccctttatggccactggtggttgggttatacgagcgcatgctcactgcgtccggccagacgtaaggcagcttcttcgccggattgagaatatccttcggcagatcgaccactaccggaccggggcgaccgctggccgccagccagaaggctttcttcagcacgccgggaatatcttcggtctgcttcaccaggaaactgtgcttcaccaccggacgggaaatccccaccatgtcgcactcctggaaggcatcgtagccgataagcgaggtggctacctgccccgagaggatcaccaacggaatagagtccatataggctgtcgcaatgccagtgatggcgttcgtcgccccaggcccagaggtcaccagcaccacgccgacctccccggtcgcccgcgccaggccatccgccatatgcaccgccgcctgctcgtgacgaaccagcacatgatcgataccgccaagggtatgtaacgcatcatagatatcgaggactgcgcctccgggatagccgaatacttgcttgacgccctgatcgacaagcgattggacgaccatctcggctcctgacaacatctccatggtttgcctccaggcttattgttttacgacagcggaactcaatttccgcgcgctcgcacgatgcgaaggagtggtcctccgcattgaggtgaatgtactgcatgccactaccataactgctcgccagcaggcaggcaattcgccgcagctgaggccttatttcttgaataagaagaaaagaaagcggtgaggggaaaatatggtgaattgcttcagagataagaaaagagaatggtaaatactcggcgaaaaagggtgataacaggaatagatccatttttcacgaacacaacgaacccctcgcgcaaggtaaacagaataaaattctgctttatttgatttatgtcatataaaaaaaggagccgaagctccttgctatctatcgtcgtcgggtcagcgcttgcaaatgtccaccaacagctcttccatccactggtggcctttatcacgaccagcggcttcgtgccaggagagatagcaggtccgactgttgaccttcaacggcaaaggtaatatttgcagggcaagcttgtcagcaaattcatctgccagccagcgcggggcaatggccaccatctgggtttgcgatactacgtttaatacgctgaccatcgcattaccctgataggcgatacgcgcttgtttatcggccgtgtcataccacggcaaactaaatgaggcataccggtcgagagcaacggcggcatgctcctcgcgataaatatccgcctccatcatcggcccggaaatacgcggatggttgcgactggcgaccaggaccatttcgtctttaaataacggaacgcaggcaaactcagggcgacggaactcttcataaccgattacgaattctgtttcctgataacgtagctgatgttccgtattttgattcagcgcagacttaaagactaaatgaatattgggtgctatctctgcaactttattaaaaataaccgacgtcaggatgttatccagcgggctgcagacgcacagatggaacacgcgctcactgctcagcggttcaaaaccggagcctggcaattcgttttggaccagctgcagcgcctggcgtaccgagccaaacagctgataggcgcgcgccgtcggctgaataccgcggccatagcgcacaaaaagctcgtcattaaacatcactttcagtcgtgaaaccgcattgctcaccgcgggttgtgacatgccgagcgtatgggcggcacgagtaatattctgctcttgcataaccgcatcaaaaacggtaagcagattgagatcaaccatccgtagttgaggtttaacgacttcctgtccgggggctgatttatattctggagtttcaattaacatatctaattccgccgtcacgatgaattcccttcactaaaccgctataattagcgccgaaaatatcatttaccatgcaaatgacatttacaaaatagcaaaagaaatttttaggaatatatcaaggctatgagtggcagtgaagaaacggtcctgatcaaaaaattgagccgctcaaaccatactgattacttaatgatgataagtgtaaccataatccataaaaataaaaacagcaccacgagttaactgtaacttaagcaataataaagtattttatttttccctccataaaattaacaaatccttatcattgaaaaataatccgctagcgttcgaatacattcacaggaaaaataaatttaatattttcatccagataccgttttttgtcccttcattggcgacacctcttcgacgatgccttgaatgcaaagcactttttcaaatgaaacaaatggggataaaccgccttcggtccaaaataggatcttcggcaaaatggggcttacatcagcacattttgctaattcatttagtcagcccaaaacgctttttccatgccaggggttgactttaaaacagctatccagtaactctaaaagcataacgatttcatctggagtttgatgcaatgattcgcaccgctcgtatcaccagcctactactactaaacgcatgccatttgcgcggtaggctgttgggcgacgttcagcgttaagtcatcttccagcaagactataaaacccgcgccttggcgcgggtttttttatgctcgtcaacaaggcgccaggacacagactaaggatccaaaccatgagccagcaagtcattattttcgatacgaccttacgtgatggcgaacaagcgttacaggcaagcctgagtgtcaaagagaagctgcagatcgcactggcccttgagcgaatgggggtcgacgtaatggaagtcggtttcccggtatcctcaccgggcgattttgaatcggtgcaaaccatcgcgcgcaccattaaaaacagccgcgtgtgcgccctggcgcgctgcgttgagaaagatatcgacgtggcggcggaatcgttaaaagtggccgaggctttccgtattcatacctttattgccacctcgccgatgcatatcgccaccaaactgcgcagtacgctggatgaggttattgagcgcgcgatctatatggtgaagcgggcacgcaactacactgacgacgttgagttctcctgtgaagacgccggccgtacgccgattgccgatctggctcgcgtcgtggaagcggcgatcaacgccggcgccaccaccattaatatcccggataccgtcggctataccatgccgttcgaatatgccaacatcatcagcggcctgtatgatcgcgtgccgaatatcgacaaagcaattatttccgtccacacccatgatgatctgggcatcgctgtcggtaacgccctcgccgcggtccacgccggtgcgcgccaggtagaaggtgcgatgaacggtatcggcgaacgcgccggcaactgcgcgctggaagaagtgatcatggcgatcaaagtgcgcaaagacatcatgaacgtgcacaccaacattaatcatcatgaaatctggcgcaccagccagaccgtcagccagatctgcaatatgccgatcccggcgaacaaggccatcgtcggcaccggcgccttcgcccactcctccggcattcaccaggacggcgtgctgaagaaccgcgaaaactacgagatcatgaccccggaatctatcggcctgaaccaggtgcaactgaacctgacttcccgctccggccgcgcggcggtgaaacaccggatggaagagatgggctaccaggagagcgattacaacctggatcatctgtacgacgcattcctgaagctggcggacaaaaaaggccaggtcttcgattacgatctggaagcgctggcctttatcaacaagcagcaggaagagccagaacatttccgcctggattacttcaatgtccaatccggatccagcgatatcgccaccgcctcgatcaaactggtctgcggggatgagatcaaaaccgaagccgccaacggcaacggtccggtcgatgctatctaccaggcgattaaccgcgtcaccgactacaacattgaattagtgaagtatggcttaagcgcgaaaggccacggcaaagacgccctgggccaggtggatatcgtcgttgactacaatggccgccgcttccatggcgttggtctggcaacggatatcgtagagtcgtcagccaaagcgatggttcacgtgctgaacaacatctggcgcgccgccgaagtcgaaaaagaattgcaacgcaaagctcagaataaagagaacaataaggaaaccgtgtaatgtcgaagaattaccatattgccgttttgccgggtgatggcattggcccggaagtgatgaaccaggcgatgaaagtactggaagccgtacgccaacgttttgccatgcacattaccaccagccagtatgacgttggcggggcggccatcgaccgtcagggaactcccctgccgcaggcgaccgtcgccggatgcgagcaggcggatgcgatcctgttcggctccgttggcggtccgaaatgggagcacctgccgccggcggaacaaccagagcgtggcgcgctgctgccgctgcgtaaacactttaaactgttcagcaacctgcgcccggccaaactgtatcaggggctggaagagttctgcccgctgcgcgccgacatcgctgctaacggcttcgacattctctgcgtacgcgaactgaccggcggcatctacttcggccagccgaaaggccgcgaaggcagcggtcagcatgagaaagcctttgataccgaggtgtatcaccgctttgagatcgagcgtatcgcgcgcatcgcttttgaatccgcccgcaagcgtcgtcacaaagtgacttccatcgataaggccaacgttctgcagtcctccatcctgtggcgcgaaatcgtcagcgagatcggcaaggagtatccggacgttgagctggcgcatatgtatatcgataacgccaccatgcagctgattaaagatccgtcccagttcgacgtgctgctgtgctccaacctgtttggcgacatcctctccgacgagtgcgcgatgatcaccggctcgatgggtatgctgccgtccgccagcctcaatgaacaaggttttggcctgtacgagccggcgggcggttccgcaccggatatcgccggcaaaaatatcgccaacccgatcgcgcagatcctctccctggctctgctgctgcgctacagcctcgatgctgacgaagcggcgaccgccattgaaaacgcgatcaaccgcgccttagaagaaggggttcgaaccggcgacttagcgcgcggcacggcggcggtcagcactgatgaaatgggcgatattattgcccgctatgtcgcagaaggggtgtaatcatggcgaagacgttatacgaaaaattatttgatgcgcacgtagtgtatgaggcgcagaacgaaaccccgctgctgtatatcgaccgccatctggtgcacgaagtcacctctccgcaggcgtttgacggtctgcgcgcccatggccgccaggtgcgccagccgggtaaaaccttcgctaccatggatcataacgtctcgacgcagaccaaagacattaacgcgtccggtgagatggcccgcattcagatgcaggagctgattaagaactgtaaagagttcggcgttgaactgtacgacctgaaccacccgtatcagggcatcgtccacgtcatgggcccggaacaaggggttaccctgccggggatgacgatcgtgtgcggtgactcccataccgccacccacggcgcgttcggtgcgctggcgttcggtatcggcacctccgaagtggagcatgtgctggcgacccagaccctgaaacagggccgcgcgaagaccatgaaaatcgaagtccagggcaaagcggcgccgggcattaccgccaaagatatcgtgctggccatcattggtaaaaccggtagcgccggcggcaccggccatgtggttgagttctgcggcgaagcgatccgcgatctgagcatggaagggcgtatgaccctgtgcaacatggcgatcgagatgggcgccaaagcgggcctggtcgcgccggacgaaaccaccttcaattacgtacgcggccgtctgcatgcgccgaaaggcaaagattttgacgatgccgtagcgtactggaaaaccctgaaaaccgacgacggcgcgacgtttgataccgtggtaacgctgcaggcggcggaaattgccccgcaggtgacctggggcaccaacccgggccaggtgatctcggtgacggataacatccccgatccagcgtcgttcagcgatccggtggaacgcgccagcgccgaaaaagcgctggcctatatggggctgaaatccgggatcccgctgacggaagtcgctatcgataaagtgtttatcggctcctgcaccaactcgcgcatcgaagatttacgcgccgcggcggaaattgctaaagggcgtaaagtggcgccgggcgtccaggcgctggtggtgccgggttctggtccggtgaaagcgcaggcggaagcggaaggtctggataagatctttatcgaagccggctttgagtggcgcttacctggttgctctatgtgtctggcaatgaataatgaccgcctgaatccgggcgaacgctgtgcctcaaccagcaaccgtaactttgaaggccgtcagggccgcggcggacgcacgcacctggtgagcccggcaatggccgcggcggcagccgttaccggccatttcgccgatatccgtaatctgaagtaaggagaccatcatggcagagaaatttacccaacataccggcctggtggttccgctggatgctgcaaacgtcgataccgacgcgatcatccctaagcaatttttgcagaaggtcacccgcaccggctttggcgcgcacctgtttaacgactggcgctttctcgacgataaaggtcaacagccgaacccggagttcgtgctgaattttcctgagtaccagggggcatcgatactgctggcgcgggaaaacttcggctgcggctcctcgcgcgagcacgcgccgtgggcgctgaccgattacggctttaaggtcgttatcgccccgagctttgccgatatcttttacggcaacagcttcaataaccagctgctgccggtgaccctgagcgacgagcaggtcgacgagctgttcaagctggtgcaggccaacccgggcattacgtttgaagtggatctggaagcgcaggtagttaaagccggggataaaacctacagctttaagatcgacgatttccgccgccactgcatgctcaacggcctggatagcatcggcctgacgctgcagcatgaagcggcgatctccgactatgaacgcaagctgccggcatttatgaattaacctttgggcccggtcatttgatcgggctttttattttattgcggagaaaattgcgatctcacgcacaaaaaccaattttaatgtgctgattgtcagaccttaccgccaccctgccctaccgcctaaagaagaattattccgctttcctccccttctccagcactgtttatgtattttccctgcactgcaagtaaaaataaggcacgagtgtttaatataaaaatataagaatgtgaagaaagcgttaatctcatagagaacccctatggctatgcacaaaaaaaagcattatttttcgatttttcccctcgttatcttttgccacagagaaatattaactaaggacacgcctgggccccgcatatcggcctcccggcctcctgtggagagaagagatgagccactatccgcaccttttcagtccgttgaccatcaacggtatgacgttaaaaaaccgcattattatgccccctatgggcaccaatatggccacgctcaatggcgaggtgtcgcaggaacagctggaatactacgaactgcgggccaaaggcggcactgggcttatcaccatcgaaaatatttgtattgatttccccttcgcctccaacggcaccacccaactgcgcatcgataacgatcaatatattccacggctgtttaaattaaccgagaccctgcataaacatggcgcctgcgtatccattcagttaaatcatgccggcgcttccgcttatgcctaccgactggaaggccagacgccgctctcctcttctacaacgccgtcgaagaagcacggtaatattccgcgtccgatgacccatgaggaaatttatcatgcggtagagaaatttggtgacgccgcggagcgcgttcggcgcgcaggttttgactgcgtcgaaattcatgccggtcactcctatttaattagccagtttttatcgccgctgtttaataagcgcactgatgaatttggcggcagcgtcgaaaatcgcactcggatactgagtctgattgtcgataaggttcgcgcctgcgtggggccgcgttttccggtcagcctgcgcatcagcgccgacgacttcctcaagggcggcaataccctcgaagattccctgcgtattcttgagctctgccaggagaaggtcgatatcatcaacgtctctgcggcgcagaacgataacctgaatctgcaaatcgatcagatgtcgctggaggatggctggaagcgctatctctcccgcgcggtgcgcgataaattccataaacccacggtcatcgccggcaatattcgcactccgcaggtagccgaagatatcctcgccagcggcgatgccgatcttatcgccattggccgcggtctgattgccgagccggagtgggtgcagaaagtgcaaggcggaaaagagcgtctgatgcgcaaatgtatctcctgcaacatcggctgcgccgaccatcgcatcgcccgctcgcgcccgctgcgctgttcgattaacccggatattattcacggtgacgcctataaaatgcggcgcgtgaatcgcgacactaacgtggtggtcatcggcgccggcaccgccgggatggaagccgcctgcaccgcggcggaagttggttgccatacctggctgctggaagcgaaaaaccacgttggcggcctcgccagcgaaatctcccgcctgccggagaaaaaacgcatcgctgatttcccgcagtttatgaaaaatcgtatcgcctcgctggacaacctgatgctgcagatcggcaagcgggccgacgtggcttcagtttccgccctgcgtccgcatctgattgtcaacgccaccggctcaacgccgctgctgccgcccattgaaggcttgcgggaaaacattgacgtcgagaacggcaagatcttttccattaccggcatgatcgacaatctggcgaaatttaccgatatcaagggcaaacgcatcgccgtagtcggcgccggcgccgttggccttgacgttatcgaatactttaccgctcgcggcgcacaggcggtgctaatcgagatgcaggacgccgccggtcgcgatctcgacatcattaccaaaaatgccatgttgaccatgctcgacgagcaccaggtcgaacagcacatgaatacccaactgatggcggtcgctgccgaccatttccaggtgaaaaatacacagcaaaccttcgatattcccttcgactacggctttgtctgtctggggatgcgcgccaaccggacgggtctcgacgagatcgagcgctgggccaatgccaataacgtcaaaatcatgaacatcggcgacagcgtgatggcgcgacgcattatcgatggcgtccgcgaaggccgcaacgtactggatgcactggaagacatgggtgcgctgggcagcagcgaagcacaacgaattccctttctaacttattgaggatttttgtcatggcagaacgtattactggacacactgagctgattggcctgatcgccaccccgattcgtcacagcatgtcgcccaccatgcacaacgaggctttcgcccatctcgggctggactacgtctatctcgcttttgaagtcggtaaccaggagctaaaagacgtggtgcagggcttccgggcgatgaagctgcgcggctttaacgtctctatgccgaacaaaaccgagatttgccagtatctcgataaactgtcgccggcggcacagctggtcggggcggtcaataccgtggtcaacgacgacggcgtactgaccggacatatcaccgatggcaccggctacatgcgcgcccttagcgaagccggtatcgatatcatcggcaagaagatgaccgtactcggcgccggcggcgcggcaacggcactctgcgtccaggcagcactggatggcgtgaaggcgatctccatcttcaaccgccgcgataaattcttcgccaacgcagaagaaaccgtggccaagatccgccacaacaccgactgcgagatccatctgttcgatctcgacgatcatgacaagctgcgcgccgaaattgacagcagcgtgatcctgaccaatgccaccggggtcggcatgaagccgttcgaaggccagatgctgctacctgacgacagcttcctgcgtccggacctgatcgtctccgacgtcgtctacaacccgcgcaaaacccacctgctggaagtggccgagaaaaaaggctgccgcacgctgaacggcctggggatgatgctgtggcaaggcgcgcgcgcgttcgaaatctggacgggcaaacagatgccggttgattacatcaagagcattctgttctaagaggcgaatgatgaaaaataaatacatccctactgcggcagggctgtatctcaactacctgatccacggtatgggggtgctgttaatcaccctcaacatggcccatcttcaggaacagtggggaacagacaaagccggcgtatcgatcgttatatcttcgttaggtattggtaagttagcgaccatcgtgaccggatttctctcggatcgcttcggtcgcaagccctttatctatcttgggatccttagctacctgatctttttcgtcggcatcctgctgaccaaaaatatctatctggcttacgtgttcggcattatggcgggcctggcgaacagcttcctcgactccggtacctatccggcgctgatggaatctttcccgcactctgccagccgggccaacgtgctgatcaaagccttcgtctctgcagggcagttcctgttgccgttcattatcagcttcctgatatgggcaaatctgtggttcggctggtcgttcgtgattgcggcagcgctctttgtactgagcgggatttatctgcttaaaatgccgttccctgacagccaggcggcgaaaaaagaggaagcccctacggcacaggcggaaacagccgtccggccacaggctaataagctggatatggtgatcttcaccctgtacggttatatcggcatggcgaccttctatctggtcagccaatggctggcgcagtacggccagttcgtcgtcggcctgccctatgcctcggcgattaaactgcttagcatctataccgtcggctcgctggtctgcgtctttgtaactgccgccttcgtcaaagaggtgtttagctcggccattgcgatgattatttatactggcctgtcgatgatttcgctgctgttggtgtgcctgttcccgacgccgatgatggtgaccggctttgcttttgtcatcggctttgccgccgctggcggagtgctgcagctgggtgcgacaatcatggcgatgagcttcccgaacggaaaaggcaaagcaaccggcatcttctacaccgccggcagtatcgccagcttcacgatcccgttgatcaccgcaaagctttcgcagatcagtattgccagcattatgtggtttgattttctgatcgccgttatcggctttgtgatcgccctgtacatcggctatcgtcaactgcaggctcgggcggcgcaaaaagtgtcacgcaccgcagtcaccgcctgaagtacaacgcgaaaaataatggatacctacatgacaaatgcagtaaccgtaaagaacatcacctttcaggaaggggaaaccctcatttgtgtaccgctgatcggtaaaaccctggatgagatactgggtaacgcccacggcctggtcgatgccggcgctgatattatcgaatggcgcgttgaccactttgcccaggtcagagagatggcccaggtgatggccgcgctggcggaaatccgtggcgcgctgaaagcgcttccgctgctatttaccttccgcagtaagaaagaaggtggcgaaaccgagctcagcgacgaagcctattttgcgctcaaccgcgaggccgcacgcagtggactggttgatgttatcgatatcgaactgttcaatgatgaagcgcagatccgcgcgctggttgacgatgcgcatgccgcgggcgtcaaggtgatcatgagtaatcatgatttccataagacccccgctcaggaagatattatctatcgcctgcgccgcatgcaggatctgggggcagatctgccgaagatcgcggtgatgccgcagtcgccgcaggacgtactcaccttgctcgccgccacgctgaccatgaaagagaagtatgcgacgcgtccgctgatcaccatgtcgatgggcaaatccggtggcgttagccgggtcaccgggcgcttgttcggttcggcgatgaccttcggtaccgttggtcaggcctccgcgccggggcagatcgccatcgctaagctgcgtgaagtgatggatattctctcctgatatccggatggcccggaggtcacatccgggccatccgttaacagatcttctggctgtcgtggataaccacatttttaaatgactccagcgccggagagagccccttgtctttcatggtcgccagatagatatagcggggggggatggtgtttttaatcttcaggatatggacgttgtaataggagagcgcggtgatgcgcggcataatcgcgatcccgtagtcaatactcaccagcccggccatcgccgtatcctcatccacatagcaggcgatctccggcaccagcttttgctgcataaatacattatcgataaacggacgtaagccgctattttctgaaaaatagatatacggataatgaatcgtctccaccagatcgacttcatgttcatatagccgggccagcggatgatcctttgccgtgaccaccaccagttcctgctggatcaccggaataaaatcgatatcgggttcatcggcaatataagagcagatcgccagatcgacttttccggccttcagctcctgcaacagcgtcagcgatgtcccttgagtaaaagaaaaagtcacattgtgacattcaggtgaaagagaatatttattaattaactgtggaacaacatactcccccatcgtgtaaataaaggcgatgcgaatattctctttattctcagcgccatttttttgcaatatcatgcgtccgttctccagcgaggccagcgcatcttcaacatacggcaaaaaacgcttgccgttttgggtaatttttacgttccgcccctgtctggcgaatagcgcgacccctaactccttctccagctccgatatcgcgtggcttagcgagggctgggtgatgcacagactggaggcggcttcggtgtaatgctcagtttcagacagacgtttaaaataataaagttgctttaggttcattatttttacccgtataatataagaataaatgcactgacgctaatataccatgcaagccaccaataatgcgcatgaacgggtaaatatcggcgttacatcaaatattatttgacgaagggcatgaatgtgccacaaggcattgccattcatagatactacctatagctccttgagatatttttgcatattagaatatatgcaaaaatattttaaactttaaaggaactcgctatgagtatgtcaaactctcaggaagtcctcacttccacatcgggggcgaaaaaaagaagccgcgtacggatagttattctgctgctactctccgtcggaacgatgatcaattatctcgaccgtaccatcctgggtattgtagcgccacagttaagcaaagaaatccatatcgatccggcgatgatgggcatcatcttctccgccttcgcctggacttatgcgctggcgcagatccccggcgggatgtttttagaccgctttggcaacaaactgacctatgccctgtcaattttcttctggtcgctgtttaccctgctgcaaagtttcaccctcggcctaaaatccctgctgcttctgcgcctgggactcggcgtcagcgaagcgccctgctttccggccaacagccgcatcgtcagcacctggttccctcagcatgagcgcgcgcgggcaacggcaacatatacagttggtgaatatatagggctggccgctttctcgccgctgttatttttaattctcgaacatcatggctggagaacgctttttttcctcaccggcggattaggtattttatttactttagtgtggtggcgtttttatcatgaaccgcatgaatcgcgcacggctaatcaagcggagctggagtatatcggcgcaaacggcattaacaataaaatccagaacgttccatttaactggcgtgacgccagacgcctgctgggctgtcgccagatcctcggcgccagcctgggtcagttcgccggcaacaccacactggtctttttcctgacgtggtttcccagctacctcgccaacgagcgccatcttccatggctgcacgtcggcttcttcgccacctggcccttccttgccgccgcgattggcatcctcttcggcggctggatctccgaccggttgttgaagcgaaccggctccgtcaacatcagtcgaaagttaccaataatttccggtttattgctgtccagctgtattatcgcggcgaattgggtaagcgccaatagcaccgtaattattatcatgtcggtggctttttttggccaggggatggtcggtctgggctggaccttaatttcggatattgccccggaaaatatggcaggcctcaccggcggcatatttaatttctgtgccaatatggcctcgattatcgcaccactgataattggtgtgattatttccgccacgggtaatttcttttacgcgctgatctacgtcggcctgacggcgctgattggggtgattgcctacatttttatcattggcgacattaagcgtatcgaactcaagtaggcctggtcgccccggcgatgccggggcgagtagtcagatatccttcaccttgctggtcaaaaacagcgtcaccagcgaaatggccgcgatcgtccagtagacgctggcgtgaccatagctctgggacagcgccccctgcatcacgccggcaaggatcacgccggtggaaatactgttggtgaacagggtggtcgccgctcccgcccgtcccggcattaaatcctggaaccacagcatgcctatcccggcgataatgccgataaagatggcattgaacagctgcagagccagcagcgccgtgcgaccatgaaacaggatcagtccggcataaaacagcacgccggcggccaccgccgccaccatcattttacgtttgccaaagcgctttacgtagtagccggcgaggatcatcgccggtatctccagcccggcggcagtgcccatcaggatcccggccaggctgtcgggaagcccgagatcgctgctgatccacagcggcatatcaatgatgtacatggtgttgcaggtccacatcagggtggaggcgataaacagcatacgcacgttcttgtcctgccagccgccggcctgcgctagcgccgccgcctcctccgagggctgttccacacgcggaaccgaaggcagtttgatggcaatcagagcgaggctaatgacaaaaatgcccgccgcaatggagaacatggtggtgaagccatagttgagcgccagcataaaggccagcggcgggccaatcacccaagccagcgacagctgggcgcgcatgaccgagctgaacatcaccacttcccgcgccgagctgtcggcgtactcccgcgccagcgcgaagagctgcggcatggccgcgttggcaatggatgccagcatcacgccgcaggtgatcagcgtcagatagtggcggttgaaggcaaacagcagcgcattacccaccgccatcagacagcagaacataatcaaccgccgccggtcgccgcggctatcggagcgcttggccagccacaggctaaccaggatcccggcgatggcgtttacggtatagaacaggcccacccagaacggttgcgcccccacttcgcggctgagaaacaaactcaacgtcggcgcctgcaacgcgcccgccacgcccatcataaaagcaaccagcataaaggcggcatagacgccgttaagccgtcgtcccatcgtcatcaaccacagcatggaatgtccttaacacacgcgaagaaaacgaaaaaagccagcagaggctttctgctggcgggtgattctatactctatggatttcatgctgcaggacaaaacggttaaccattttgcgccgcgctcgcgctggccctgaaaaggtgagtcccgtagaggcgaatcacgcagcccgaacatacggcccaggaagcatcgacagcgcacctgcagtttgaaaaacgacgagtataacaccaatactcagtcacacatgatgtctgcaagtcaatgatcagaggtcgttgacgtcactccccactgcatcagttcccccagaatttcctgctgtcgtcctgccatcaggcgggccagccaggacgcttcctgcgtcgcagaaaagtagcgttggtagaacgattttgcggtagacctcatcatattcacctcctcgcttcatcgggattcattattggcttaatataggaagtaataaattgctgagttttgcgcaggagttccccttttatgtcttccggccgtctgcaacaacagttcattcgcctatggcagtgctgcgacggcaagtcgcaggagaccacccttaacgagctggcggaaatgctgagctgctcgcgccgccatatgcgcaccctgctcaatatgatggaatcccgcggctggctgacctgggaagcggaggcaggccgcggcaagcgttcgcggctaacctttctctataccggcctcgccctgcagcagcaacgtgccgaagatctccttgagcaggatcgcatcgatcagctggtgcagttggtcggcgataaggctgccgtccgccagatgctggtctcgcatctcggccgcagcttccgccaggggcggcacatcctgcgcgtgctctactatcgtccgatgaagaatttgctgcccggtagcgcgctgcggcgttcggaaacgcatattgcccggcaaatattcagcgccctgacgcgggtaaatgaggaaaatggggaactggaagccgatattgcccaccactggcagcagctgacccccacccactggcgctttttcctccgtcccggcatccattttcaccatggccgtgagctggagatggccgatgtgatcgcctctctgcagcgcagcaatgccctgccgctctattcacatatcgaacgcatcgaatcgcccaccgcctggaccctggatattcatctgcgccagcccgaccgctggctgccctggctgctggggcaggtgccggcgatggtgctgccgcaggagtggcagaccatgaaccacttttcctccatgccggtcggcaccggcccctatgccgtggtgcgtaacaaccagaatcagctcaagatccatgcctttgaggactattttggctaccgggcgctgatcgatgaggtgaacgtctgggtgctgccggagattagcgaagagcccaacggcggcctgacgctgcagggcaataccgaaagcgaaaaagcggtagagagtcgcctggaagagggctgctattacctgttgttcgactcgcgaagcccgctgggggccaacgacgcggtgcgccgctggctaagctatctgtttcagcccgccaacctgctctaccatgcgggcgaacactaccagggcaactggtttcccgcctacggcctgctgccgcgctggcatcacgccagcaaccacgcctgcgagaagccggcggggctggagacagtcacccttacctactaccgcgatcacgtcgaacatcgggtgatcggcgggatcatgcgcgacctgctggcggcgcatcaggtaaagctggagatccaggagctggagtacgatgcctggcatcgcggcgaggtggtcagcgatatctggctcaacagcgtgaacttcaccttaccgatcgaattttcgctcttcgcctatctgtacgaagtcccgctgattcagcgctgcattcccattgactggcaggcagacgcctgccgctggcgagcaggagagtttaatccggccacctggagccagcggctgctggccgggcaacatatcgtgccgctgatccaccactggctgatgattcagggtcagcgcagtatgcgcggcgtgaggatgaataccctcggctggttcgattttaaatccgcatggtttgcgccgccggagccgtaagcgctttccgtcatctgacaaaatcattacactaaggccgttctcaacggggtgctaataaacatacgcaatatcattcaagttgcatcaaggcagcaagcgggtgaatcccctggagcatagataactatgtgactggggtgaacgcgcgaagctaacgcagatgcggcttgaaggatgaagcgtatgggctgagaaaatacccgtcgaacctgatccggataacgccggcgaagggatttgaggctcactcaaaatcctttgccaccccttttttctgaggtgcaaagtgttgaaaaaattactcccgctgctggcgctggtcgccatgcccgctttggctaagcctgttcttaccgtctatacctatgactccttctctgccgactggggccccggcccggcggtcaaaaaagcctttgaagcggagtgcggctgcgagctgaagttcgtcgcgctggaagatggcgtttcgctactgaatcgcctgcgcatggaaggcaaaaacagcaaggccgacgtcgtgcttggccttgataacaacctgctggaagccgcggcgcagagtaaactgtttgccaaaagcaacgtacccgccagcgcggtcagcgtgccgggcggctgggataatgacacctttgttccctacgactatggctatttcgccttcgtctatgacaaaaacaaactggctaatccaccgaagagcctgaaagagctggtcgagggcccgcaaaaatggcgggtcatctatgaagatccgcgtaccagcaccccgggactgggcctgctgctgtggatgcaaaaggtctatggcgatcaagcgcccgaggcctggcagaagctggccgcgaaaaccgttaccgtcaccaaaggctggagcgaagcctatggtctgttcctgaaaggggaaagcgacctggtgttgagctataccacctcgccggcctaccacatgattgaagagaagaaagacaactatgcggcggcgagcttcgccgagggccactatctgcaggtcgaagttgccgcgcgtaccgccgccagcaagcagccggaactggcggaaaaattcctcaaatttatggtatctcctggcttccagaacgccatccctaccggcaactggatgtatccggtgaccaaggtcaccctgccggccgggtttgataccctggtgaagccgcagaccaccctgtcctttaccccgcagcaggtcgccagcgagcgtcaaacctggattagcgcatggcaacgcgccgtcagccgctaaaccttcgcgggctgatgccgggcctgttcgccgctacgctgctgtgcgctgtcgcgctggcggcgtttctggcgctgtggtttagcgcccccggcgcgggctggcaatcggtcttcagcgatagctacctgtggcatgtggtccgcttctccttctggcaggcgtcgctgtcagcgctgatctcggtgggaccagccatctttctcgcccgcgcgctttaccggcgtcgcttcccgggccgtacgctgctgctgcgcctgtgcgcgatgaccctgatcctgccggtgctggtggcggtgttcggtatcctcagcgtctatggccgccagggctggctggcctcactatttcacgcgctcggctggcaatgggagttctcgccctacggtctgcagggcatcctgctggcgcacgtctttttcaatatgccgatggcgacccgtctgctgctgcaggcgctggagaacattcccggcgagcagcggcaaattgccgcccagcttggcatgcgcggctatgccttcttccgcctcgtcgaatggccgtggctgcgccggcacattcccgccgtcgccgcgctgatttttatgctctgcttcgccagcttcgccaccgtgctctcgctgggcggcggcccgaaagccaccacgatcgagttggctatctaccaggcgctgagctttgactacgatccggcgcgagcggcaatgctggcgctgatccagatgctctgctgccttgggctggtgctgcttagccagcgtctgagtaaagccgtcgccatcggcgtcagccatgtgcgcggctggcgcgaccctgacgatcgcctgcatagccgcctgagcgacgggttgctgatcggcgccgccctgctgctgctgctcccgccgctgctggcggtcatcgtcgacgggatcaaccgtaatatgctggacgtgctggcgcagccagcgctctggcaggcattgagcacctctctacgcatcgccatcgccgccgggctattgagcgtgaccctgacgatgatgctgttatggagcagccgggagctgcgctctcgccagcggccgttggccgggcaggcaatggagctgagcggcatgctgatccttgcgatgccgggaattgtgctggcgaccggcttcttcctgctgctcaataacactatcggcctgccggagtccgccgacggcatcgtcatcttcactaatgccctgatggcgatcccctatgcgctgaaagtactggaaaacccgatgcgcgacattgccgcccgctacagcatgctgtgccagtcgctgggtattgaaggctttgcccggctgcgggtggtcgagcttcgcgctctccggcgcccgctggcccaggcgctcgccttcgcctgcgtactgtcgattggcgatttcggcgtggtggcgctgttcggcaacgaggcgttccgcaccctgcctttctatctgtaccagcagataggcgcctaccgcagccaggacggggccgtcaccgccctgctcctgctgctgctctgtttcttgttgtttacgctgattgaaaaacttccggggcgtgatgctaaaactcaatgatgtgacctggctataccagcatctgccgatgcgcttcaccctcgacgtcgcgcgcggggagcgcatcgcggtgctcggtcccagcggcgccggaaagagcaccctgctgaatctgatcgccgggtttctgccacccgccagcggcagcctgctgattaacggcgaggcgcataacgcgacgccgccggcgcagcgtccggtctcgatgttgtttcaggagaataacctgtttaaccatctgaccattcgacaaaatatcagcctcggcatccacccaggccttaaactgagccgcgagcagcaggcgcaggtcacggcgatagctggacagatgggaattgatgcgctgctggaacgtctgcccggcgagctctccggcggtcagcggcagcgcgcggcgctggcccgctgtctggtgcgccagcagccggtgctgctgctggatgaacccttctcggcgctcgatccggcgctgcgccaggagatgctgtccctggtcgccgatgtctgcgagcagcagcagctcaccctgctgatggtctcccacagcgtagaggacgccgcgcgcatcgcgccgcgctcgatggtggtcgccgaagggcgcattgtctgggatggcgccaccgccgagctgttaagcggccacagcagcgcctcgcatttgatggggatcagcgcgcgatgaccttgtgcaggatcgccagatagaccggcatcagcggatggcggaagacaaatgttaacgctgtagccgccagcgcgaccatcagcggcgacagccacagcagtcggccgcgcggcagccagcgggtcagccgatcgcctgaggttttcgcgctccgccacagccgccagcacagccatcccgccagccaggccagcagcgccgcccccaatagcagccatttaaagctggcgctgttttcatcagccggaatatcaatcgccgccccggcgaggatgcccggaaggaaatagagcggcggccagagcaggcagccgataatattcggtagcacgaacttggccaccggcaggtcgagcatcccggcgaccattggcaccagcggacgcgtcggtccgacaaagcggccaatcagaatggtgatcatgctgtgctgatgcagcgcatgctcggttttctccagcagggcgcggtttttcttcataaacgaccagcggtgcaacggcttcttaaagcgccagccgagccagaatgagatccagtcgcccagcaggcagccgacaatccccgccagccacgcctgccagaagttaacttcgccgccgccgatgagcgccccaaggccagccatcatcaccgtgccgggtaagataagccccaccagcgccagcgactcgagaaaggccaccagcatcacggctaacaatgagtagaccgtggattgggtaataaagtgttcgagcaatgcttgcataatgtacccggttaaaaaacgaagcccggattctccgaagccatcgcgccgtcgtcaagccatcaattgtcttaatagtttactggctgtgacatttaagcgggtcatcatttcactttctttactttttattcacaacccgcgcggaattcgctcgggctggccccggtgcattttttaaacacgcgggaaaaatagagctgatcttcgaagccgacgttgcgcccaacggtggcgatcggcatccgcgtggtgctgagcaacagtttggcctggctgatgcgctgatcctcccgccagccgaggacgctgacccccagctgctggcggaacaggtgcgacagacgcgagggcgacaggcagacgtgctgggcgacgctggcgatatcaaaatggctgtccgccagatggtcgctgatgtactggcaggcgtcgcgcacccggttgtccagcggcggatgcagcgattcgttgatcgcctccatgcgccgcagcagcagctgttccagcaggtttatcgccaacagttcggaatagcgcccagccccctgcccggcatcaacgatctggccgaacagctcgccaaagcgcgcctgccactgttcatccggacggaaaaagccggtctgggcaaaaatcgttggccagttgagccactcgtgccagtaggcgcgcgggcggaagtagacccactggtgataccactcgctggcgtcgggatggcggccatagtgatgaatttccccgggcgggaacagcagcatatcgcccggccggcagacaaactgttcgccgtggttgttgatcaccccctcgccgcggatcgtcagattgagaatatagcctttcatacccagcgggcggtcgataaagaaatccaggtatccctgcgcctcaatcggcgtcaggccggtgaccagatgagcgttaaaagagtagcccggcagcagcggatcgttttgcgtttcggccatacgcgtggttctccccgaaggtatcagtggcaccaattgtccatattcatcattttatcgctctcggccctgtcgcgactgcgacggcggtgggaatttggcgaaaaacccgcacagcaagcgaaaaaagcgccagcagcgtgcattccaccgtgatatgccgggtaacaaaagtgtctataaatacggcagaaaagtccacatcgaatatttgcacggcgtcacactttgcaaggtaacagcaaaataatccataagattagcgaatccggcctgacggattttgccggggatatctactgttgctgcatgaatgatttctgcatggagtaacaagatggcaattgcgattggcctcgactttggtagtgactcagtccgcgctctggcggtggaatgcgcgtccggcgcagagctggcgaccagcgtggagtggtatccgcgctggcgggaaggacagtattgcgatggcgctaacaaccgcttccgccatcacccgcgagattacatcgagtccatggaagcggcgctgaaaagcgtgctcgcttcgctgagcgccgaacagcgcgccgacgtcgtgggcattggcgtcgacagcaccggctcaactccggctcccgtcgatgccgagggcaacgtgctggcgctgcgcgaagaattcgctgacaaccctaacgccatgtttgtcctgtggaaggatcacaccgcggtcgaggaagccgaggcgatcacccgcctgtgccaccagccgggcaaagaggattactcgcgctatatcggcgggatctactccagcgaatggttctgggccaaaatccttcacgtcacccgcgaagatagcgccgtcgcccaggcagccgcctcgtgggtagagctttgcgactgggtgcccgccctgctctccggtactacgcgtccgcaggatctgcgccgcggccgctgcagcgccggacataaatcgctgtggcatgagagctggggcggtctgccgccggccagcttcttcgatgagcttgatcccatcatcaaccagcatctggcctggccgctgttcaccgatacctggacggccgatgtgccggtcggcacgctgagcgcagagtgggcccagcgcctgggtctgtcgcagaccgtggccatctccggcggcgccttcgactgccacatgggcgccgttggcgccggcgcgcagcctaacgcgctggtgaaagtcatcggcacctccacctgcgacattctgatcgccgataaagagagcgtcggcgagcgcacggtcaaaggcatctgcggccaggtcgacggcagcgtggttccacactttatcggcatggaggcaggccagtccgccttcggcgatatttacgcctggtttggccgcattctcggctggccgctggagcagctggctcagcagcagccggcgttgcgcgagcaaatcaaagccagtcaaaaacagttactgccggcgctcaccgaagcctgggccaacaatccatcgctggagcatctgccggtggtgctcgactggttcaacggccgccgcacgccgaatgccaaccagcgcctgaaaggggtgatcaccgaccttaacctggccaccgacgcgccggcgctgttcggcggtctgatcgccgccaccgccttcggcgctcgcgccattatggagtgcttcaccgagcaggggatcccggttaacaacgtcatggcgcttggcggtatcgcgcggaaaaaccaggtcatcatgcaggcctgctgcgacgtgctgaaccgtccgctgcagattgtcgcctccgatcagtgctgcgcgctgggggcggctatcttcgccgccgtcgccgccggcgtctatgaggatattccagccgcccaacagcggatggcaagccaggtggaaactaccctgcagccgcgtccggcgcaggcacagcgtttcgaacaactctatcagcgctaccagcagtggtcggtcagcgcggaacaacactatctcccttcggctgcaaaggcggaaaaagccccgcaatctcaggcagcgctcacccattaaggatacgaaaatgacgatttttgataactatgaagtatggttcgttattggcagccaacatctgtacggcccggaagccctgcgccaggtgacgaagcatgccgaacatgtggtgaacagcctgaatgcggaagccaaactgccgtgcaaactggtccttaagccgctgggcaccaccccggacgagatcacccatatctgccgcgacgccaactacgatgacaaatgcgccgggttagtggtctggctgcataccttctcgccggcaaaaatgtggatcaacggcctgaccatcctcaataagcctctgctgcagttccatactcagtacaacgccgcgctgccgtgggacagcattgatatggactttatgaacctgaaccagaccgcgcacggcggccgcgagttcggcttcatcggcgcccgtatgcgccaacagcacagcgtggtcaccggccactggcaggataaagaggcccaccagcgtatcggcggctggatgcgtcaggcggtctccaaacaggatacccgtcatctgaaagtgtgccgtttcggcgataacatgcgcgaagtggcggtgaccgacggcgataaagtcgccgcgcagattaagtttggcttctcggtgaacacctgggcggtcggcgatctggtgcaggtggtgaacagcatcagcgacggcgatatcagcgccctggtcgatgaatatgagagcagctaccgtctgaccccggcagcgcaggttcacggcgagaagcgccagaacgtgctggacgccgcgcgcattgagctggggatgaaacgcttcctcgaacagggcggtttccacgcctttaccaccacctttgaagatctccacggcctgaaacagctcccgggtctcgccgtacagcgcctgatgcagcagggctacggctttgccggcgagggcgactggaaaaccgccgctctgcttcgcatcatgaaggtgatgtcaactggtctgcagggcggcacctcctttatggaggattacacctaccacttcgacaatggtaacgatctggtgctcggctcgcacatgctggaagtgtgcccgacgatcgccaccgccgagaaaccgatcctcgacgttcagccgctgggcatcggcggcaaagcggatccagcgcgcctgatcttcaatactcaaaccggcccggcgatcgtcgccagcctgatcgacctgggagaccgcttccgtctgctggtcaataccatcgaaaccgtcccaacgccgcacgatctgccgaagctgccggtggccaacgccctgtggaaagcgcagccggatctgcgtaccgcgtcggaagcctggatcatcgccggcggcgcgcaccataccgtcttcagccatgcgctgaacctcgacgatatgcgccagttcgccgagctgcatgatatcgagctgaccgtcatcgacaacgatacccgtctgccgtccttcaaggacgcgctgcgctggaatgaagtgtattacggttcaaaacgctaagaggccgtcccctcacccttcccctctccccgttggggagaggggaccgaccgggcgccatgccgcctttctccctctcccgccgggagagggtcggggtgagggatacccgactcgcctgctattcggagcacactatgttagaagatcttaaacgccaggtgctggaagctaacctggccctgccaaagcataatctggtgaccttaacctggggcaacgtcagcgccgtcgaccgcgagaaaggggtgttcgtgatcaaaccctccggtgtggattaccgcgtgatgaccgccgacgatatggtggtggtcagtctggagagcggcgaagtggtagagggtaataaaaagccctcgtcggataccccgacccatcgcctgctgtatcaggccttcccgacgctgggcggcattgtgcatacccattcgcgccacgccaccatctgggcgcaggccgggcaatctattcccgcgaccggcactacccatgccgactacttttatggcccggtgccctgcaccaggttaatgaccgatgcggagatcaacggcgactatgagtgggaaaccggcaacgtgattgtcgaaaccttccgccagcagggaatcgacccggcgcagatgcccggcgtgctggtccattcccacggcccgttcgcctggggcaagaacgccgaagacgcggtgcataacgccatcgtgctggaagagatcgcctatatggggattttctgccgccagctggcgccgcagctgccggctatgcagcagaccctgctggataagcactatctgcgtaagcacggggccaaagcctactacggccaataatcaccctgctcgcgctgcgcttagcagggccagggctctgcgccatctggtagccgggataaggcgcaagccgcaatccggagcaacattagcgccgaacacctgtataaaaccccagcacccctcatgaaaccaggctataatcaggcctggttttttatcggcgagaatacccgtgacccagccacgagcaggatttttactcacccgtcactggcgggacactccgcagggcaccgagctctccttctggctggccaccgacgacggtccgctgcaggtaaccctcccgccgcaggagtccgtcgcctttattcccgaagcgcagcgggcgcaggctgaacggctgctgcagggggagaaagggctccgcttcgccccgctggccctgaaagatttccaccgtcagccaattgttggcctctactgccgcgcccatcgccagttgatgcgtctggagaagatgctccgcgacagcggcgtcaccgtttacgaaggcgatatccgcccgccggagcgctatctgatggagcgctttatcaccgccccggtgtgggtggaaggcgaaacgcgcggctcgcagctggtcaacgcacgcatgaagccgaaccctgactatcgtccgccgctgaaatgggtgtcgctggatatcgaaaccagccgccacggcgagctgtactgcatcggtctggaaggctgcggccagcgggtggtctacatgctgggccccgaaccggaaacgccgccagacgtcgacttcgagctggtcttcatcgccagccgtcccctgctgctggaaaagctcaacgcctggtttgccgaacacgaccccgacgtgctgatcggctggaacgtagtgcagttcgatctgcgcgttctgcaaaagcacgccgaacgctatcgcatcccgctgcgactcggccgcggcaacagcgagctggagtggcgtgagcacggctttaagaacggcgtctttttcgcccaggccaacgggcggctgattatcgacggcatcgacgcgctaaaatcggcgttctggaatttctcctccttttcgctggaggcggtggcccgcgagctgctgggagaaggcaaagccatcgacaacccatgggatcggatggatgagatcgatcgccgctttcatgaagacaaaccggcgctggccatctataacctgcaggattgcgagctggtgacgcggatcttccacaaaacggagatcatgccgtttttgctcgaacgagcgacggtcaacggtctgcccgccgaccgccacggcggctcggtcgccgccttcagccatctctatttcccgcgcatgcaccgcctgggctacgtggcgccgaatctcggcgacgtaccgccgcaggcgagccccggcggctacgtgatggactcccgccccggcctgtatgactcggtgctggtgctggactataaaagcctgtatccgtcgattattcgtacttttttaatcgatccggtcggcctggttgaagggctggcgcaacccgatgaccagcacagtatcgagggcttcctcggcgcccgcttctcgcgagataagcactgcctgccggggattgtcagccagatctggcacggccgggatgaagccaaacgccagcacaataagccgctctcccaggcgctgaagatcattatgaacgccttttacggcgtgctggggaccagcgcctgccgcttcttcgacccgcgtctcgcctcgtcgatcaccatgcgcggccatgcgatcatgcgccagaccaaagcgttaattgaagccaaaggctatgacgttatctacggcgataccgactccaccttcgtctggcttaagcgcccgcacagcgaagcccaggcggcggagatcggccgcgagctggtcagcgatgtcaacgcctggtgggcgcaggagcttagcaaaagccagcttaccagcgccctggagctggagtatgaaacccacttctgccgctttttaatgccgacgatccgcggcgccgataccggcagcaagaagcgctatgccgggatgattcaggagggcgatgcccagcgcatggtgtttaaggggctggaaacggtgcgtaccgactggacgccgctggcccagcagtttcaacaggagttatacctgcgcatcttccgcaaccagccgtatcaggattatgtgcgggagactatcgccaggctgatgaacggcgagctcgacgaacagctggtttatcgcaaacgcctgcgccggccgctggcggagtatcagcgcaacgtaccgccgcacgtgcgcgccgcccggcttgccgatgaacacaacctgaagcttgggcgggcgcagcagtatcagcagcgcggcaccatcaaatacgtctggaccaccagcggcccggagccggcggattaccagcagtcgccgctcgattacgatcactatttaacaaagcagttgcagccggtggcggaagggatcctgcccttcgtcaacgatgactttgctacaatagtgacaggacagttggggctattttgatttttggtcacccattccacgggcacgaaagcctaaaaatgaagcgtgaggagaacgtgacgaacgttctgccatccagtaatatagcgccctttccattcctggccccaattttgacgcatctccgattgttcatggagatgatcaactattgcctgcaattaaagaactaaagagccgaacatatatgccttttacacttggtcaacgctggattagcgacacagagagcgaactaggattagggacggtggtagcgctggatgcgcgcatggtcactctccttttccccgccatcggcgaaaaccgtctgtactctcgcaacgattccccgatcacccgcgtaatgtttaacccgggcgacaccatcaccagccatgaaggctggcagctccacgttgacaaagtgaatgaagagaacgggctgctgtcctacactggcacccgcctggacacccaggaagcgaacgtcaccctgcgtgaagtgctgctcgacagcaaactggtattcagcaaaccgcaggaccgcctgttcgccggccaaatcgaccgtatggatcgctttgccctgcgctaccgcgcgcgcaagttccagagcgaacagtaccgcatgccgtggagcggcctgcgcggccagcgcaccagcctgatcccgcaccagctgcatattgcccacgatgtgggccgtcgtcacgcgccgcgcgtcctgctggccgatgaagtgggcttaggtaaaaccattgaagccgggatgatcctgcaccagcagctactctccggcgccgccgagcgcgtgctgatcgtggtcccggaaaccctccagcaccagtggctggtggagatgctgcgccgtttcaacctgcgtttctcgctgttcgacgacgagcgctacgccgaagcgcagcacgatgcctacaatccgttcgaaaccgaacagctggtgatctgctctttagacttcgtgcgtcgcagcaagcagcgcctggagcacctgtgcgacgccgagtgggacctgatggtggtcgacgaagcgcaccacctggtgtggagcgaagaggcgccgagccgtgaatatcaggctattgaacagctggctgagcgcgtgccgggtatcctgctgctgaccgcgacgccggaacagctgggaatggagagccattttgcgcgcctgcgtctgttggatccgaaccgcttccacgattttgaacagtttgtcgaagaacagcagaactaccgtccggtggccgacgccgtcgcgctgctgctggcgggcaacaagctgagcgatagcgaactcaataccctgggcgatctgatcggcgagcaggatatcgagccgctgctgcaggccgccaacagcgatcgcgaagatgcccaggccgcgcgccaggagctgatctcgatgctgatggaccgccacggcaccagccgcgtgctgttccgtaatacccgtaacggcgtcaaaggtttcccgaaacgcgagctgcacaccattcgtctgccgctgccgacccagtaccagacggccatcaaagtgtccggcattatgggcgcgcgcaaaaccgcggaagagcgcgcgcgcgacatgctctatccggagcagatctatcaggaatttgaaggtgataccggtacctggtggaacttcgacccgcgcgtcgagtggctgatgggctacctgaccagccatcgctcgcagaaggtgctggtaatctgcgctaaggccgccaccgccctgcagctggagcaggtgctgcgcgagcgcgaaggcatccgcgccgcggtgttccatgaagggatgtcgattatcgaacgcgaccgcgccgcggcgtggtttgctgaagaagacaccggcgcccaggtgctgctgtgctccgagatcggctccgaaggacgcaacttccagttcgccagcaacctggtgatgttcgacctgccgtttaacccggatctgctggagcagcgtatcggtcgtctcgaccgtatcggccaggcgcacgatatccagatccacgttccgtacctggaaaaaaccgcgcagtcggtgctggtgcgctggtatcacgaagggctcgacgccttcgaacatacctgcccgaccggtcgcaccgtctacgacagcgtgcacgatgaactgatcaactatcttgcggcgccggaatccaccgacggctttgacgatctgatcaaatcctgccgccaacagcatgatgccctgaaggcgcagctggagcagggccgcgaccgtctgctggagatccactccaacggcggcgagaaagcccaggccctggcggagagcatcgaagagcaggatgacgacaccagcctgatcgctttctcgatgaacctgttcgatatcgtcggcatcaaccaggacgaccgcggtgaaaacctgatcgtcctcaccccttccgaccatatgctggtgccggatttcccgggcctgccggaagacggttgcaccatcaccttcgaacgtgacgtggcgctgtcgcgtgaagatgcgcaatttattacctgggaacacccgctgatacgcaacggtctggacctgatcctttccggcgataccggcagcagcaacatttccctgctgaagaacaaggcgctgccggtcggcaccctgctactggagctgatctatgtcgtcgaagcgcaggcgccgaagcagctgcagctcaaccgcttcctgccggcgaccccggttcgcatgctgctggataagaacggcaacaacctcgccgcgcaggtggagttcgaaagcttcaaccgccagctgagcgcggtcaaccgccataccggtagcaagctggtcaatgcggtgcagcaggacgttcatgcgattctgcagcagggtgaagcgcagatcgccaaagcggcgcaggggctgatcgacgcggcgcgtaacgaagccgatgaaaagctgacggcggagctgtcgcgtctggaagcgctgaaggcggtgaacccgaacatccgtgacgacgaactggcggcgatcgaaagcaaccgtcagcaggtgatggatgcgctggcgcaggccggatggcgtctggacgcgctgcgtctgatcgtcgtcactcaccagtaacggaacgcgaacatggcgatggaaaactacaatccgccgcaggatccctggctggtgatcctgtatcaggatgagcacatcatggtggtcaacaagccgagcggcttgttgtccgtccccggtcgtcttgaggagcataaagacagcgtgatgacgcgcattcagcgcgacttcccgcaggccgaatcggtgcatcgcctggatatggccaccagcggcgtgattgtggtggcgctgaataaagccgccgaacgtgaactgaagcgtcagttccgcgagcgcgagccgaagaagcagtacgtcgcccgcgtctggggccatccgcagccggcggaaggcctcgtggatttaccgctgatttgcgactggccgaaccggccaatgcagaaggtgtgctatgaaaccggcaaagcggcgcaaaccgaatatgaggtgctggagtacgcagaggataacaccgcccgcgtgcgcctgaagccgattaccggacggtcgcaccagctgcgcgtgcatatgctggcgctggggcatccgatccttggcgaccgcttctatgccacgccggaggcgctggcgatggccccgcgcctgctgctgcacgccgagacgctcaccatcacccatcctgcctacggcaacgcgatgacctttcgcgcgccgatcgacttttaacgctcatacttcgagttgcatgcgggttggctgcgtgcaactcggattagtgaggatacagaaaacaatcccgattaatcgcgggcgaaccacgcgtcaatcatctgctcaacgcgggcgacgacgagatcggtgtcgtgacgacggctgcgcgcacaggcgtgcgccggctcatcgcacagcaggcagcggcgctgcgattcgcccagcgactggcgtcccaccagcccgttctgcggacagattacatcgatatcccacaggcgtcccagcggatggctctgctccagcgtactgcacatcgctttgatttcgctggccggatgcgctacgcaccacagcgcttctggcccggtcggcagccatagcacctgacgatccagcgtttgccagcggtgcttccacagcagctgatcgcaggcctggagggcaacgcccatcatattgcgatagcgaatgctgtccttcaccgcccccggggtcaccagggtcagggaaataacaggctgctgataatgggccaaccagtcggcctggcgggctgcacgctgctctttcgccgccagcaatgcgtcgatgctgacgcccgcctgggcgggagtatccactgacattaattcctctcctacatatgataaatacgacagcgcctggactgtcatgatgatggttgcgatagccgatcgcgcgctgattgtaacgctaaatgcggagcatttaggatacagaacgcagatattttcggcgttctgtagcggaaaatagcagatttatcgctgagcgtagcgttatatcacgccagatagtggctgaggaacagcaaccccagcgagacatttatcgccccgccgatgcgggtagcgatctgcgcgaacggcatcaggctcatgcggttgccggcggtcaggatcgccacatcgccggtgccgccctgcccgctctggcaacaggaaacaatcgccacatcgatcgggtgcatccctatctttttaccaaccaggaaaccggtcgccaccagcgcggagacggtactgacgatcaccagcaggttggttaaagtgaaggcgtttaccagttcctgccacggagtgatcgccacgccgacggcaaagaggatcgggtaggtgactgcggtgcggaagaatttatacaccatctgcgacccctcctgcagacgcggagacaccacgttagccagctttaacagtaccgcgaggaacagcatgcctaccggcgccggcagaccaatcagtttgtggccgagcatccccatcatatacagcagtaccgccagcagcgcgccggaggcgagggtcccaacgtcggtcttaccgctcacgccttcgctctcgctgaggctgcgggtttcatggctgcggttcggcatcagttgcccttcgccggtcagatgcgggaagcgcttgccgagctggttgaggcagccggagatgacgatcgccgtcaggctgccaagcatcaccatcggcaatacccggcccagggccacgccctgctccatatgcatcagcgcggcataacccattgacagcgggatcgccccctctcccacgccgccggccataatcggcagcacgataaagaagaacacctggaacggctccatgcccagcagcgtgccgacgccgatgcccaccagcatgccgaccacttcgccgcacagcatcgggaagaagatcttcagaaagccctgaatcagcgtggtgcggttcatactcatgatgctgccgacaatgatgcagcagatatagagatagaggatgttagtggatttatagaatttggtcgtggattcaataaccacgtcaggcagcagaccatagtggaccagcgcggaaggaataaaggtggcgcagatcgccgccgcaccgagtttccccagcaccgggaggcgtttaccaaactcgccgcaggcgaagccaaagaaagccagggtggccaccatcaccacgatatcgctcggcagtttgccgccaaggcagtcgagggcaatcagtcctccggccagcagaaacagcggcagcgggacgatccccaccttccagttatccataatatgccaccagcgctgcttgagcgtggttttcggcgtatcgatcggttcaagggttgcagagaatgcattgtctgtggtgctcataaattcagccctgtcgttattattcattttcagcgtaaagggacagcggcgtcgttaatgtgaagcttcccagattaaaaaagaagttttaatggtcactatggtttttatggtttctattcgctgaactgcccgggagtgatatatctctgatttatgactgtggtttttatggtttttatttcccgccggccgcctatttccgccgcgaccgctggcggcagcccgcgcctgcgccgctgatcacaactttcccttaacatttacgtcacgtgacagaaaaatgttagagtgccggtatggttaatacgtcgtccggggcctatgaaattatcttttcaatataagctgtttatttctctggtcgcttttttctcggtcctttttatcgcgctgggcatttattattattttgacgccagccgccagctttatcaggagatgagcgcccgggccaaaatacaggccgaagagatagccctgatgccgaatttacgtcaacaggtcagccggcacgacccacaggcgattcaggcgtttatgcagcaaatcgccgcccatagcgacgccagctttatcgtcatcggcgaccgtcagggagttcatctgtttcattccgtccatccggagtgggtcggcacccgactggtcggcggcgacaaccaggcggtactggaaggaaaatccatcaccaccattcgcaaaggcggcctcggggtctcgctgcgcagcaaaacgcccatcgttgatgacgcagggcgagtgatcggtattgtctccgtcggctacctcaccagctatctcgacagcattactctgactaaagtgatcaatatttttatcgccgccgtcctgctgctcatcgccctgtttatcttctcctggtactttacccgcagtatcaagaagcagattttttcgctcgagccgcgggaaattggcctgctggttcgccagcaaaaggcgatgatggagtcgatctttgagggggtgatcgtcatcgatcgccagcggcgtattgaggtgataaaccatgccgcccgcagcctgctggggctcagccagcccgcccgccagctgcgcggtcagtcgatcgacagcgtcatttcgccgcagccctttttcgccagcggcgacatgctcgaacgcgatacccacgatgagctgtgccgcttcaaccagttgaccgtgctcgccagtcgggtgcgcattatgctggagaataccctgcagggctgggtgatcacattccgtgaccgcaatgaaatcaatgccctcaccgcccagctgagccaggtgaagcgctatgtcgacaatctgcgcatcatgcgccacgagcagctcaaccggatgactaccctctccggcctgctgcatatgggccattatgacgaagcgatccgctatattcaggcccagtcggaacatgctcaggagctactggactttatctcctcgcacttccactcgccgacgctatgcggtctgctgctcggcaaagccacccgcgcccgcgaaaaaggcgtggcgctgagcttcgacccggcctgccgcatcgaccgccccctgccgtcgctgatggaatccgagctgatctccatcatcggcaacctgctggataacgccatcgaagccacgcagcgtgccgagctgccgcatgagccggtggaagtcctgatccagctcaacgcccgggagttgattatcgaagtggccgaccgcggcgtcggcatccgccccgatatccgcgagcgcatttttgaacgcggcgtcaccaccaaaacccgtggcgatcacggcattggtctgtatcttattgaacattatgtcactcaggcgggcggcaccatcgaagtcgccgataacgcgccgcggggaacgatcttcaccctatttatcccggccgacgcgcacgcctgtccgcaaccggaggcccacgatgcatcatgacctggtcgatgtgctaatcattgaagatgagagcgaactggcgcgcctgcacgccgagcttgtgcaaaaacacccgcgactgcggctggcaggcatggcggcctccctcgcccaggcgcggcagctgcttcacgccacgccgccgcagctggtgctgctggataactatttaccggacggcaaaggcgtcacgctgatgaccgacccggcgctggcgaccagccaatgctcggtgatctttatcaccgccgccagcgatatggaaacctgcagccaggccatccgcaacggcgccttcgactatatccttaagccggtatcatggaagcggctgagccagtcgctggagcgctttatccagttctacgatcagcaacgggagtggaaaatcgtcgatcagcaaaacgtcgattccctctatcaactgcaggcgaagaactatcgcgtggatagcggcagcaaggggattgaagagaaaacgctggcgctggtgcagggactgtttagcggccgggaagcgcactgtttttccgttgatgaagtggtcagcgccgccgggctcagcaaaaccaccgcccgtcgctatctggagcacggcgttgagaccggttttctggaagtggagatgctgtacggaaaaattggccatccgcggcggctgtatcgccgcgctaaggtcaaaagttaaaacccctcgccggacgggaggggctggaaacgtcagaagccgcgctgctctttgatcagctcccaggccttctggatctcctgggccttctgtttggccatctccatcatctccggcggcagacctttcgctaccagcttgtccggatgatgttcgttcatcagcttgcgataggcgcgcttcaccgtcgccgcgtcgtcggtcggttttactcccagcacattgcaggcatcttcgagggtcggcccacgctgcgcctgctgccagccggcgttgccgccatgctggccataagagcgctgctgcgaaccgccgccaaactgggcgccgccctgcatcatccgcaggaattgatcgaactgggcgcgggagatgccgagctcgtcggcaatgacgaacagcacttcacgttcgttaggatgcagttcgccatcagcgaacgccgcctgcagctgaatttccagaaacatccgaatcagatcgaaacggccaaagcagacgctgcgcagctgacgcattttctcgcgcaggggatagttgtcggccttaccgtcgcgaaacgcctgctgcgccgcggtgcgcgaggcgccatgcaggttcatgcgatccattagcacattggcgacatgaatatccgcttcggtaacgcggcccttggatttggtcaggtgccccatcacttcgaaggtggtggaaaagaagagcgactgacgctcctgctgattggcgaagagatttaaccggcggctgcgcgcccggtcaaacatatggccgaccagaaagccaagcaccacgccccagaacccaccacccatcagcaaagccactgccacgccaatcactttacccaaatactgcatagactccccaactgtttatcgccgttaagctcgaatatgaccgcacgttacccggcactcgcgcctcggtcaattgtgggacatagcctataatttgctttatcatactcgtcattcaacagggtgcctaacgctcgggctcgaaacgggcaggattaacactagcgtgataatgttgagtaagttaggctctgaccgtttgcaagccgctgtcacaagatgatggaacaataaatacaacgtatgaaaaaacgtattcccagcctcctggctacgatgattgccagcgccttgtatagccaacaaggcctcgctgccgatctcgcaacgcaatgtatgcttggcgtgccaagctatgatcgtccgctcgtggaaggtcgtcctggcgatctgccggtgacgattaacgccgatcatgcgaagggcaactacccggacaacgccgtctttaccggcaacgtcgatattaaccaggggaatagtcgcctccgcgccgacgaagttcagctgcaccagcagcaggccgcgggccaggcgcagccggtgcgcacggtggacgcgctgggcaacgtgcattacgacgataaccaggtgatcctcaaagggccaaaagcctggtcgaatctgaataccaaagataccaacgtctggcagggcgattatcaaatggtcggacgccagggacgcggcaccgccgacctgatgaaacagcgcggtgaaaaccgctataccattctcgaaaacggcagctttacctcctgtctgccgggctccgacacctggagcgtcgtcggcagcgaagttatccacgatcgcgaagagcaggttgccgagatctggaacgcccgcttcaagcttggctctgtgccgattttctatagcccctacctgcagctgccggtgggcgataagcgtcgttcaggcttcctgatcccgaacgcgaaatacagcaccaaaaacggcgtggaattctccctgccgtactactggaacatcgcgccaaacttcgatgccactattactccgcactatatgaacaaacgcggcggcgtgatgtgggaaaacgagttccgctatctgacccagctcggcagcggcttaactgaattcgactacctgccgtcggataaagtctacgaagacgaccactcgagcgacagcaacagccgccgctggctgttctactggaaccactcaggggttatcgatcaggtatggcgtctgaacgctgactacaccaaggtcagcgatcctgactacttcaacgacttcagctcgaaatatggttccagtaccgacggctatgcgacgcagaaattcagcgccggttacgtcaaccagaactttgacgccacggtatcgaccaaacagttccaggtctttgaccgcgaatcgagcaactcctattcggctgagccgcagctcgacgtcaactactaccagaatgatgtcggtccgttcgatacccatctctatggacaggttgcccattttgttaactcgaataacaacatgccggaagcgacccgcgttcacttcgaaccgacgatcaacctgccgctgtccaacggttggggcagtctgaataccgaagccaagctgctggcgactcactaccagcagagcaacctcgataagtacaatgccgccaacggcactgactataaagagtccgtcagccgcgtaatgccgcagtttaaagtcgacggcaaaatggtctttgaacgcgacctgcaggagggattcacccaaacgctggaaccgcgcgtgcagtatctgtacgtgccgtaccgcgatcagagtgaaatcggcaactacgactccacgctgttgcagtcggattacaccggtctgttccgcgaccgtacctatagcggtctggaccgcatcgcgtcggctaatcaggtcaccaccgggctcacctcgcgcgtgtatgatgccgccgcggtggaacgttttaatatttccgttggtcaaatctactatttcaccgagtcacgcaccggtgatgacaacatcaactgggagaacaacgataccacgggttcactggtctgggccggcgatacctactggcgcattgccgatgaatggggtctgcgcggggggatccagtacgatacgcgtctggataacgttgccactggtaacggcaccattgaataccgtcgcgatgagaaccgcttagtccagcttaactatcgttacgccagcccggaatatattcaggccacgctgccgtcatattccaccgcggcacaatataaacagggtatttcgcaggtggggatgaccgccagttggccgattgtcgatcgctggtccgtggtcggggcctactactacgatactaatacccggaaagcagcaaaccagatgttgggtgtgcagtataactcctgctgctacgccatccgtcttggctacgaacgtaaagtcaacggctggaacagcaacgacaacggcggcgagagcaaatacgataacaccttcggaatcaatatcgaattgcgcggtctgagctctaactacggcctcggcacccagcagatgctgcgctcgaacattttaccgtaccagagctccctgtgatgcggctggtttacaacatcatccgcatttgcggttaatcgaaatggaaaaagtatgaagaactggaaaacgctgcttctcggtatcgccatgatcgcgaataccagtttcgctgccccccaggtggtcgataaagtagcggccgtcgtcaataatggcgtcgtgctggaaagcgacgtcgatggtttgatgcaatcggttaagctcaatgctggtcaggctggccaacagctgccggatgacgccaccctgcgccatcaaatcctcgaaagactgatcatggaccagatcgtgttacagatggggcagaagatgggcgtgaagatctctgacgaccagctcgatcaggctatcgccaacatcgccaaacaaaataatatgaccttggatcagatgcgcagccgtctggcgtatgaaggcatcaactacaacacctaccgtaaccagatccgtaaagagatgctgatttcggaagtgcgtaacaatgaagtgcgtcgtcgcatcaccgtgctgccgcaggaagtggaagcgctggcgaaacagatcggcgaccagaacgacgccagcaccgagctcaacctgagccacatcctgatcccgctgccggagaacccgacctctgacgaagtcgccgcggcccaggagcaagcaaactccatcgttgagcaggcgcgcaacggcgccaacttcggcaaactggcgatcacctactccgctgaccaacaggcgctgaagggtggccagatgggctggggccgtatccaggaactgccgggcattttcgctcaggcgttaagcaccgcgaagaaaggggatatcgtcggtccgattcgttccggcgttggtttccacattctgaaagtcaacgacctgcgcggtggtacccagaatatctccgttaccgaggttcacgcccgtcatattctgctgaaaccgtcgccgatcatgaacgacgcccaggctcaggctaagctggaacagatcgcagccgagattaagagcgggaaaatcacgtttgctcaagcggcgaaaacctattcggaagatccgggttcggcaaaccagggcggtgatttaggctgggccacgccggacatctttgacccggcgttccgcgatgcgctgatgcgtctgaacaaagggcagaccagcggaccggtgcactcttcctttggctggcatctgatcgaactgctggatagccgtcaggtcgacagaaccgacgccgcacagaaagatcgtgcttaccgcatgctgatgaaccgcaaattctctgaagaagcggcaacctggatgcaggaacagcgcgccagtgcgtatgttaaaattctgagcaactaatatcgatgcctgaaacccgtaaagttgttatcactcccggcgaacccgccgggattggccctgacctggtcgtgcagcttgcccagcgcgactggccagttgagctggtgatttgcgccgatggcgccctgttaactgaccgagccaagcggctcggtcttcctttatctctcctcccttacgatcccgcgcaacctcctgttcctcagcgcgccggtaccctgacgctgctgaacgtgccgctaaacgtcccggcggagcccggcgtgctgaatgtgcaaaacggcgcctacgtagtggagacgctggcgcgcgcctgcgacggttgccttagcggcgagtttgcggcgttagtgaccggcccggtgcataaaggcaacatcaacgacgccggtatcgcctttaccggtcataccgagttctttgaagagcgcgcgaaggccagcaaagtggtgatgatgttggcgaccgaggagctgcgggtggcgctggtcaccacccatctgccgttgaaagccatcagcgaagcgattacccccgagctactgcgcgagatcatcaccattctcgatcacgacctgcgcacgaaatttggcattgcccagccgcatgtgctggtttgcgggcttaacccgcacgctggcgaaggcggccatatgggaacagaagagatagacaccatcattccggtgctggaagagatgcgcgcaaaggggatgaacctcagcggtccgctgccggcagacaccctctttcagccaaaatatcttgatcatgccgatgcggtactcgcgatgtaccacgatcagggcctgcccgtgctaaaataccagggctttggccgcggcgtgaacattacgctcggtttaccttttattcgtacctccgtcgaccacggcaccgcactggaattagcgggccagggaaaagcggacgtcggcagttttatcacggcgcttaatctcgccatcaaaatgattgttaatacccaatgaataatcgagtccatcagggccatttagcccgtaaacgcttcgggcagaacttcctcaacgatcagtttgtgatcgacagcatcgtctcggcgattaacccgcagaaaggccaggcgatggttgaaatcggccccggcctggcggccctgaccgagccggtcggcgaacgccttgaccagctgaccgtcatcgaactggaccgcgatctggcggctcgcctgcagacgcatccgttcctcggtgcaaagctgaccatctatcagcaggatgcgatgaccatgaactttggcgaactggcggagaaaatgggccagccgctgcgcgtcttcggcaacctgccgtacaatatctcgaccccgctgatgttccatctgttcagctatactgatgccattgccgatatgcactttatgctgcagaaggaagtagtgaatcgtctggttgccggaccgaacagtaaggcgtatggtcggttaagcgtgatggcgcaatattattgccaggtgatcccggtactcgaagtgccgccgagcgcgtttaccccgccgcctaaggtcgactccgcggtggtacgcctggtgccgcacagcaccatgccgtatccggtcaaagagatccgggtgctgagccgcatcaccaccgaagcgttcaaccagcgccgcaagactatccgcaacagtctcggcaatctgttcagcgtggaagtgctgaccgagctgggcatcgacccggccatgcgcgccgaaaatatttccgtggcgcagtactgcctgatggccaactggctgtctgacaatctgccaacgaaggagagctaaccatgattcattcgccccgggtgtgtgtccaggtacagagcgtctatatcgaatcgcagtcttccccggaagaagagcgctacgtcttcgcttacaccgtcaccattcgcaacctggggcggagtcaggttcagctgcttggccgctactggctcatcactaacggccacggtcgtgagactgaagttcagggtgaaggggtggtcggcgagcaaccgcatattcccgccggcggtgaatatcaatataccagcggcgcagtgattgaaacgccgctgggaaccatgcagggtcattatgagatgatcgatatcgacggcgcgccgttccgtattgagatccctgttttccgtctcgcagttccaacgctcattcattaaaacaatgtcaacataccttattggcgacgttcacggttgctacgatgaactgatcgcattattagcgcaggttgaattcgatccgcggagagatacgctgtggctgaccggcgatctggtggcccgaggcccgggatcgctggaggtcctgcgctatgtcaaatctctgggcgacagcgtacgactggtgctgggcaaccatgacttacacctgctggcggtctttgccggtatcagccgcaacaagccgaaggatcgtctgaaaccactgctggaagcgccggatgccgatgagctgctcaactggctgcgtcgccagccgctgctgcaggtggatgaagagaaaaagctggtgatggcccatgccggcattacgccgcagtgggatctggagaccgcccagcagtgcgcgcgcgatgttgaagcagtgctctccagcgactcctatcctttcttcctcgatgccatgtacggcgacatgccgaaccactggagcaacgagctgagcggcctggcgcgcctgcgctttatctctaacgcctttacccgcatgcgctactgtttcccgaacggccagctggatatgtattcgaaggaagcgcccgaggacgccccggcgccgctgaagccgtggtttgccattcccggcccggtcagcaatgcctacagcattgcctttggccactgggcttcgctggagggacgcggcacgccggaggggatttacgccctggataccggctgctgctggggcggggaactcacctgcctgcgctgggaagataagcagtacttcaccgagccgtcaaaccggcagaaaagcctcgacgaaggcgaagccgtcgcgtcctgactcttcccggatagcggcgcgttgcgccttatccgggctacctgcggcgtcgttttgtcgggtggcggctaacgccttacccgacctacatttccttgccatttgtagcccgggcagcactccaggaagacgaagcccgcgacgggaaacatgacgcagtcccgtaggcccgcgcaagcgcagcgccgccgggcaagaactgcgggcgcggagccacttttgtgtcgggggacggctaacgccttactcgacctacgtttaagtgctatttgtcgccccggggagcgcttcagaaagaagacgaagcccgcgatgggaaacacgacgcagtcccgtaggcccgcgcaagcgcagcgccgccgggcaagaactgcgggcgcggagccaattttgtgtcgggtgacggctaacgccttacccgacctacgtttaagtgctatttgtcgccccggggagcgcttcagaaagaagacgaagcccgcgacgggaaacatgacgagatactgagtgcgccatcgtcgcgcaattcatgcaaaagaaaaccccggtcacgccagacgcgaccggggtttttttatcgctatcctgcccgcttaacggcgttcgaggatctcaaagcagtagctatgggagttctgcgcgtcggcgtcatgaaactcgctgaacaccgactcccattcgtccggatcgtaatccgggaaatgggtatcgccttccacttccgcatcaatatgggtcaagtagagcttctgcgctttcggcaggaactgctcatacacccggccgccgccgatcaccataatctcttccacatcgccgcaggcggcaattgcttcttctacggaggagacccactgcacgcgatcgtcgctgccgggtttgctgctgatcacgatatttttacgccccggcaatgggcgcccaatggattcccaggtcagacgccccatcaccaccggcttatttaacgtgttgcgtttgaaccaggcgagatcggcaggcaggttccatggcatggcgttttccataccaatgacgcgatctaccgctaacgccgcaatcagactgatcattcattcattcccgagtgcaaaaaattgtcgccactatacggaaagcgtacaacttcgtcgactggccggagggtaaagaataagaaaattttctgatttgctggcaagcccacgttcacaccgtgggccgccagaagaggatccaaacgaaaacaaaatgttactggtcagcctcaggctgagggcttattttccggctcatcggcgatatccccggtgtgcctgccctcttccgtcccctgccagccatgacgctgcaccagcgacagatgatgacgatcttcgttgatgatgccggtcagcatatcgctggtccgcttgaagaccgccacccgcgacgcggcatcgttttccgccatcgccaccatctcttcgaccatctgcaggttgaatcgacggaacagatcggcccgctcgcgcgcttcataggcgccgagccccagcgcctccagcgtcattcggccggacttcagcgccgcctcgaaggtttcacgctccggggcctcgacgccagcctggcgcagctgaatgtaatgatcgacatcgcgggcgcgggagatgatctgcagatgcggaaaatgctcttttaccctcgccaccagctccaggctgacgtgcggatcgtcaatggcattgatcagcacttccgccttttcggccccggccgactccagcagatcgacccgggtggcatcgccgtagaaaaccttcatatcaaatttgcgcagggtatcgacatggtccgggtcatgatcgaggatcaccatcttcaccccgctcgagagcagcaatcgcccggcaatctgcccgaagcggccaaagccggcgacaatcacccgcggctgctcttcatcaatctcgtcagcatcacgcgcctggccgctggacgatttctccagacgggtcagcagcaccagcagaatgggggttgccgccatcgacagggccaccgccagggtcaacgcttttgcccattcgccgtccagtacatccgccatccgcgcggcgccaaacaccacaaacgcgaactcactcccctgccccagcagcaccgcaaaccagcggcgctgggcgcgcggtacgccaagcggcctggcgataagccacagcatcagcatttttatcgccaggaaaccgaccagcaaaatcacaatacgcagcggatgggtgaccagggtgccaaaatcaatcgacatgccgacgccgataaagaacagccccaacagcagtcctttaaacggctcaatatcactctccagcgcatgacgatattcggaactggccagcagcaccccggcgagaaacgcccccatcgccatcgacagccccacctcttccagcaataagccaaagccgaagaccaggaacagggccacggcgctgaacacttcgcgcaggccggaacgggcgacaaagcgcagcagcgggcgggtcagatagcgcccaaggaccaccaccagcgccagcgctgcggccactttcagcgcggagagggcaaaagccatcagcgaagtggcgccgccgctggccgccagcagcgggatcatcgccaccagcgggatcgcggcgatatcctggaacagcagcaccgcaaaggcgctgcgccccatctgcgacaccgtcagattgcgctcattcatcgcctgcatagcaatggctgtggaagaaagcgccagagtcataccaatcagctcggccacctgccagcgcaggcccagcagcatgcagaacaggccgatcaacaccccgcaggccaccatctgcagtgcgccgccgccaaacaccgaggcgcgcagcttccataagcgctgcggatcgagctccagaccaatgacgaacaacatcagcaccacgccaatctcggcaaagtgcagaatcgcctcggcatcggtcaccagccgcagcgcccacgggccgataatacagccggcgatgagatagcccagcactgaccccagccccagacggacggcgatgggcacaatcagcgccgcggcgccgaggtaaatcaacgcctgtatcagcgtatggctatccattctggtgtgcctcctgccagtcgattaagcgttgacgatagcggcgggcctgcgcctgcagcgtttcatcatcgcagataaaggtgcagtgcatagcgaacggcggcagccatttcatcccgcagtaaagcgcagttgcctgcagaggctgcgccagcaccgggaaaccgggaaacgaaccgatatcaaagtggctttcaccgccgccggtagtgaccgcccacatcagcgatttaccgcgcagggcaataccgttgtgaccataggcccagccgtgcgacagcaccttgtccatccacagcttgagcagcggcggtacgctataccactgcataggatgctgccagataaccagatcggcacgggccagcgccgcctgctcggcggcgacatcgatattaaagtcgggatagagttgatagagggagcgtatctctacgccttcaagcgtccctgcctgttcaagcattcgcttattcgcatgagaatgctgcggataaggatgcgcataaattatcagaatcattgattggcctgcgtttgctcttgtcgtaatcagcaagagtgtagacagttaagcgaaccgcttacaatgataactgtgatttatgtcgcgatggcttacgcaacgcgcgccctgagggttaacgtcaggccttagttatccagctcgtccatggacttcacctggtcgcggttaatctgctccacgcggccggtttcggcatttttgtatgagacgaggccggtgtcatcatccacctgcggtttaccgctggtgacaatggtcttgccgtcggtggttttgatcgactgattcgatgagcagccggccacgaacatgattgccgtcgctgccagtgcggatgccaccagaatattgttccgcattgtatcctcctgtcttttcatcaataggtatcgttatggtgctaactatagttagcctgacccgacagggggttaaaagcagaactctctgaagatggctgcggccaaaaaaaataggctgacgatgtcgtcagcccaggattgttgctatccggccaggccgggaagcttatttagtgatttgcgcgtgcatttcctgaaccgaaatcaccttctcggtggcgtcagcgttcagcgccatcgcggtggcaaagccgccgttcagggtggtgtcgtaatgcactttgtactgcagcgcgctgcggcgaatcagcttggagtcttcaatcgcctggcgacctgcggtggtgttgatgatgtaggtatattcgccattcttgatgcggtcctgaatgtgcggacgaccttcatgcaccttgttcaccagacgcgggttaatgcccgcttcacccagcacaatcgccgtaccgtgagtcgcatccagctcgaagccaaacttcagcagcttcgccgccaggtcaaccacgcgctctttatcgccttcgcggacggagagcagcgcgcgaccctgtttcttcatggtcgagttgctgcccagctgcgctttggcgaacgcttcggcaaaggtgcggccgacgcccatcacttccccggtggagcgcatttctggccctaacagcgggtcaacgcccgggaatttattgaacggcaggaccacctctttcaccgagtagtacggcgggatgatctctttggtcacgccctgctgcgccagcgtcttaccggccatcacgcgcgccgccactttcgccagcgggacgccggtggctttggagacgaacggtacggtacgcgccgcacgcgggttgacctcaatcagataaacttcgttatctttcaccgcgaactggacgttcatcaggccgcgaacctgcagctcgaaggccagcttctgcacctgctcgcgcatcacatcctgaatctctttgctcagggtgtaggccggcagggaacaggcggagtcgccggagtggacgcctgcctgctcgatatgctccatgatgccgccaatcagcaccatttcgccatcgcagatggcatcgacatccacttcaatcgcatcgtcgaggaagcgatccagcagcaccggcgcgtcgttggagacgctgaccgcggtctggaagtagcggcgcagatcctgctcgtcatagacgatctccatcgcccggccgccgagcacataagacggacgcactaccagcgggtagccaatctctttcgctttctctaccgcctgctcaatggcggtgacggtggcgttcgccggctgcttcagcttcagacggtcaaccgcgtgctggaagcgctcacggtcttccgcccggtcgatagcgtccggactggtaccgataaccggcacgccggcagcttccagggcacgagccagcttcagcggggtctggccgccgtactggacgataacgccttttggcttctcgatgcgcacgatttccagcacgtcttccagggtcaccggctcaaaatacagacggtcggaggtgtcgtagtcggtagagacggtttccgggttacagttgaccatgatggtctcgtaaccgtcctcgcgcagcgccagcgaggcgtgtacgcagcagtagtcgaattcgataccctgcccgatacggttcgggccgccgccgaggaccatgattttatcgcggtcaacggacgggttggactcacactcttcttcataagtggagtacatgtaggcggtatcggtagcaaattccgcagcgcaggtgtccacgcgcttgtagaccgggtgcaggtcatactggtcgcgcagcttgcggatttccgcttcccgcacgcccgccagcttcgccagacgcgcatcggcaaagcctttacgcttcagggtgcgcaggaagtcagcgtcgaggccgttgatgcccacttccgccactttctcttccagacggaccagctcttcaatctgtaccaggaaccagcggtcgatgttggtcaggttgaagacgccgtcaaccgagaggcccgcgcggaacgcgtcagcgatataccagatacgctcagcgccggcatctttcagctcgcggcggattttggtcagcgcttccgggtcgtcgaggctcactttcgggtcaaagccggtagcgcccacttccagaccgcgcagcgctttctgcaaagattcctgctgggtacggccaatcgccatcacttcgccgacagacttcatctgggtggtcagacggtcgttggcgccggcgaatttttcgaagttaaagcgtgggattttagtgaccacgtagtcgatggacggttcaaaggaagccggggtgcggccgccggtgatgtcgttcatcagctcgtcaagggtataacctaccgccagcttggctgccactttagcaatcgggaagccggtggccttagaggccagcgccgaggagcgggagacgcgcgggttcatttcgataacgatcaggcgaccgtttttcgggttgaccgcgaactgcacgttagagccgccggtttcgacgccgatttcacgcagcaccgccatcgaggcgttacgcatgatctggtactctttgtcggtcagggtctgcgccggggcaacggtgatggagtcaccggtgtggatccccatggcgtcgaagttttcgatggagcagacgatgatgcagttatcgttcttatcgcgcaccacttccatctcgtactctttccagccgatcagcgattcatcgatcagcagttcgttggtcggagagagatccaggccgcgttcgcaaatttcttcgaactcttcgcggttataggcgataccgccgccggtgccgcccatggtgaaggacggacggatgatgcacgggaaaccaacgtcggcggcaaccgccagcgcctcttccatcgtgtgggcgataccagagcgcgcggtgtcgaggccgatttttttcattgcgatatcgaaacggcgacggtcttcggctttatcaatcgcatcggcggtggcaccaatcatggtcacgccgaattcagccagtaccccctgacgctccagctcgagcgcgcagttcagcgccgtctggccgcccatggtcggcagcaccgcatccgggcgctctttttcgatgattttacgcaccacttcccagtgaatcggctcgatgtaggtggcatcggccatttccgggtcggtcatgatggtcgccgggttagagttcaccaggataacgcggtagccctcttcgcgcagcgctttacacgcctgggcgccggagtagtcaaactcacacgcctgaccgataacaatcgggcccgcgcccagaatcaggatactttttatgtctgtacgttttggcattgctcttttactcctgattatttcgcggactgacggtattgctcaattaactcgataaagtggtcgaacagcggcgcggcatcgtgcggccccgggctcgcttcagggtgcccctggaagctgaacgccggtttgtcggtacgatggatcccctgcagggtgccgtcgaacagcgacttatgggtcacgcgcaggttggccggcagcgtcgcctcatctacggcgaaaccgtggttctgggcagtgatcatcaccacgttgttatcaatatctttcaccgggtggttgccgccgtggtggccgaacttcatcttaatggtcttggcaccgctcgccagcgccagtagctgatggccaaggcagatgccgaataccggaatatcggtctcaaggaatttttcaatcgcctcgatagcgtaatcgcacggcgccgggtcgccagggccgttggagaggaagataccgtccggattgagcgccagcacgtccgcggcggaggtcttcgccggcaccaccgtcaggcggcagccgcggtcaaccagcatgcgcaggatgttgcgtttcgcgccgaagtcatatgccacaacgtggaacggcagctcgctttccgctttcgcttccggcaggtcgcccgccagggtccagctgccttgcgtccagctataggtttctgcggtggtcacttccttcgccaagtccatgccgttcaggcccgggaacgctttcgctttttccagcgccagctgggcatccgggctgtcgcccgcgatgatgcagccgttttgcgcccctttctcacgcagcagacgcgtcagcttgcgggtatcgatatcggcaatcgccacgatgttatggcgcttcagataagaagagaggtcttcagtactgcggaagttgctggcaatcagcggcaggtcgcgaataaccagaccctgcgcatgtacctgagaagattcttcatcggcggcgttggtgccgacattaccaatatgaggataagtaagagtgacgatttggcgggaataggaaggatcagtgaggatttcttgataaccggtcattgaagtattgaaaacgacttccccaaccgccgtgccggttgccccgatggcccgaccgtgaaactgggttccgtcttccagaaccaatagcgctgacttaatcaaaacatcctccagagaatatccactcactttatttgcatattaattcataaacacgatctgaatcaatgcaaatctgttgcccgcagatttttggcaaacggcggcattctggagagatgtcggataaaagtcaacttaaagcggagatttttaatgtcattttacgccactgatgcgtaacacgtgatttttacgccaaaaagatcaacaaacctggctgagaaaacgcttgcggatgtggaagagtgtaaaacagagcgatgctcggcaaaaaagtggaccagatggtcaaaatttacatttcattcactaaaaaacacgctaatactgtattttttacgcgttacactcaaaacatcaaccgtaatacgcaaaaataaaaaagggcaacaaaatattgccctctgcatcaataacttattgatagcaataaccacatcacgatgggtaataatcgttataaagcattcaaatcaagcacatcacgcatatcaaacaggccatttttcttgcctttcagccataatgctgaacgaacggcgccatttgcaaaggtcatgcggctggacgctttatgggtgatttcaatacgctcaccgatgtcagcaaacattgccgtatgctccccgacgatatcgcccgcgcgaacggtcgcgaagccgatggtgcccgggacgcgttcgccagtgtagccttcacgactgtagaccgcgcagtccttaagatctttgttcaatgccccggcgatcgcttcgcccatcgccagcgcggtgcctgacggcgcatccactttatgccggtggtgcgcttcgataatttcgatgtcggtatagtcgcccatcaccttcgccgccttctccagcagcttcaacaggacattgacgccaacgctaaagttagcggcgaagacaatggcaatgtcctgcgcggcatcgcgaatcgcctgtttgccagcgtcgtcaaaaccggtggtgccgatgaccatccctttgccgtgctcgcggcaaaacgccagatggttcagcgtgccttccgggcgggtaaaatcgatcaacacgtcgaaatcatcttttaccgccgccaggctgctctgcaccgcgacgcccgctttgccggcgcccgccagctcgccggcgtcgctgcccaccaggcttgacccttcgcgctccagcgccgcgcccagcgccacgccttccatctgcaatgcagcctgaattaactggcgtcccatccggccgcccgcgccggcgatggccacgcggatttgtgcatcatgcatagctattctcttttgttaacattacgtaaattgttttcagagtaaccagcccgtcagcgggccgctactcaaaaacgccgataattagaaatttatgacaaacggcggacgatatcagtaaaaactatacgattgtgctgaaatgcgggctttgcgggtgctctctctgagacgataatcgacgttttcgtcatcagttggtttcaagaaataagatgcactaaatctggcaaactcgaccgaccagcattgaaatgctagggaaacattatacttccggtagagcagaaagccttacgccagggtgtagctgaccaccagctgccccttcttcatcttaatctgactaatgacaatgtcgcccagctccgccagacgggcgacgtgggtgcctccgcagggataggctggcagctcgccgaatcccaccttgcgcatgccatcagcgaacgtcacctgacgcggtaagtcctgcgcctgccatgcctttactagcgccagtagcgcactggcgtccggcagcgcggcgctattcctgctggcaaaggttatccgcccttcgccgggccagtggtgcgctttcaccggttgccagccaagctgttcgcccgccaggccaagcaggtggccggcagaatgcagacgagcatgcagctgtctcgcggaggcatcaattttcatctccacttcaccgaggggaaggggttgcgacagaatatgcagcaccctttcgccgcgcacagccaccgtctcaaccacctgcccggcaatccatccacggtccgccggttgaccgcccccttgcgggtgaaacagcgtccgctccagttcgatggcgtaacggccatccgcttctgcagtgcaggcgatgatctgggcgcgcccgtcggtagcatcgctggtgtaataaacccgttcagtcatagtgattctcctctctgtccggccagtatattattaatgccgacagcgataatcccaccaccagccaatgcactcttgctccgggagcacaaatgaatctgaacctcctgcccgacctcgctcttttcgttcagatagtcgaccagggcagcttctctgccgtcgcccgccagaacggcattaccccttcagccgttagccgcagcgtgtcacggctggagcgagagatgggctgcaaactgctgcagcgtaccacccgcaagctgcgtcttagcgatgccggggaaacgatatatcagcatgcccagcagatgctggaagcggcgcgacaggcaatggattccgcaggcagtcgccaaacggtcgcccagggaaagctgacgctaagcgtcccgaaagccgtcggccgctttgtgatccacccgctgatgatggcgtttttccaccgctacccgcaggtggacgtctgcctgcggctggaagatcgccctctcgattttatcgatgacggtattgatctggcgctacgcatcaccgataccccctcccccggcctgcatggcaaaccgctgatgccaatcaggcacgttatctgcgccactgaggcctatttacagcagcacggtacgccgtacacgccgcaggatctgcgcgcgcatagctgcattagccttggcgaaacgcccgccgatgcgcgctggaagttccgtcgggaaggcaaaacagaaacggtgcaaacctacgggcggtacgccgccaaccataccgccgtacgcctcgacgcggtcagacagcatttagggatcggcagcctgccgctgttcaccgcccgtgaggcgctggcgaacggcgacatcgtgcaggtgctgcccgagtgggaatttatcagcagctactccggcgacctgtggctactgtgggcgggagataagcatatgcccgccaggatgcgggcgatgatcgattatctcagcgagacggtgccggcgctgaacgcaggcagcacagagccagcgaaataattgcaaaccacggaatgataactcccaacacaaaccagatcccggagcggccgatatcatgcattcgccggcagccaacagccagcagggggatcgccatcatcagcagccacagcgccgcaaagtatatgacaacaaaactgaggagcccgtagtgagggtcaacaagggtggccagactccaggcggccactggcgcggcggcgatcaatacattgatgagaaaaaacgtcaagaactgctgccggctggcgcggccactaaaattaaaggtctctttccagccgctcaaatacgcctgtccataggtcattgcttctctccttgaaaatcgagtgatatatcacggcgccagggcaatcacctccgccgcccagcgctgaaacccttcgacgtcgatatccagcgccacctgggcgttcgccggctggcccagtcgtccttcgatatccaccaccgtggtgccggcggtccaggtcccctgcgtctccaccgccacaaagcacggctggagagtgaacagttccgggcgggccagccacgcaatagcgcacaagtcgtgcatgcgcagaccgctgctcatgctgccgctgcgatagtggctaaacagcgcatggagcattttaccggtctggttcagcgtcggcagcgtcgccagataatccgccgccagcagcgcccggttggtgacgtccagcccgcacatcacaatctccagcccgctgtggaacactttcgcggcggcctccgggtcgatagcgatattgaattccgcattcggcgtgaagttgccgcggcccgccgagccgcccatgatcaccagccggcgaatattaaacacacattccgggtactgggtcagcagtagcgctatattggtcagcggaccaatcgccaccagggtgatcggctcggcagcatgcataagtgcatcacggatcgcctggaaggccggcttcgccagcggttgacgttgatgctcaacaaagtcatacccctccatgccggattcgccatgcaccgaggcggcgtcgcgcaacggacgcaccagcggcatcgacgcgccctgcgccagcggtacatcggcattccagaaatgcagcaattgcagcgcgttacgggtcgtcttctccaccgagacattgcccgctacggtggtcatcaactgcagatccagctcaggcgcgaacagcgccgcggcaatggcggcggcatcgtcgatgcccggatcggtatcaagaatgattggtaagcgcatggtttctccctaaaaaaatgccagacgttaagtctggcatcttctcatactgctggaggaaagaacttactctacttcacggacatccacacgcagctctttcggcacttcaaagacgatattctcttcccggccttccagcggcacggcttcgccgccgcccagctcctgcaggcgggtaatgacgttctgcaccagaatatccggcgccgacgcgcccgccgtcacgccgacgcaggccgcatccttgacccacgcttcctggatatcggaggcgtcgtcaatcagataagccgctttgcccatccgctgcgccagttcggcgaggcggttagagttggaggagtttttcgacccgaccaccagcactacgtcagcctgctccgccagcgcgcgcacggcttcctgacggttagtggtggcatagcaaatgtcgtctttgcgcgggccgacgattttcggaaaacgcgcgcgcagggcgtcaatcacatccgaggtatcgtcgacggagagcgtggtctgggtcataaacgacagccgggcgtcatttttcacttccagcttcagcacgtcttccggcgactcgaccaggtacatccccccttgcgggttgttgtactgtcccatggtgccttcgacttccgggtggccggcatggccaatcagaatcgactcttcgccgcggcggctggcgcgggcgacttccatatggactttggtcaccagcggacaggtagcatcgaacaccgtcaggtcgcggctcttcgcttcgttgcgtaccgcctgcgacacgccgtgggcggagaaaatcaggatcgcgccgtccggcacttcgctgatctgttcgataaaaatggcgccacgcttgcgcaggctatccaccacatagcggttgtgcaccacttcatgacgaacatagatcggtgcgccatacagcgtcagcgcgttttctacaatgctgatagcgcggtcaacgccagcgcaaaaaccgcgcgggttagccaacaggatctgcatgttactcctccagcgccggatcgatctccagcacttcaatatcaaaatgaacagtgcgcccggccagcggatggttgaagtcaacggtgatggaatcgccgttcacttcgcggatcacgccaggcatttcgctgccatccattgcggtaaagagcataatcgcgccgatctccggctcgccagcgtcgataaactcgcggcgagagaaatactgaatcaggtccgggctgggtacgccaaaggcggcgtcaggctccagcgaaaaggcctttttctccccctctttcaaaccgagaagctgttgctccagcccttcagacaaagaggtgtcgccgaggcgaaacagcgccggtttgccgttgctgcgggtggactcggcagtggagccgtcgtccagtttcagagtgaagtgcaccagtaccgcgctgttgctctgtacggatttagacatgcaaattgctcgcttgtttaggtcacctggtgcccggcggcattacgcttaccgggcctacgggagccaaaaattctgtaggccgggtaagcgtcacgtcacccggcattgagatttacgcctgctctttcacagtcggtttcggcaggaagccttccagcacaatcagcgctgcgccgatgcagatcgcgctatcggcgaggttgaaggtggcaaaatgccagtcgccgacgtagaagtcgatcatatcgaccacaaagccatgccacaggcgatcgaacaagttgcccagcgcgccgccgataatcagcgcgtaggcaatattgttcagcttttgcgtcgccttcgaacggtacatcagcatcgtcagcaccacgcaaatgccgatcgcgatcccggaaaagaaccagcgctgccagccgccgctgtcggcgaggaagctaaaggccgcgccatagttgcgggcataatgcagattaagcgacgggaacagcggaaccgtctcccccagagcgaagtactggaggatcaggaatttgctgcccagatcgataatcagcacggctacgaccacccacagccagcgtagccccgttgaacagatcgatttactcatcaggcgaatttacgttgctcgccgtcaccggcgacgttgctcacacagcgtccgcagatttccgcgtgttccgccaccttgccgatatcggtggtgtaatgccagcagcgcgggcatttctcaccttcagctttactcaatgcgactttcaaccctttgagcagttcgctttgctgcgcatcagcggacgcgctcgcatagtctgcgacgttcgccccggaggtcaacaggacaaatcgcaattcatcgcccagcgcattgagcttagccgccagatcggcatcagcatacagcgtgactgccgcttccagcgagccgccgactttcttatccgcacgcgcctgctcgatcaccttgttgacttcgccacgcaccttcagcagctcatcccagaaatcgtcgttcatcgcttcgtcgtcggccaggccgaacagaccttcataccactcgccggtgaagacatatttctcacgctcgcccggcagatagccccagatttcatctgcggtgaaggacatgatcggcgccatccagcgcaccagcgcttccacgatatggaacagcgcggtctggcagctgcgacgcgccacgctgtccgccttggcggtgtactggcggtctttgatgatgtcgaggtagaacgagcccatctcgatggagcagaagcgcatcaggcgctgcaccacttcatggaagtcgtaggattcgtaggctttcaggatatctttctgtgccgcctgcgcgcagccgaccgcccagcggtccagcaccaccatctcttccggtttaaccatgtctttcaccggatcgaaaccgttaaggttcgccagcaggaagcgcgcggtgttacggatacgacgatagctgtccgcagcgcgtttgaggatctcgtcagagaccgccatttcgccggtgtagtcggtggaagccacccacaggcgcaggatatcggcgccgagcttgttcatcacgtcctgcgggctaacggtgttgccgatagacttggacattttgcggccctgaccgtcgacggtgaagccgtgggtcagtacctgacgatatggcgctttgcctttcatcgccgtggaaatcatcagcgaggacatgaaccagccgcgatgctggtcagaaccttccagatacatatcggcggcgtgaccagcgaattccggacgcacgtcaaccacggaagagtgggtcgacccggagtcaaaccagacgtcgagggtatccggcactttctcgtagctgtcggcgtcatcgccaagaatgtcgcgggaatcgagatcccaccacgcctggatgccgtcaacttcaacgcgttttgccacttcttccatcagttcaagggtacgcgggtgcagttcgtgggtttctttatgcacgaacagcgacatcggcacgccccaggtgcgctgacgggagatacaccagtcagggcggttagcgaccatcgattcgatacgcgcctggccccagtccgggatccactgcacgcctttgatctctttcagcgactgcgcgcgcaggcctttctgatccatgctcacgaaccactgcggagtggcgcggaagatgatcggcgacttgtggcgccagcagcatggatagctgtgctgcagtttctcaacgtgtaacagcgcgccacgctcacgcagcatctcaacgatgatgtcattggctttgaaaacattaatgccgtccagggacggccaggtgccaggcaggtaagcgccgtccgggccaaccgggttggcgatttccagaccgtatttctggctgatggtgtagtcgtccggaccgtggccgccagcggtatgcaccgcaccggtaccggcatccagcgttacgtggtcgccaaggatcgccggcacgtcgaaatcgaggaacggatgcttaaagcgcatcagctcaagctcagaaccttgtaccgccgccagaatagtgtagtccgtcgcgccaacgcgcttcattacgctctcaaccaggtctttcgccaggatcagcgcctggccgtcaacctgcaccagcgcatagtcgaactcaggagacagagagatagcgcggttggccggcagggtccacggcgtggtggtccagataaccagcgacaccggaccgttgacgtcgactacgccgaatttcgccagtaccgcggctttgtctaccgcgtggaacgcgacatcgatagacggagaggttttgtcgtaatactccacttccgcttccgccagcgcggaacggcagtctacgcaccagtgcaccggtttggcgcctttatgcaggtggccattaccgatgattttgcccagcgcgcggatgatgttggcttcggttttgaagtccatggtcaggtacggatgcgaccagtcgcccagcacgccgagacggataaagtctttacgctggccatcgatctgctcggcggcatattcgcggcacttagcgcggaattcggcagcggtaaatttctcacccggcttgccgtattcctgctccactttcagctcgatcggcagaccgtggcagtcccagcccggaacgtaaggcgagtcatagcccgtcagtcctttggacttaacgataatatctttcagaatcttgtttaccgagtgaccaatatgaatgctgccattcgcataaggagggccatcatgcagaatgaaggtttttttgccttttttggctgcacgaatgatgccgtacaggtcatcatcggtccaacgcgccagcattcccggttcgcgtttggcgaggtcgccacgcatagggaaccctgtttccggcaaattcagggtcgatttatagtcactcatcagattctcggttccgtatttcggtttgataaacaccagtggctcaggcctggctggtcagcccaaataattcgcgggccgttaactcatcacgtgcgatttgcgccttcagctcgtccagcgacgcaaaccgctgctcgttacgtatctttttacgcagtattacattgatatggcgaccgtagaggtccattacaacgtccaacagatgtacttcgagctgctgacgcacgcccgcaaccgttggacgggtgccaatattggcgacgcccgctatcggtttgtcgcccagccctgtcacttctaccgcatagacccctttaaccggggaaacctgacgacgcagcggtaagttcgccgtcggaaaacctatggttcggcctagttcatcaccatgcacgacgcgtccggagatgctaaacggatggccgagcagcgtctccgccagcaggagatcgtcatcggccagcgcctggcgtaccgccgtgctgctgattcgcaccccgccttcgcagaaggtctgggtgctggtgacgtcgaagccatattccgcccccgctttttgtaataacaagaaatccccctggcgaccagcgccaaagcggaaatcgtcaccaacggcgaggaactgcacgcccaggcgacgcaccagcagttcactgataaaatcctgcgcggttagcgcggcgaaccggcggtcaaagcgaacgcacaatacatagtcaaccccgctttcagccagatagcccagcttttcacgcaggcgggtcaatcgcgccggggctttatcagcggcaaagagctccagcggctggggttcaaaaatcatcaccacgaccggtaaaccgcgctggcggccctcttcgcgcaaccgctgcagcagcgcctgatgcccacgatgcacgccgtcgaaattaccaatggtcagcacgcacccgtgcggggcctgactgagattatgtatgccgcgtatcagcttcatgtctggctcaaaacagtgaaaatcgtccgagtataccttgtacaactgtcaacgttaaccagcgattgcacctcggcaacgaaagttctcaggaattcattcactcagcgcgagaaagcgtgaaaactggccgcgcccggcgatttttatggtggaaaagctgtattcgcctgcaacaagctggtagaatcttgcgccatcactacgtaatgaagcgctgtggtgttaaacggcgcttatttgcacaaatccattgacaaaagaaggctaaacgggcatattcctcggcctttgaattgtccatatagaacacatttgggagttggaccttggctaatatcaaatcagctaagaagcgcgccgttcagtctgaaaaggctcgcaagcacaacgcaagccgtcgctctatgatgcgtactttcatcaagaaagtatacgcagctatcgaagctggcgacaaagctgctgcacagaaagcatttaacgaaatgcaaccgatcgtggaccgtcaggctgctaaaggtctgatccacaaaaacaaagctgcgcgtcataaagcaaacctgactgcacagatcaacaaactggcttaatcgcctgcttgctgaactttgttaaagaaacccgcgaaagcgggtttttttatgcctaccatcttcccccggtagcgcacgctggcgcgatctgagccacgccagcccacgccttccggctatcggggttcggtgaacagcgacgaataatcgcgattacagatacgctgtaccgccgggtgctgaatcattctttcagcgaaaatagcgtgatactcctccatcacgctatccatacggccaatttcgacaatcgattcatcatggtagaaatcatgcgcgtagagcgtcggcgcgacaaatatcgcattatgtgcggcgccgaaggctttcatgagcgccgcgtcgtcaaactcgccgaggatctccaccttcaggccctgcacgttaatccagttcaacagcttacgtcccagcatcgatcgccggccggggatcagcagccgccgctcttcgaggcaggccgggaacggcttcgtcggcgccggattcatgcaccagaagctgacgctgcactcgccgatcttcaccgaaaatagcccttcctgctgcgtcgagtcgatcgggcagtcagagataatcatgtcgagcttatgctggctcagctgctccagcagcagctcatgagtggattcaaaacagcgcagatgaatctgctcgctctcaacgacggcggcatccagcacgccgctgaccagccgtttcgagagcgcatcggccacgccgacgtcaaacagcaggttcgactctttgcgatagttgacgatgtcgagcatctcctggctgagggtaaacatccggtcggcatagcgaaaaaccagctcccccagctcgctcggctcaagccccctcccctttcgcttaaataatttcccctgcaggcgctcctccagggctttgatctgcccggtaatggtctgcggcgtcagaaacagcgcctccgccgcgcccacgacggacccttctttatacacgtgccagaagtagtacagatgattgtagttaatatgtgacatgcttctctccctgataatgtccaggagagcctgacgggctctcctgcagaaaggttataccgcgaggcgagtatccgtcacgcgctgacgcagtatgaggtagccgacgaccgctgatagcactgagccgatcagaatgccaagcttggcccagttgatcaacgcgggatccacgctgccaaaggccagggtggcgatgaaaatcgacatcgtaaagccaatcccgcacaggatccccaccgccataatttgcttgcaggtggttccctccggcagcgaagcccacttcagcttcagggccagccagcagaacaggctaatccccagcggcttaccgataaacaggccagccataatgcccagcggcaggagcgacgtcagcccggcaagggtgaccccctgcagtgagacccccgcgttcgcgaaggcaaacagcggcaggatcataaacgccacccacgggtgcaggacatgctcaagcgctttggccggcgacttgccatgcttttcttcgagcgggatcataaagccgacaatcaccccggcaagggtcgcgtgaacgccagacttcagcaccgccgtccacagcaccgcgccaaccagaatatagatcccggtacgccgcacgccgctcagattcagggccaccagcaccgcgatcgccgccgccgccacgcccagcgagagcatggacaggtcgtgggtataaaacagcgcgataatcacgatagccccgaggtcatcaataatcgccagcgccatcaggaaaatcttcagcgccgtcgggacccggctacctaacagcgccagcacgccgagggcaaaggcaatatccgtcgccgccgggatcgcccatccctctctggcgacaggatcctgggcgttaaaagccaggtagaccagcgccgggacgatcatcccgcccagcgcggctatcaccgggaagaccgcctgacggcggctcgccagcgacccctgaatcagctcacgcttgacctccaggccaatcagcaaaaagaacaccgccatcagggcatcattgatccataacagcatgttcttgttgatctccagcgtgcccacacgcagctgtactggcgtctcaaggaaggagtgatacagaccgctggtcacgctggtattggccatcaccatcgccagcgcggcggcgataattaagacaatgccgccggaagcatcgctactaaagaatcgttgcagatgtttcacttttactttcatcctgttggtgaataactcgataaaagcataatacacacactgataactcgaaaaaatcagatttaagttgcgctaatattcgctttttacgagttaaaggggagttctaaggcgaaaaaaagcccgggcagcaaaggcccgggccggatatcaacaaaggcggaattagcgggtcaggtcgtcgaagaacttcttcacgccgtcaaagaagcttttcgaacgcgggctgttgttttccccggtcggaccgccgaagctctcctgcaactctttcagcagctgcttctgcttctcattcagccccaccggcgtctccaccaccacgcggcacagcagatcgccctgcgcgccgccgcgaacggatttcacgccttttccacgcatgcggaacagcttgccggtctgggtttcacctggaattttcaggttcacgcggccgtcgagcgttgggacctcgatctcaccgcccagcgccgccatggtgaagttgatcggaacttcgcagtacaggttattgccttcacgctcaaagatagcgtgctgcttcacctgaacctgaacgtacagatcgcctgccggcgcgccatgttcgccggcctcgccttcgcccgccagacggatccggtcaccggtatccacgcccgccggaattttaaccgacagggttttgatcttttctacgcggccatggccatgacatttattgcacggatctttaatcagcgtaccgcgtccctggcagtgcggacaggtctgctgtaccgcaaaaaagccctggcgcatctgcacctggcctgcgccatgacaggtcggacaggtctgcggtttgctgccggccttggcgccgctgccgtggcagacgtcgcactcttccagcgtcggaatacggatctctttagtgacgccgcgcaccgcttcttccagcgtcagctccatgttgtaacggagatcggcgccgcgtgccgcgcgctgacgaccacgtccgccgccaaagatatcgccgaaaacatcgccaaagatatcgctgaagtcggcaccgccgccaaaaccgccgccgccgcccatgccgccctgttcgaaggccgcgtggccgtactgatcgtaggccgcacgcttctgggcatcagtcaggatttcatacgcttctttgatttctttaaatttggcttcagcctctttatcaccctggttgcggtccgggtgatatttcatggccaggcgcttataagcctttttgatttcacgctcttccgctgttttggaaacgcctaaaatctcgtagtaatcttgctttgccatcggtgtttttcagccccttaacatgcgtgcacgggcggagaggaaacctcttcgcccgtgccagtgttttacccgttcaaagggcgattattttttatctttcacttcttcgaactcagcgtcgacaacatcgtcgtctttcgcgttgctcgcctgagcgtcagcggaacccgcctgctgctgagcgtgctgctgctgagcaatttccatcagcttctgagaagcctgcgccagcgcctgcattttcgcttcgatatccgctttgtcttcgcctttcagagaagattccagcgcggtcagcgcagactcaatggcagttttgtcgtcagccggcagtttatcgcctgcttcttcaacctgcttacgagtgctgtgcagcagatggtcgccctggttgcgggtctggaccagctcttcgaacttacggtcagattcggcgttagcttctgcttcgcgaaccattttctgaatttcttcttcattcagaccggaagacgctttgatggtgatcttctgctctttaccgctgtttttgtctttcgcggagacgtgcaggataccgtcagcatcgatgtcgaaggtcacttcgatctgcggcatgccgcgcggcgccgggttaataccatccaggttgaactgacccagagatttgttatcagacgcgcgtttacgctcaccctgcagcacatggatggttaccgcagactggttgtcttcagcggtagagaacacctggctgtgcttggtcgggatggtggtgtttttgctgataagcgcagtcatcacgccgcccatggtttcgatacccagcgacagcggggttacgtcgagcagcagaacgtctttcacatcgccagtcagtacaccgccctgaacggcagcaccgatcgccacggcttcatccgggttaacgtctttacgcggttctttaccaaagaactcggccactttcttctgcaccatcggcatacgagtctgaccaccaacgaggatcacgtcgttgatatcggaaacggacagaccggcatcctgcagagcgactttcagcggctcgatggaacggttaaccaggtcttctaccaggctttccagtttcgcgcgagtcactttgatgttcatgtgtttcggaccggtcgcgtctgcagtgatgtacggcaggttaacgtcggtctgctgagcagaagacagttcaatcttcgctttctcagcggcttctttcaggcgctgcatggccagcgggtcgttgcgcaggtcaatgccctgatctttcttgaactcatcaacgaggtagttgatcagacgagtatcgaagtcttcgccgcccaggtgggtatcaccgttggtcgccagaacttcaaaggttttttcgccatcaacttcgtcgatttcgataatcgagatatcgaaagtaccaccaccgaggtcgtaaaccgcgatagtacggttgcccacttctttatccagaccgtaagccagcgcggccgcggttggttcgttgatgatacgtttgacttccagaccggcgatacggccggcatctttggttgcctgacgctgcgcatcgttgaagtaagccggtacggtgataaccgcttcagttaccggttcacccaggtaatcttcagccgttttcttcattttcttcagcacttcagcagagatctgcggcggtgcagttttggtgcctttcacatccagccatgcgtcgccattgtctgcggcaacaattttgtatggcatgatagaaacgtcacgctgaacttcttcgtcctggaagcggcggccaatcaggcgtttaatcgcaaacagggtgttttgcgggtttgtcactgcctgacgtttagccggctgaccaaccagagtttcaccatcctgggtataggcaatgatagaaggcgtggtgcgatcgccttcggcgttctccagcacgcgtgcagtagtgccatccataatcgctacacaagagttggtagtacccaggtcgataccaataattttacccatctaaacgtctccactaaaaattcgatcaacatgtggttgtgaacctgtaataagggcgaaacgtgcggtttcaactgcccagacatcattttttttcaggttcttcactgcggttgactacaagatggggtcgcccactccggcatcaaggggcaagcataaaaattttttgcctcggattcgcacagggttacggatgacttgccgaacaaggttgttggatggcaaaaacgacggcgaaatatacatacaaaaaacggattaaaataggaaatacattcataatatcattgacataacccgcaatacttgcgcgctaaaagccccgttttcgcagtgataaactcccccgccatcgcacttcgcttattcaggggacaaattaatgaaatcgctataccggctttccgtagggcttatcctcggcgtgtcatttatcacctcggcggccgctaacgaccataaaattctcggcgtgatagctatgccgcgcaatgaaaccaacgacctgacgctgacgcttcccgtctgccgggtggtcaaacgcattcagctcagcgccgaccgcggcgatgtacaactctccggggcgacggtctactttaagaccagccgcggcgccagccacacgctgaacgtccccgccgggatcaaagagggcagcaccaccggctggatcaaaatcaatagcgataacgacaacaaacgttgcgtgaagaagatcgccttctccggccacacggtgcactcctcagatatggcatcactgaaaattatcggcgatgactaatgtcgcccctgcccgagagaaaacgttatgcatattaattacctggaggatgacgatctcgcctttctgcctgagtgcagcgaggcgcatctggaagcctttacccgcattctgacccacggggaaaatggcaaaccccgtctctccagcacgctcctgcgcaacgagacatttttagcgatggagggtcacccggagcgttatcgccgcaactggcagctaatcgccggtgagctacagcattttggcggcgatagcatcgccaacacgctgcgccgccatggcaaattttatcgcgcgatcctgctggatgtatgtaaacgactgaaagcgaaggtcgacaaacagctgtcgacgccgcagatcgagcagcagttgctggcgcattttctgcagcacagctggaataaactgaacgcggagcaaaaagcgcactttctcgccgcggtggagtgccggagccatgagctggacagcctgatggctcatctgctgaggcatcgcaagctaagcgaaggcgtcactttgttgctggacgaacgcttaaccgccatcctgcgcacgcacgccgcggtgagcgtcatcggtcatggcctggtgcgcggcgccgggctgggcggaccgctcggcgccgcgctgaacagcgtgaaagcggtgagcggcagcgcctaccgggtcaccatccccgcggtcctgcatattgcctgtttacggcaaatgctccagccgccgtcagacaccgcggaaattggtgaaaaataccccgccagatcatagacagcccatcagcgcctcattattatgccgcgccccgccgccaagtcgcggggtaatgcttcccttttaatgataattttgaggaattatgggcaacactaagttggctaatccggcaccgctgggccttatgggcttcggcatgaccactattctgcttaacctggcgaatagcggcctgttcgcattcgatgtagctatcctggcgatgggcattttttacggcggcattgcgcaaatttttgccggcctgctggaatacaaaaaaggcaacacttttggcttaaccgcttttacctcctacggcagcttctggctgacgctggtggcgattcttctgatgccgaaaatgggcctggcagacgcgccaaacgcgcacttcctcggtatgtacctcggcctgtggggcgtctttaccctgtttatgttctttggcaccctgaaggcagcccgcatgctgcagtttgtcttcctgagcctgaccgtactgttcgcgctgctggcgattggccatttggccgataacgaaggcattgtgaaggtagccggctgggtcggcctggtttgtggcgccagcgctatttacctggcgatgggtgaagtgctgaacgaacagttcggccgcaccgtgctgccgatcggcgaaccgcgctaatcttccgccgccgtccggtcacagggcggcggcaggtcattatcagcatcagctagccatcgttaacgctgcagctccccttccggcatccccgtcggcgccgtcagctcctgacgcagccagatacctaatcccagccccatcagcgacagggccagcacataccaggccggcgccatcggcgacacccccatcagcatggtgaccgcaatcggcgtcaggccgccaaagatcgcgtacgacaggttgtaggagaaagagatgccggtgaagcgtacttccgccgggaaggcccgcaccatcacatagggcaccgcccccaccacgccgacgcaaagccccaccgtaccgtagagcagaaacagccgctgcgggctggcgccggcaagatggtaaaatgcccagctggcaaccgccagcagcaggctgccgacgataaaagtgcggctggcgccgaagcggtccgccgccagcccggcgagcagacagccgatgcacaacataatggtggcgatgctgttggcctgcagggtaatggccggcgcaaaaccatagtgcttctgcagccagaccggcgacatcaggatcaccaccaccacgccagccgacagcagccaggtcagcagcatagagatcaccaccgccttctggtgcttgagcgccaccgcttttaccggcagctcctgcgccagcgctttgcgctgctgcatctcaagaaaaatcggcgtctcctgcagccagcggcgcagatacatcgctatcagaccaaatacgccgcccagcaggaaggggatccgccagccgccgtcgtggatcccctgcggcgtcagactggtattgataagcgtggccaccaccgaccccagcagaatgccaaccgtcaggccggccgtcagcgtgccgcaggcgataccaatgcgtttttccgggacatgctcagcgacaaacacccaggcgcctggaacttcaccgccgatcgccgctccctgcagaatacgcatcagcagcaatagcagcggggcgatgatacctaccgagctataggtcggtagcagaccgatcgccagggttggcagcgccatcagcaggatgctgagggtgaacattttcttgcgccccaccagatcgccaaagtgggccatgatgatgccccccagcggacgcgccaggtaaccggcggcgaaaatgccaaaagtttgcacctggcgcagccattcgggaatatctgcgggaaagaagagctcgccgacgacggcggcgaagaaaacgaaaatgataaagtcataaaactccagcgcgccgcccagggcggccagcgtcagcgttttataatcctggcggttgagcggtcggtttgcatatgacataacgcaatttcatcctgaggtgtgcagcgtgttttatagtgtgtaaagtaaaaatcactatatcgtaaataaaacggcacaccattagcgatgcaggttatatcaaaaatgcatcaaattcaggataaagtttcgcgtctggcactcttgggacgaaaagcttctactatacggccatcggtttccacataaggcccttcaagcaactgtacacaataaggtacacttgcgaaaataccgtgcaccagcacgttgccgtcagcatctttcaccccttccagagtctcctgaattgctttcggttgcccgggaaggttgaggatcagcgcctgcttgcggatcacaccgacctgccgggaaaggatagccgtcggcacaaagtgtaggctaacctggcgcatttgctcgccgaagcccggcatctcgcgatcggcgatcgccagcgttgcgtcgggcgtcacatcgcgacgcgcagggccggttccgccggtggtcagcaccagatggcaccccatttcgtcaaccagttcgcacagcgtttgctcaatgatggcctgctcatccggaatcagacgggtttgcagctcgaaaggggtggtcagggcacgtgccagccactcttccagtgccgggatgcctttgtcctgatagacgccgctggaggcgcgatcggaaatggaaactaagccgattcgtaaggtattcatggttattccgttcaaactgtggcgttaaacgaaatgatacactgccggaggcgggacagacagtgtaatgtggccgacgggcgtcggccacctgcgcgattacagcagttcgtcgatcattttttccagtttttcctggtcgatcgcaaacttacggataccttccgccagtttgtctaccgccatcggatcctggttatgctgccacaggaactcagattcggtaatacgctccggacgcgctttcacttcaccggtatataccagcttacgctcaacggcgccttcgctttcggacagctctttcagcagcgccggggcgatggtcaggcggtcacagccagccagttccagaatttcgccaacgttacggaagcttgcgcccatcacgacggtttcatagccgtgctgcttgtaatactcgtagatttcgctgacggaaaccacgcccggatcttctgccggtgcgtactctttcttgtcggtgttggctttgtaccagtcgaggatacggccaacgaacggcgaaatcaggaagacgcccgcttcggcgcaagcgcgagcctgagcgaaggagaacagcagcgtcaggttacagttaatgccttctttttccagctgttcagcggcgcgaatgccctgccaggtggaggccagtttgatcagaatgcgatcgttgctgatgcccgcgtcgttgtacagcttgatgatgcgcttggctttcgcgatagacgcttcggtgtcataggagagacgtgcgtccacttcggtggagatacggcccgggatcagtttcagaatttcgagaccgatgttcaccgccagcttatcggaagcatcgaggatctgctgcgcgcgatcgctgctctggctacgagcccaggcgacagcgtcgtcaatcagcttacggtactcagggatctgagccgcgccgagaatcagggaagggttagtggtggcatcctgaggctgatacagcttcattgccgcaatatctccggtgtcagcgacgacagtggtgtactgacgcagagaagttaatttatccgtcatgatatatttctcttaaacagcagttaaggggatgtaaccggtctgcccagatgataacacgctgccgggtcagcgcaaccgccgacgagagaagagcgcagagtgtgataaactatgcagattaatttgctgaaagcgaaaggattgtcacttaattggtaacgcttacactggcgtaccggcatggacaagaggatgtttaatgcctgattttctctcatttatcaatgaaatactctggggctcagtgatgatttatctgctactgggcgccggtatctggtttagctggcaaacccggggtattcagtttcgttacgtgcgcaaattcggccgcagtctaaaaaaaagcctgcacccgcagccgggtggtttaacgtcctttcaggcgctctgtaccagccttgccgcccgggtcggcagcggcaatcttgccggggtgacgctggcgatcgacgccggtgggcccggcgccgtattctggatgtgggtttccgccctgctcggcatggccagcagctttgctgaatgttcccttgctcagctgtataaagaacgcgatagccgcggacagtttcgcggtggccctgcctggtacatggcgcgcgggctcggcatgcgttggatgggcgtcctgttttcgatcctcctcctgctggcctatggttttatcttcaataccgtgcaggctaactccgtggcccatgccttgcgctatgcgttcgatctgccggcggcggtcagcggcggcgtgctggccgttgtcgttttgctggcgatcctccgtggtttacgcggcgtggcgcgtctgatgcaatggatcgttccctttatggcgctgttgtggatcgccaccagcctgctcatcggcctgtggcacatcaccgccctgccgacgattttcgccaccatctttcgctgcgccttcggctggcaggaggccgccgccggcgcggtgggctacaccatcagccaggcgctgaccagcggcttccagcgcggcatgttctccaatgaagcagggatgggctcttcgcctaacgccgccgcggccgccgcctcctggccgccgcacccggcggcgcaggggatcgtgcagatgattggcgtgtttatcgatactatcgtgatctgtaccgcaagcgcgattatcgtcatgctggcgccgcggcccgacaatgaatatacgctcaacggtattcaggacttgcaacacgcgatgagcgtgctggtcggcggctggggagcgggttttatcgccctcatcgtgctgctgttcgcctttagctctatcgtagccaattacgtgtacgcggaaaataatctggtcttcctgcgcctggataagccccgctatatctgggggctgcgaatactcaccgtcctgatggtgctgttggggaccatggttagcctgcctgtcgtctggcagagcgcggatatcatcatggcgctgatggcgatgaccaacctgacggccattctgctgctctccccgacggtgcggattatcgccagcgattatctgcgtcagcggcggctgggtatccagccgactttcgatgccactcgttacccggatattgaccaacagctggccccgggcgcctggaatgaattgccgcgcgaatagcgcggcaattgcagctatcgatcccaccatgcactttttttgttaaaattcgtcgaaattacctgcaaggactggatatgctgattctgatttcacctgctaaaacgctcgattatcaaagcccgctggcaacgactcgctatacccagcccgaactcctcgagtattctcagcagcttatcggcatcgcccgtaagctgagcgcaccgcaaatcggcaagctgatgagcattagtgacaagctggcggatctaaacgccacccgcttccacgactggcaccctgactttacgccgcaaaacgcccgccaggcgatcctcgcctttaaaggcgatgtctacactggcctgcaggcagagacgctcaccgaggacgactttgacttcgcccagcagcatctgcgcatgctctccgggctgtatggcgtgctgcgcccgttagacctgatgcagccctaccgcctggagatggggatccgtctggaaaatccgcgcggcaaagatctgtaccagttctggggggataccattaccgagaagctgaatcaggcgctgcgcgaccagggcgacgatatcgtcatcaacctggcttccgatgaatattttaaatcggtgaaaacgccaaaattgcagggtcagctgatcaagccggtattcctcgatgagaagaacggcaaattcaaagtgatcagtttttatgcgaagaaagcccgcggcctgatgagtcgctacattattgaaaaccgcttaacccagccggagcagctcaaagcctttaatagcgaaggctatttctttgatgcggatgcctcagagaaaggcgaactggtgtttaaacgccacgagcagtaacacgttacggtaataaaaaaggggagttattccccttttcaatataattaagcagattattacttattttaacgcacccagttttccaccacgcctttttcatcgaagaaaatcatcagcgagttcgaatctttttggctggacttatcgaccgcatcggcagcttgcgatgccccggttaccgggatcatggaacccgcgaggctgaccaggttgatccctttatctactgaataataccagctctctttacccgacgccgtcaccgtcgtatgaccagaatccggagcaccaaaatactgacgaacctcggccttggtggtttttccgacaatgagatgttgtttcagataggctggcgttaatttatcttcattaccgccaatcgttgtcccggagcagcctgttaaagcgaacaccaccaaaaaaagagataaaatacgcatgtttcctccttgaaaaccttgtgcattaacaatgcatctataacaaatgatatctatagctgcttcataataaaatcagcagcataaatataagcagcatgaaataataaataaaaaagataatccagtggaattatccggcaaagaggacaatccgtaaaagagtttgcaataaaagcagtgcgctgacaataaaatagtgtggggaattttatggagagaaattttactgatatggaaaagtgcgttaaatataaaaaccgggcaatagctgcccggtttggtcgatcatgttgccgatattattgcctggcttagcccatcatcagcttacgcagcgcggcgaaatccgccggcaggttgtgagacagcagcggcaggtcggcgcggtcggccagctccttcggcagcggcagagtctcctgcaggatctcctccacgctctctttgaacttcgccggatgggcggtgccgaggaacaggccgtactctcccggctgcagctgatcgcgcagcgcgcgccaggcaatcgccgcatgcggttcagagatgtagccgatggccttcagctcgcgcatcgctgctttggtggtctcatcatcgaccgcggcatagcccagctcgctgagacgccagattttacggcggaacagctcttcaacgcgcggccagttgttcggctggctgacgtccatggcgttggacagcgtcgcctgggtggcttttggcgcccactcgccgccctgcagatagcgcggaacggtgtcgttggcgttggtggcggcgataaagcgcttgatcggcagccccagcgacttggccagcagaccggcggtcagatcgccgaagttgccgctcggcacggaaatcaccagctgattgcgggcttcctgcggcagctgcgccgccgcttcgaaatagtaacagatctgcgccagcaggcggctgatgttgatggagttagccgagttgagacccagcgtcgccttcagctcttcatcgtcaaacgcctgcttcaccagcgcctggcaggcatcaaagtcgccatcaatcgccacggtttcaatattgccgccgagggtacagaacagcttctcctgcagcggactgatcttgccgcgcggatagaggatcactaccttgacgttcggcaggccgtagaaagcatgcgccaccgccgccccggtgtcgccagaggtcgcggtgaggatggtgaccggcttatcgcctgcgatgtgggtcagcatctgcgccataaagcggccgccgaaatccttgaacgccagcgtagggccatggaacaactccagacagccgacatcttcctgaaccttgcttaccggcgccggaaacgcaaacgccgcgcgcacccgctgctgcaggacatcctgcgggatctcatcgccgataaaggcggatagaattttggcgctacgggtgacaaagtcctgcgccagcatgtcgtcgatttcagtcaggctgaattccggcagatcgtgcggaaagaacaggccctgatgcttgccaagtccctgggtgacggcctgcgcaaagctgacctgctcgttatgatcttttaagttatacagtttcattggttatcccactacgcgtgcgcccgccgtgtccagccggcaaatatgaacaaagccttcctgattctgcagatagtgcgcgccaagccagtcggcgacgcgctgcgcggtatccggtttatcacacaacgcgaacagcgttgggccagagccggagatgccgcaagcctgggcgcccatctccatggccgcctgacgcgcttcgctaaagcccggcagcagtttggttcggtacggttcggcaatcacatctttcatcaattttgccgccagctgcggctggcgggtgtagcaggcgtgaataaagcccgcgaggtggcgaccatgggcgatacaatcctggcggcgatactgcgccggcagaatcgcccgcgcttcagcagtagagactttaatccccggataggccagcacccacagccactcatcaaacccgggcacctgctgactgataatcccattctcttcgatcatcaactgcatgccgccaagatagcacggcgccacgttgtcgtagtgaatgctgccggagatacgcccttccatctctcccatcagcgccagcatgcgcgtctcgttcagcggcttgccgcagaactcgttcatggccaccagcgcagcgaccaccgagcaggcgctggaacccagcccggagccaatcggcatgtttttttccagcgtcatcgccaccggcaccgtcttgccgatctcccggcaaaagctttcccagcactggtaaacaatgttctcctgcggcgccgtcggcagtttgctggcgaagcgtccaagattctgcaggctaaattgctccgccgcttcgacagtgacgttgtcgccaagcagcgtgccatcgaccggcgtgaccgccgcgcccaacacatcaaacccgacgctcatattggcactggaagccggggcatatactttgaccatcttaaactcctaacttccaggacagggtgcgcagcaggtcggcgaatacgccggccgccgtgacgtcgttcccggcgccatagccgcgcagcaccagcggcaatggctgataataatggctataaaaagccagcgcgttctcaccattcttaactttgaacagcggatcgttgccgtcaaccgcggctatttttacccggcaggtaccatcctcttcgatgttaccgacgtagcgcaagactttaccttcatcgcgcgccttagcaacccgcgaggcaaaaccatcatccagcgacggcaggcgggccataaaggtctcgacatcgccgctggcgtcgaagtccggcggcagcgccgactcgacgataatgtccgccagctccagttcacgcccggtctcgcgggccagaatcagcagtttacgcgccacatccaccccggataaatcgtcgcgcggatccggctcggtataccccatctcacgggccatcgccgtcgccgcggagaaactcaccccctcgtccagcttgccgaagataaacgacagggagccggacaggatcccggagaaatggcgcagctcatcgccggcgttgagcaggttctgcaggttctcaatcaccggcaggcccgcgccaacgttagtgtcatagaggaacttacgccgcgagctgctggccgcatggcgcagctggtgatagtaatccagcgaagaggtattggcctttttgttcggcgtcacaacatggaaaccttcgcgcaggaagtcggcatactgatcggcgaccgcctggctggaggtacagtcgacgatcaccggattgagcaggtggtactctttcaccaggcggatcaggcggccaagattaaacggctctttcgcctccgccagttccgcactccagttttccagattcaggccatgcacgctggtcagcagcgcctgagaattggctacaccgcagacgcgcagatcgatatgtttgttcttcagccacccctgctggcgcttgatctgctctagcagcgcgccgccgacgccgccgacgccgatgacaaacacttcaatcacctggtcggtgttgaacagcatctgatgggtcacgcgcacgccggtggtggcgtcgtcattgctgaccactaccgaaattgagcgctcggaagagccctgggcaatcgccacgatattgatattggcgcgggccagtgccgcaaagaatttcgccgagataccgcgcagggtacgcattccgtcgcccaccacggagatgatcgccagacgctccataatcgccagcggctccagcagcccctctttcagctccagataaaactcatcttccatcgcccgtttggcacgtgcgcagtcgctctgcggcacgcagaaactgatgctgtactccgaagaagattgagtgatcaacaccaccgagatgccagcgcgggacatggtggcgaagacgcgggccgccatgccgaccatccctttcatccccggcccggagacgttgaacatcgccatgttgttgaggttagagatgcctttcaccggcaaatcgtcctcgtcgcggctggcgccgataagcgttcccggcgcctgtgggttgccggtatttttaatcaggcatgggatttggaactgggcgataggggcgatggtgcgcgggtgcagcactttcgcgccaaagtaggagagctccatcgcctcctgataagacatcgatttcagcaggcgcgcatccggcacctgacgcggatcgcaggtgtacactccgtcgacatcggtccagatttcgcagcagtcagcgcgcaggcaggcggccagtaccgcagccgagtagtcggagccgttacgccccagcaccaccagctcgcctttctcattgccggcggtaaacccggccatcaggatcatatggtctgccgggatctggctggcggcaatgcggcgggtggattcggcgatatcgacggtggattccagatagtggcccacggcgagcagtttttcgaccgggttaatgacactgactttatgtccacgggcttccagcagacccgccatgatggcgatggagagcttttcgccgcggcagatcagcgcggcattgacgctgtccgggcactgacccagcaggctgatgccgtgcagaacatgcttaatctgagcaaattcctgctccatgaaggcttttaactgggcaagcgggaaagcgggctgggcgtcggcaaggccctgaagaagttcggcaaaaatgcgttcggcgtcggcaatattggggagggcatcctggccgccaatggtcttttcaatcatcgctaccaggtggttagtgatcttcgccggggcagacaggaccgtcgctacctgcccctgcctggcattactctccagaatatcggcaacccgcagaaaccgttccgcatttgccactgatgtaccgccgaacttcaacactcgcatggttcttaccccttgatctcttgtcaaaaaaaaagcccgcactgttcaggtgcgggcttttttctgtgtttcctgtacgcgtcagcccgcaccgttacctgtggtaatggtggtggtgataatggtggtaatcatgccgatgcgattcatggatgttgtgtactctgtatttttatctgtctgtatgtcctgcctatattggttaaagtatctgccgtcttaagtcaatgaatttctcaatttgccccatttcagcaggcttacgtattttcccgctgccgtgagaaaaaacatccagatcggcggaaaaccagcccatagaacagcatacacatccataaataaaaaatatgacagagttttattctggcaggtttttttcaatatcatgcagcaaacgatgcaacattgccgtgtcgcgctgctgcagcaggcccagccgttgcgacaaccagtcggccagtttggcatcatcctccacgcccaaacgcgaaagtaacgccagggtacgagtacgtaaggcctgcagctgatgatggtctgccgcagcggcggcgggcgccgtttgttgcattagcgatgctaattgataacagtagaccatcaccgactggccgagattcagcgacggataatccgcagccatcggcacaccggtcaacacatcagccaacgccagctcctcattggtcaatccggcgtcctcacgaccaaataccagggcagtatggttcatccactgcgccttctcctccagcagcggcaacagctgctgcggcgtggcgtaatagtgaaaacgcgcgcggctgcgggcggtggtggcgacggtaaaatcaacgtcatgcagcgcctcggcaagggtgggataggtggtgataccatcgaggatgtcgcctgagccatgcgccacccagcgtgccggaggcgccaggtgggcttcgctatcgacgatccgtagttcgcgaaatcccatggttttcatcgccctggcggcagcgccgacgttctcggcccgggcaggaccgactaaaataatcgttaaacgcattgcggtttctttctctctctcaggcgttatcgaggcgcagcgccccccattttacgcggtgaaaatttacaaatttgcaacaaaaatcactaaaattgcgttttcttacccataaaaaaatctaaactgttctcaggaggccgtgacaaggagtatgttaacagaacccatttatccatatgatgggcaatgcaatttcatctgatgcatcgtttcaggctttggattcactgtatttattaatttatccacgcaactagttgagccgggtaaagattgtgactataaagagcatggcgatgcaatgatttcacaagactgttaacgtgctacaattgaacttgatatatgtcaacgaagcgtagttttattgggtgttcggcctctcttagcctgttatgttgctgttaaaatggttaggatgtcagccgtttttgacaccgtcgggtccagagggaaagtacccacgaccaagctaatgatgttgttgacgttgatggaaagtgcatcaagaacgcaattacgtactttagtcatgttacgccgcgcatgttaatttgcgacatgcagcaggcaggtcagggactttggtacttcctgtttcgatttagttggcaatttaggtagcaaacatgcagaccccgcacattcttatcgttgaagacgagttggtaacacgcaacacgttaaaaagtattttcgaagcagaaggttacgatgtattcgaagcgaccgatggcgcggaaatgcatcagatcctgtctgaaaatgatatcaacctggtgatcatggatatcaacctgccgggtaaaaatggtcttctgctggcgcgcgagctgcgcgagcaggctgacgtcgcgctgatgttcttaaccggccgcgacaacgaagtggataagatccttggcctcgaaatcggcgctgacgactatatcactaaaccgtttaacccgcgtgaactgactatccgcgcgcgcaacctgctctcccgtaccatgaacctcggtaccgtgagcgaagagcgtcgcagcgtggaaagctacaagttcaacggctgggaactcgatatcaacagccgttccctggttagcccgaacggcgaacagtacaagctgccgcgcagtgaattccgcgcgatgctgcacttctgcgaaaacccaggcaaaattcagtctcgtgccgagctgctgaaaaaaatgaccggtcgcgagctgaagccgcatgaccgtaccgttgacgtgaccattcgtcggattcgtaaacacttcgaatccactccggataccccggaaatcatcgctaccattcacggtgaaggctaccgtttctgtggcgatctgcaggaataatacgatttattccgcagccatgatgcgaaaacggcgccccaggggcgccgttttttatgccgtcactctttccagagacgcagcttatcgtcatcggcagccggtgtcggaggcactgtgcctttcggcagcgataacgcataccagtccacgcgacgggtcaaaaacatcaggacgctcagcgccagcgccagcaccccggtacccagcagcagcgcgctatcctcagaatgcaacagaaaccacatcacgccatccagcagcagtagcgcggcgacaaacagcaggctgttacgccatcctctgagcactgcctgaaggtagatcccattcatcaccgcgccagacaggctggccgccagccaggcggcggtaaaaccaatgtgctctgagagcgccagcagcaccaggtaaaacagcaccagcgataagcccaccagcagatattgcatcggatgcaggggacgacaggtcaggctctcgaacacgaaaaaagccataaaggtcagcccgattaacaggatggcatattttgtcgcccgatcggttagctggtactggtcggcaagggacatcacatcggcactgaacgccggcagtcgcgaccacgggatctccatatcatccttgaaatagctccccatatcgttggcgaaccagctgctttgccagtgggcgcgatagccggcagcactcacttcccgttgcgttggcaggaagctgccgagaaaaccgggatgcggccagttactggtcagctgcagctcgctgttacgcccgagcggcaccagtgaaaactctcccgtcccgttcagatcgagtgaaaaggcaatctcaagcggcttgttgtcctccgccagcgcaggcattggcatatgaatacctgcgccatcgccgcttatccccagccccggctccacgcttaatacgttaccgttgacctccggggcatggatggcgccaatgccgcgggcatcgccgacgctcaccaccagccgcggctggcctaagacgatattcgtttttctcagcgccgccagacgcagcggatcaaacgaggccttaatctgcaaggcgttatgccagacctggccgctgtagataccccccctcctcgactccacggtctgtttgccggcgaccgccagcgactccggcagccagtaatacacccagctccgctgatagttgacctctttttggttctccatgcgggtcagggtctcggttatcggaatagcgatcagcggtccggcgagtttttgcgagccgctggtgctttgctcaatggcgtccaccacttcgctacgataatccgctcgctcattaataagctccctgaccatcattaacggcaaagatagcagcacaatacagcctattaacgtggtgattttccagaataacggtgatttcaacatagcctttctccctatcgtgatggcctcacaataggacggctgtgtggggagaatttgaagctatgtgaagggacggtgaagtcgcagcgtggcgaccacgccgccttcgggccgattgtgcagattgatatcgccgtgatgcaggcgcgcgacttcacgaacgaacgccagcccaaggccgctgctcttatggccgtcttcgcgcggcagcgaatagaatcgctcaaagattcgttccagggcatagtccggaataccgcacccgttgtcgataacgctcaattgcacctcttcatttcgcttctccgcagccagggcgatctcaccgccctggggggtaaagtcaatcgcgttgtcgagcagattacccagcgcctgggccagcagctcgccatcgccattgaccagcatcccactctcccgccagcgcagggtgatagctttcgccgccagagcgatgttgcgctcctccgtcagccgttggtatagcgcatctatcgacaccggctgctgctttatctccagccggctttccagtctcgcctgctggagcagccgctccaccagcagttgcatccgggtgttttgcgcgaggatattatcagtaaaccgcgccgccacctcaggcggcggcccttcgcgcaggatctccgccgcgccgcggatggccgccagcgggcttttcagttcatgggtcaggtcatagacatagttttcgatggcattcttaccttcgagctttacccgcatgctctccagagcctgggccagcttgcgcaattcgctgctgccaacctccggcagcggcagcgggcgctcagcggtcaccgagtccgcatagcgcaccagcttgccgatagagaaattgatccaccagacgacgccgccgccaatcaacagcgcaatgcccagcagggcgccgccggcccagaggatccgccgctcgctgcgcttaatgaccggcgtcatcgccaggttgggtttaccgacgctcagcacgccgataatccgccccttatccatcaccggcgcggcgatatacatcaccgagctggcttcatcatgcggatcgctgcgcgtactgcgcgcgccgtactggccgcgcagggtgagccagacatcgttccagcgcgaatagtcctgccctgtcgcctgcccgctggagtcaaacaccaccttgccccgggcatcggtcagatagacgcggtactcattacgtacctttttaattccgccaatattggcgttgagcggctgctggttgagctggtgaaaggcctgcgccagcctgccctgctgcgggtttgccgccagcagatcctcacgcgccagcgccgccaacagggtagcggtatcattgagggtcccctctgtcgcccggcgcacgcccggcttcacttcctggacaaagatcgacagcacaaaccacgcggcgatcgcgacgataagaaaatagcccagcagcaggcgcatgccgatgcgcatcagccgcgccccaggctgtagcccataccgcgatgggtattgattggcgccttttcaggattcacagcccgcagcttagcgcgcagggttttgatatgggtatcgacggtacggtcgaggctttcccaggcatcgctccacaccagctccatcagctgctgacgggagaagacgcgaccgggcgcgtgaagcagggttttcaacagcagaaattcgtagcgcgtcagattcagcggctggccgaaccagctgatcgccgccgcctgctcatcgagcacaaactcgccgacgcgtaccaccggcgatggcgcggcaaacttctgcagccgccgcagcacggttcgcacccgcgcgcagacttcgcgtggtgaaaacggcttggcgatataatcgtcagcgccgatttccagccccagcagcttatcgacctcgtcgctacgcgccgtcaaaaacagcaccggcagcgccggataacgcgtcagcagacgccgacagagctcgaagccgctgatatccggcaagccgacgtcgaggatggcgacatctggcgcctgatgcgccgccgcctccagcgcgggcaaaccgcggccaaagacgctgacctggaagccctcctgctgcagcatgtaaaccagggtatcagcgatactctgttcatcctcaactaaccaaatccgtggctgctgcatgcgcgctcccgtttatttattccatggcatgatcggcacggcgctgatggcgttcttcggcgagccatcaaccactttatccgagtaggtcagatagaccagcgcattgcgcttcgcatcatagaaacgcacgacctgcagttttttaaacaccagcgaggtgcgcttctggaacaccacgtcgccctggcttttgccgtttttgattttgtccgttagctcaatcggcccgacctgctggcaggaaatcgccgcgtcagaggtatcttccgccagccccagcccgcctttgataccaccggtttttgcccggctgatatagcaggtcacgttctgtacatccggatcgtcaaaggcttcgacgacgattttgtgatccggccctaaccatttgaagaccgtatccacggaaccaatctgctccgcctgagccagctggctaccggccagcaggagcagccccatcgcaaacttcttgtatttcatattgttaccattattaaaaaatatagctgagtgattatcacgcacttagcagaaaaggtttatagatcacagctttacaaaattatcgttcaaatcccctgacctaccgcatttaaaagcaaaaaaaacactgaatgctaaaacatcaaaaaatgctattatccgctactttaatatcaggcacctgtgtttaaggatggggacattttatggatcaagcagggattattcgcgatctccttagctggctggaaggtcacctggatcagccgctttctctggataatgtggcggcgaaggcaggttattccaagtggcatttgcagcgaatgtttaaggatgtcaccggccatgccatcggtgcctatattcgcgcgcgccgcttgtcgaaatctgctgtcgcattacgcctgaccgcccgtccaatccttgatattgcgctgcagtaccgtttcgactcccagcagaccttcacccgagcgtttaagaaacaattctcgctgacgccggcgctctaccgccgctcgccggactggagctcgttcggtatgcgcccgccgctgcgtcttggcgaatttaccctgccgaaacatgagtttatcactctgccccctactcagctgcttggcgtgacccagagctatacctgtaagctcgaggaaatctccgattttcgtaaccagatgcgggtccagttctggcgagacttcctcggcaactcaccgtcaatccccccggtgctctacgggctgcatgagccgcgtccgagcctggaaaaagacgatgagcaggaagtattctataccaccgcgctgacgccggagatggctaacggccacctgcagcatgcccatccagtgaccctggagggcggcgagtatgtcatgtttacgtatgaagggctgggtaccggtctgcaggaattcatcctgaccgtctacggcacctgcatgccgatgctgaacctgacgcgtcgcaaggggctggatattgaacgcttctaccctgaagatgaaagccgggatcaggccacgccgattcagttgcgctgcgagtatctgatcccgatccgccgttaacgctgcagctcgtccattgcgggggcgtcaagatgcgagacgtcgcccgccgtttccaccacccagccggaagccagccacgggctttgctgatagtcgacgcgcgaaatagagcagttgcgcagccgcagacgacgctcagcgtacgccggcagccctaatatcgtgctcaccaggcagcccagcgcgatcccatgactcaccagcagcggccggctaccggcgggtaattccagacaggatgccagcgccgcatgcatacgctcgctgagctcctgcatcgattcgccctgcggaatacgaccgtccggtgtgccgttgaccagctggcgacgccagccttcttcttcttcgctgagcgagtcgatatggcgcttctccagcacccccatatccagttcgcgcaggcgcgcatcggcgatcacgctgcagccgcaggcttcggcgataatttctgctgtgcggcgggttcgccccagatcgctggtaatgatatgggtgatccccagcgttctggcgcgctcgcccacctgccaggcctggcgctcaccatgggcggtcagcgggctgtcggactgaccctgaatacgtcgctcggcgttccactgcgtttcaccgtggcgaacaaggtatacttgtaacatgctttttttccgttctggactcgttatcaaccgctttcgggcattaccgcctgccctcggggtgatttagagtatactgcgatgacgttagtttattctgagttgttttgattatgcaccatgttgtctcagcgaccactaatcccgccaaaattcaggcaattctgcaggcttttgacgagattttcggcgaaggatcctgccacattgagtccgtcgccgtcgagagcggcgtgccggaacagcccttcggcagcgaggaaacgcgcgctggcgcacgaaatcgcgtcgccaatgcgcgccttgcccagccaaatgccgatttctgggtagccatcgaagccggtatcgacgatgacagcacctttagctgggtggtcatcgaaagcgccggccagcgcggagaagcgcgctcagccacgctgccgttgcctgacgttattcttgagcaggttcgcgctggcgaagccctcggcccggtcatgtcgcagtataccggcatcgatcagatcggtcgtaaagagggggcgattggggttttcaccggcggcagattaacccgcagcagcgtttaccaccaggcggtcgtgctggcgctaagcccgttccataacgctatttatcgctagccagcagcgtctgctccagccactggcgcagctctaccggcgccgatttcaggctgttggacccgcgggtaatggtcgcaattccggcgccgagctcatttttcagctcacgctggctcatctcgccgcgcagcaactcttcgataatgcgcacccgggtacccagggcttcgcgctcgtcgggcgtcagcatcagctgcagcaacggcagatgcagatcctcagcataggcctgctgaagcagggcaacaaagcgcagccactcctgatgacgttgttcggcaacggccgcggaatagggagattgttgggtcatatcgcgccaccatattgagacgggcagcttacgctgcccgtcgaatgtactcttcaacgagtacaaagcataacatacttcccggcgatcagtaacgctggcgccactccgcatcgctgaggatcttatcctgctgccccataaagtagcggtagtaggcgtcataggagaggacattcttcacgtagccgcgggtttccgaaaacggaatactctcgacaaacgccacggcgtcgatccgtccggcgctgttcccctgccagctgcgtacccggcccggcccggcgttataggccgctgaggcgtagatacggttattgccgaactgctgataaacgtactgcagatagctggtgccgatgttgatgttggtttccggatccaacagctgcgacgggccgctgtagccgggaatgctgaacatactgacggtatgcgtcgcggtgcccggcataatctgcatcagtccgctggcgccgaccggcgagcgcactttcgggttccaggcgctctcctgacgggcaatcgccatcgcgtagctctgcggaatatctttgccgctaacatagcgggcaaacaggtcgttataggccagcgggaaacgttcttccagctgatcccacagcttaccggcgatcgtcgcctgcacgctcagatcccaccagtgctgatcgaaggcatagcgcgccagctgcgcctgctgggatttggtgcgactagtgaccaggttggcccattcggtgcgcgcggtgttatccatattccagtacatcagctcacgtacccgcgccatctccggcccggaggccagcgccggatcgatggtgcccgaggctttatcgatgcggaaggtatactcctcgccaagacgctgcgcggcgaccatcgggtagaagcctcgctgttgcatcaacgagcgaaggatcgcctgcgcctcctcatccctgccgcgctccagcagcagatccgcctgccagtagcgccattcgtctttctctttcgcctccatcggcaggcgcgccagccaggtgttgaggccatggcgatcgcccgtccccaacgccatccgtacccgccgctccaccagcggcgtggactgcgaacgcatgattgcgtcatcgcgccagatggcctgctcttcggttacatcgctacccatcaggcgccaggcgacaatatcgcgcagttcctgggtctgatcctcattgagctgctgagcctgtaccagcgaagggatcatcaggcgggcattttccacgtcctggcgggcgacgctggcgaaggcgacggcggccatctgacgggtaaagtccgtcgccccggtggtgcgggcgaaggtgaggacgctgtttggatcgttagccagggcgaccacggcgctggcgatgctctggtagttggcgggcatttgctgggccagcgatttcaccagcccgatattgccggccttcatcgccaggcggatccgttcgagataggccagcggatcctgctgaccggagtcgcgccaggcgctgaacagcggttcacaggcgccgggctgattcttgcccgtcagccacagctctttcgccccgctccaggcctcctgcgactgccccacgctcagcttggcgtagtaatagttgcactgcgcctcggtgctggtcggcttatccgggctaaacgccagcaagccgcgccagtcgctgcgccgggccagttcattcacgaagcgcgaacgtaatgaacgcgcagggggcagcgtcggattggcgtcaataaagtttttcaccaccagcgccggctggttcatcagatcgtcggtgatctgtcggtactgcaaatagggatacaggggataggtgcttaacgtgggcatcagctggtcgactacatccatctgccggttatcccacgcctgcttaatttgtgcgtagcggctgcgctgttcatccagtgaatccgcatgcgccagctgactcaacgtcaacaaaccaacgctggcagccaaaagatgccacgccatttttttggctttttccacaagctcttcctctttccggtgcattttcgcagcatcgtgccgcttaaaaacccctgccggttcggcaggcggctttacttatgctaatcagacaacgctaaacgcgccatgtcctggacatttttttacgcttctgtgaatcctgtcgcctcgctgggattagcgcgcgaaaaaggctacacttcggctttgaactatctatcaaaatagaaagaggcgaagtccaacgtggctcaattcgtttataccatgcatcgtgtcggcaaagtggttccgccgaaacgtcatattttgaaaaatatctccctcagctttttccctggcgcgaaaatcggtgtgctcggtctgaacggcgccggtaaatctaccctgctgcgcatcatggccggtatcgacaccgagatcgaaggtgaagcgcgtccgcagcccggcatcaaaatcggctacctgccgcaggagccgcagctcaacccggaacacaccgtgcgcgagtccgtggaagaagcggtcgccgaagtggttaacgcgctgaaggggctggacgaagtctatgccaaatacgccgagccggatgcggacttcgataagcttgccgcacagcaaggcaagttcgaagagattatccaggcgcacgacggccacaacctgaacgtccagctggagcgcgcggccgacgccctgcgcctgccggactgggatgcgaaaatcgctaatctttccggtggtgaacgccgccgcgtcgcgctgtgccgtctgctgctggaaaaaccggatatgctgctgctcgacgaaccgaccaaccacctcgacgccgagtccgtcgcctggctggaacgcttcctgcacgacttcgaaggcaccgtggtggcgattacccacgaccgttacttccttgataacgtcgccggctggatcctcgagcttgaccgcggcgaaggtattccgtgggaaggcaactactcctcctggctggagcagaaagaccagcgtctggcgcaggaagcttctcaggaagccgcacgccgcaaatctatcgagaaagaactcgagtgggttcgccagggcgcgaaaggccgtcagtctaagggcaaagcccgcctggcgcgctttgaagagcttaacaacgttgaatatcagaaacgtaacgagactaacgaactgttcattccgccaggcccgcgtctgggcgataaagttctggaagtcagccatctgcgcaaatcctacggcgaccgcgttctgattgacgatctgagcttctcggtaccgaaaggcgctatcgtcggcatcatcggtccgaacggcgcgggtaaatccaccctcttccgcatgatgtccggccaggaacagcctgattccggcaccatcaccctgggtgaaaccgttaagctggcttccgtcgatcagttccgcgacgcgatggacaacagtaagaccgtgtgggaagaagtgtctggcggcctggatatcatgaagatcggcaacaccgagatgccgagccgcgcctacgtgggccgttttaacttcaaaggcgtcgaccagggtaaacgcgttggcgagctgtccggcggtgaacgtggtcgtctgcacctggcgaaactgctgcaggtcggcggtaacgtcctgctgctcgatgaaccaaccaacgacctggatatcgaaaccctgcgcgcgctggaaaacgccctgctggagttcccgggctgcgcgatggttatctcgcacgaccgctggttccttgaccgtattgccacccacattctggattaccaggatgaaggtaaggttgagttcttcgaaggtaactttaccgagtacgaagagtacaagaaacgcactctcggcgccgacgcgctggagccgaagcgaatcaagtacaaacgtatcgcgaaataaaacgcaaaaaggcaacgcaagttgccttttttaatgtttgctccctctcccattgggagagggttggggtgagggcaacagcccgcagagcccctacccctgctcgcccatcagctgtttcaccagctcgacgcagcgcaggaaccgggcatcgtagtccgactccttcacatgaacgaattcgatctcgttctctttcagcagcgataccagcaacgactgaaactctttacgatccaccgagctcccaagactgcgcagtccatcggccacccacggggtattgttctccagcaggatcaccaggtcgaagcggtattcatcaatcagcgcctgcacaaacgggtgctcacgtccctcgtacttcagacagaaggcctgagtgctgacgaagtcggtatcgatgaacgccaccttgttggcatatttcaccgcaaaatcaatatactgcgcatgcccaagggcaattttatcgtaatccgaatactggagcgccatctcatcgccgccgagatgcgaaaaaacataatcccggccatattcccaggcgctggtggtattgaagatattggcgagtttattgaccagcgtcgatttaccgctcgactcgccgccgaggatcgccaccgtccgcacaaagaacggtttcacttccgtcggaatatattcccagtagcggaacgggttctcgcggatctgcccgccgctaatattcataaaggtccgcttaggatcgataagcaccgtctcgatccccagatgctcaaggtactgcggcgcatcggcctcttccgaggtatagatccggttcggctcgatccctttttcgctcataaaagcgcggatcccatggctccacacgtcccagccgtgcggatagggctccatcccctcttcattgaaggcgtggatgcgaatattcttctgatatttaaaggtttgcagcagccagcgcaggcggtcaggcaccgtcggctgttgcgacatggcgctctcttcaaacagctcgcggtcacgggtgtcgtcatagcccataatgatatgcagctcatcgacctggctacaggcgcgctgtatcaggtagatatgcccggtatgcagtgggtaaaacttaccaaacaccaccccgacgcttttctgtcggcggggaaactccagcccgaggaaacgatgcagcgcttcaagcttctgcgcactcgggcttttgattttggcattcagcagctggctaagataccccttggtcattccgctggcttccgccacctgctgcagggtacagcctttctgcttaatggcgctttttaaatagtcaaatgacgacatcgctaatctccttttaacttattataagtcgtcaaaaacgcttagcgcgtctgaaagctttttcacgccaaagatttgcatgccttccggcacttttttcggcacattggccgccgggacgatggcgcggcggaagccgtgcttcgccgcttcggagatacgctcctgaccgctcggtaccgggcgaatttccccggccagccccacttcgccaaagaccaccagatcctgcggcagaggacggtcgcgcaggctggagaccatcgccagcagcagcgccaggtcggcgctggtttccgtgaccttcaccccgccgaccacattgacgaagacgtcctgatcggccatctgtaggccgccgtgacggtgcagcaccgccagcaggatcgccagacggttctgttccagccccaccgccacgcggcgcgggttggacatcattgagtgatcgaccagcgcctggatctccaccagcagcgggcgggtcccttcccagaccaccatcaccgagctaccggaggtgatttcatctccccggctgaggaagatagcggacgggttgctcacttcgcgcaggccctgctcggtcatggcgaagacgcccagctcgttcaccgcgccaaagcggtttttatggctgcgcaacgtgcggaagcgggagtcggcatccccgtccagcagcaccgagcagtcgatacagtgctccagcaccttcggaccggccagcgagccgtctttggtgacgtggccgaccatcacaatcgccacgccgcgagttttagcaaagcgcgtcaaataggccgcggtttcccgtacctgggcgacgctgcccggcgacgactgcacgtcggccatatgcatcacctggatggagtcgatcaccatcagctgcggcttttcttcatcggcgatctgacagatctgctcaatgctggtttccgagagcatgttcaggttggccgttggcaacccgagacgatgggcgcgcatcgccacctgctgcagggactcctccccggtgacgtacagggttttcatcccttccgccagtttgcagagggtttgcagcagcagcgtcgatttgcccgcgccggggttgccgccaatcaggatcgcgctgcccggcaccacgccgccgcccagcacgcggtcaaattctttaaagccggtggagaaacgcggcagcgcctccaggctgatatctgacagcttctgcaccttcgacacgccggcgttaccggcatagcctgaaagacgctcgtttctcgccacctgcggcgacgcggcgatgcgcatctcggtgatggtgttccaggcatggcaggcgctgcactgcccctgccagcgcggataatccgcaccacattcattacagacaaatgcgcgttttggagctttcgccacgtttacctcttacttttggttcatgctgcccgagagaatacagaatacccccatcaggtcagcgtggcggatagtcacttccgcctgttcattcactttgggcttcgcgtgataggcgatgccaagccctgctgccttaatcatcggcaggtcgttggcgccatcgccgatagccacggtttgcgccgttgggatctcatacttttccgccagcttgcgcaacgtattggctttatatttcgcatcgacgatatcgccgagcacgttgccggtgagcttgccgtcgcggatctccagctcattggcgaataccgcgtcgagatgcagtttgtcgcgcagatactcggcaaagaaggtgaaaccgccggaggcgatcgccactttccagcccagcgtttccagcttgagcaccagctgcgccaggcccggcatcagcggcagcgcgtcgcgaacctgcagcaaaatactggcatcggcgtctttcagcgtcgccacgcgctggcgcaggctggcggtgaagtccagctcgccacgcatcgcccgctcggtcacttccgagaccagctcgccggtgccggccagtttcgcgatctcatcgatgcattcgatctgaatcgccgtggagtccatgtccatcaccagcaggcccggggtgcgcaaatggggaattttacccaatggcgcgacgtccagccccgcctcatgcgccagtcgcgtcgcacggggagtcagcgaaccggccaggcggatcacctggtaatcctcgaccacccaggaggcaacgatcactaacgcggcgcccagctcacgctgccacgccgtcagccgacgtttatccagaccgcgaccatacagcagccagccgctgcgcccggcgtgataatccagcggcatgacctcgtcgccgctcagggaaagcggcaacccaggccacagggaaacgtcttcaggcaggtcgcaccaggtcaaactgttaggcattacggctccacatctcttcattcaggcgaggaaaataacgcatgaggctaccttgtaaccagcgcttctggcaacattaagctgcaaattttcaaaggtggaatatggttcgcgcaaaactgaaattccggctgcatcgtgcggtcattgttcttatctgtctcgccctgctcgtcgcgctgatgcagggcgcttcgtggttcagtcagaacagtcagaaacaacgcaatccgcagctggaagagctggcccgcacgctggcgcagcaggtggtgctgaatctcgcgccgctgatgcgcagcgagacgcctgacgagaagcgcatcaatcagctgttgacccagctaacccataacagccgcgtcctggacgccggcgtatatgacgaacagggcgacctggtggcgcgctctggcgaaagcgtcgaggttcgcgaccggctggcgctggatggtaaaaaagccggcggctacttcaaccagcagattgtcgaaccggtgccaggaaaaaacggcccgctgggctacctgcgtctgaccctcgatactcataccctggcgaccgaggcgaagcaggtggataataccaccaatatcttacgcctgatgctgttgctgtccctggctatcggcgtggtgctgacccgcacgctgctgcagggcaaacgcacccgctggcagcaatcgcccttcctgctcaccgccaacaagccggttgaggatgaagacgatgaaaagaaaggaaatctataatgtccacattgcgcctcctgctctctgactcttacgatccgtggttcaacctggcggtcgaggagtgcattttccgccagatgcccgccacccagcgggtgctgttcctgtggcgcaatgccgataccgtggtcatcggccgcgcgcagaacccgtggaaggagtgtaatacccgccgcatggaggaagaccatgtgcggctggcccgtcgcagcagcggcggcggcgcggtgttccacgacctcggcaatacctgctttacctttatggcaggcaaaccggagtacgacaaaaccgtctccaccgctattgtgctggcggcgcttaattcactcggcgtaaccgccgaagcctccgggcgcaacgatctggtggtcaaaaccgacagcggcgaccgcaaagtctccggctccgcctatcgtgaaaccatggaccgcggttttcatcacggcaccctgctgctcaacgccgatttaagccgtctcgccaactacctcaacccggaccagaaaaagctgcaggctaaaggcattacctcggtgcgcggacgggtggcgaacctggttgagctgctgccgggcattacccatcagcaagtttgcgaggcgatccaggaagcattcttcagccattacggcgaacgggtggacgccgaggtgatctccccggacaacacgccagatctaccaaattttgctgagaccttcgcccgtcagagcagctgggagtggaacttcggccaggcgccggccttctctcatcttctggacgagcgctttcgctggggcggcgttgagctgcattttgacgtcgaaaaaggccatatcacccgcgcgcaggcctttaccgatagcctgaacccggcgccgctggaggccctggcggcacgcttagtcggctgtcagtatcgggcagaagtattacagcagcagtgcgaggcgctggtcggcgatttcccggagcaggaagcggaactgaaagaactgtcggcgtggattgccggcgcagtgcgctgataaaaaaagcccgctgcgcttagcgggcctggaaaaccgtaggccgggtcagacgaagccgccacccggcacaacagctcttactctttatcgcccagcagcacggattccagcgcgattttgatcatgtcgttgaaggtcgtctgacgttcagcggcagtggtctgctcgtgggtacggatgtggtcggagacggtgcagatggtcagcgctttcgcgccgaactccgccgccacgccgtagatacccgccgcttccatttccacgcccagaatgccgtatttttccatcacgtcgaacatggacgggtccggcgtatagaacaggtctgcggagaagatgttgccgacgcgcgcgtcaacgcccagcgctttcgccgcgtctaccgcattacgcaccatgccgaaatcggcaatcgccgcaaaatcatggtctttgaaacgcagacggttcactttagagtcggtgcacgcgcccatgccgatcaccacgtcacgcagtttgacatcttcacgcaccgcgccgcaggagcccacgcggatgattttcttcacgccgaaatcggtgatcagctctttggtgtagatagagcaggacgggatacccatcccgtggcccatcacggagattttgcggcctttataggtaccggtgaagcccagcatgccgcgcacgttgttcacttcacgcacgtcttcgaggaaggtttctgcaatgtgcttcgcgcgcagcgggtcgcccggcatcaaaacgacgtcagcgaaatcgcccatttctgcgttaatgtgaggagttgccatcttcagttccttttacattgttgtttttgccgggtggcggctacgccttacccggcctacaaatcgtaggcccggatcgctgtgcgccaccgggcaatgacctcagaacatggctttgccatattccatgtcagacgtaccaaagtatttcgcaatagtctggccgatgtccgcgaaggtttcacggtgaccgagcgaacccggtttcactttcgggccgtacaccagcaccgggatatgctcgcgggtgtggtcggtaccggtccaggtcgggtcgcagccgtggtcggcggtgaggatcaggatgtcgtcctcaccaaccagctccatcagctccggcagacggcggtcgaacagctccagacccgccgcgtagccagcgacgtcacgacggtggccccaggaggagtcaaaatcgacgaagttagtgaagacgatagtctcgtcgcccgcttccttcatctctttgatggtcgcgtcgaacagcgcgtccagcccggtggctttcactttcttagtgataccgcagttggcgtagatatcggcgattttacccacggacaccacgtggccgtttttctcatcgaccagcttctgcagcacggtcggcgccggcggctctaccgccaggtcgtgacggttaccggtacgctggaagttaccggctttgtcgcccacgaaaggacgagcaatcacgcgaccaatgttatagccgccttcggtcagctcttcacgcgcgatttcgcacagctcatacagcttgtcgaggccaaaggtctcttcgtggcaggcgatctggaacaccgagtcagcggaggtatagaagatcggtttcccggttttcatatgctcttcgccgagctgatcgaggatcaccgtcccggaggagtggcagttgccgagatagcccggcaggttggcgcgtttcaccagcttatccagcagctcctgcgggaagctgttttcctggtcgctgaagtagccccagtcaaacagcaccggcacgccggcgatttcccagtggccggacggggtatctttaccggaagaaagttcatgcgcccaggcataggcgccaatcacttcggcattgccatccatacccgcggcaattttaccggtggagccttcatgcgctttcaccagacccagacgggtcaggttcggtaaattcagcgggcctttgcggccgtggtcagcctcgcctttggcgcaggcttctgcaatgtggcccagcgtatcggcgccgacgtcgccaaagcggtctgcgtcttccgttgcgccaatcccaaaggagtccagcaccatgataaatgcacgtttcatcttgttctccatacatcttgcgctgcaaaaaagcgatcagatcagtatatcgctattcagtgatacggcgatagactgtcggcgtaatttccggggctttatcgtccagtttaatggccgctttgaccgctttcgcggcctcctgccagctgttctcgtctttggcatggatcaccgccagcggacgctgtccgtcgacgcggtcacccagacgcgccatctcggtaaagccaacgctatagtcaatggtgtccgatgcctgacggcggccgccgcccatagaaaccactgccatgcccagcgcgcgagtatccatcgcgctgataaaaccttcggtatcagcatagactgctttgctcagcatcgccgtcggcagataattagcataattctcgacaaagtcgctcggccctttctgcgccgcgaccatgcggccaaacacttccgccgctttaccgttatccagcaccgcctgcagcttcgcgcgcgcctcggcatcgtccgccgccagcttgccggagatcagcatttccacacacagcgccattgtcacgtcgaacaggcgcgggttgcggtattcgccggtcaggaactgcaccgcttcgcgaacttcaacggcgttgccggcgctggaggccagtacctgattcatatcggtcagcagcgcggtggtgcgcacgccggcgccgttggcgacacccacgatcgcttcggccagcgcggcagagagttcataagtcggcataaacgcgccgctgccgactttgacgtccatcaccagcgcatccagcccttccgccagcttcttcgccagaatcgaggcggtaatcagcgggatggagtccaccgtcgcggtaatatcgcgggtggcatagaaacgtttgtcggccggggcaagggagctggtctgcccgataattgccacgccaacatcttttataatctcgcggaagcggttgtcgtccgggaagatatcgaagcccgggatcgcttccagtttgtccagcgtaccgccggtatggccgaggccgcggccggagatcatcggtacgtaaccaccgcaggcggccaccatcggccccagcatcagcgaagtgacatccccgacgccgccggtagagtgtttatcgacgatcggaccgttaaggttgaggcttttccagtccagaacggtaccggaatcccgcatcgccatggtcagcgaaacgcgctccggcatagacatatcgtggaagaagatggtcatcgccagcgcggcgatctgcccttcagagatagtattgtcgcggatgccgttgatgaaaaagcggatctcttcatcgcttaatgcctgaccatcacgttttttacgaataatttcttgtgcgagaaacacggtaacctcccaaagagaataaattgccggatgacggcgcgagcgccttatccggcctacaggcatcaattcgtaggccggataagcgcagcgccatccggcaaatcaagggattagtagctgctggcgctcttgccgtcgccgtgacccagggctttcaacaggctagccagcaggctggatgcgccaaaacgatagtgacgagaatcggcccagtcggcgccgaacagttcatcagcgatcgccaggaactgctgcgcgtcttccgcgctgcgcacgccgcccgccggtttgaagccaacggttttctcaacgcccatatcgcggatcacttccatcatgatgcgcgcgctttccggcgtggcattcaccggcactttaccggtcgaggttttgatgaaatcggccccggctttgatagagatttcagacgctttacggatcagcgcttcttctttcagctcaccggtttcgatgatcactttcagcagcacgttagccgccgcacaggcatccttacaggctttcaccagctcgaaaccgacctgctcgttgccggcgatcagcgcgcggtacgggaagaccacgtccacttcatctgctccataagcgatcgccgcgcgggtttccgccagcgcaatgtcgatatcgtcattcccgtgcgggaagttggtgaccgtggcgatgcgaatatccggcgtcccctgctcattcagcgtcttacgggcgatcgggatgaagcgcgggtagatgcagaccgccgcggtgttacccaccggcgttttcgcctgatgacacagggcaatgactttctcattggtgtcgtcgtcattcagggtggtcaggtccatcagttttaacgcgcgcaggctgcttgcttttaaatcagtcatttcatactccgccggcgtcatgccggatcaatagtttgttcaccttgcgagtctgttactattgtaacattcgctcgtcgttacacttcgacattcatcacagttaatgaaaactacttactaatttgcattactgtaacgtgattaagatcacaaattaccactcaataccgcagcaattatcgttagtcccctcttaagcataatcgatactataccgccgatgagaatgtgataattctaacacacaataacagatgtactcgatagcgtggcgcacattttgcccaatttacgggaaataaaaacgctacaaattgaaatataaatcttttttcaaaaaagagagtggtgatggaattatcacatttacagcaacaccagcggcacggtggccgctggttcaggagacaggcttacagggcgagaaaaaccccggcgatggtggcgctcatcaggttggacagcgtccccgccgctaccgcacgtagcccaagctgagcgatatcctgccgccggttgggcgccattcccccgagtccgccaatcagaatggcgatcgatgacaggttggcaaagccgcacagcgcgaaagagataatggctttggtgtgatctgaaatgacctgcagcccggccgccgccacttcggcatccgcctttaaatattcgccaaagttcatgtaggccacgaactcgttaatgatcagcttctggccgataaacgaccccgccaccgtcgcttcgtgccacggcacgccaatcacccacgccagcggtgagaagatccagccgaggatcatctgcagcgacagctcaggatggttaaaccagccgccgacgccggagagtatgccgttcagcagggcgatcagcgcaataaacgccagcagcatcgcgccgacgttgagcgccagttgcataccagacgcggcgccggaggcggcagcatccagcacgttggccggtttatccgcgtcagcgctttggctgtcatgagccgggttatcgtccggtttgtccgtttccggtacgataattttggcaaacagcagacctcccggcgccgccataaacgacgcggcaataaggtactccagcggaacgcccatctgcgcatagcccgccagtaccgagcccgccaccgaggccaggccgccgcacatgaccgcaaacagctccgagcgagtcatggtggcgatataaggacgcaccaccagcggcgcttcggtctggccaacaaagatgttcgccgtggccgacagcgattcggtacgtgaggtcttcagcactgcccgcagcgcgccgccgagaatgcgaatgaccagctgcataatgcccaggtagtaaagcacggcaatcagcgacgagaagaagacgatcaccggcagcacgcgcagggcaaagacgaagccgccgccgccaaacacctcgaacattttatcggagaccagcccgccgaagatgaaactaatcccttcattgccgtaggcaataacgctggcgacgccattcgacatcgctaatagcgccgcgcgcccggccggtacatacaatattaacgcgccgatacccacctggattatccaggcgccgagcacggtgcgcaggttaatggcttttcggttattggagagcagcacagcaatggccaatagcgccaccatgccgataagtcccatgaggatttgcatacagattccctgtgtttttgatagtccagtactaaccgcgtgattatatcggcctgaaactatcctgcccgtctggcttcacacattttaagcaaatcaatgatatggatggacaattatgagaaatcgatcaccatacagagaccgggggaagggaaaacaaggcgagcgtattgtgcatgatcccttcttctatggctgccggcgactccgaacgcagttcacacagcgcctcaaatacccgtgcagcttgttccggtcgattgggctgtccctgaaagccatttagcggcatatccggcgcatcggtctccagcagcagagcggaaagcggcagacgcgccatcacttcacgggttttactggcgcggggataggtaatggtgccgccaacgccgatcttatagccaagctgaacgaagcgctcggcctgctgcaggctgccggcaaagccatggatgactccggtacgcggcagggcatgttttttcagcagcatcgccagcttatcgtgggtgcgtctggagtggaggatcaccggcagatcgtaacgcttcgccagcctcagctgcgcttccagcagcgcctgctgacgatcaaactgcggatcgtcgcgataaagatcgaggccaatctctcccaccgccaccagtttaggcggccgctgcgccatcaaggcttccagctgcgccagtccctcatcagtatgctcttcgatgacgatcggatgcatacccagcgcggcgtacagcgcttcgtgctgagctgccagcgccagcacgcggctaaaacgctcagcagagatggctggaacgataattcgcccgacgccggcctgcgccgcacgcgccaggctggcgacctcatctgccgcaaaggggggaaaatcaaagtgacagtgggtatcgataaaacggtgcgtcacgccagatcctcatgatcaaaactggggtcattcgcctggggcgcaggaatgatggtcgcctggggcgcttcattggccaccggcaccggcggcaccaccaccggcgcgggccgggcaatacgcggcgcgtggcgcagcagcggcggctggtcggccagtagtttacccaccgttgccaggaaataacggccgcactggcgcccggttttgtagtcctccagcagcgccggtagtcggctgccaagcgccatgctgcgcagcggccgctgcggatagatttcgaagatccgcaacttacccggcggtttctcgatgaactgctggatggcgcggtaggtggtttcgtgatgatgcaccaaattgaccagcggttgcagactactctctcccagccagcgctccatccgcttgaaccactgcggggtataaaacatctgcgaagggacggtacggatcaccacgatggtctgggcgccgcggcgggccgcctcctgcaccgggatagcatcgctgacgccgccgtccaggtagctaacgccgtcgagcaacacgccgctgcgataaaagccggggatggcgctggaggcgcggatcagatccagccacgtttgcggcgtcggcgaaaaatagctggcggagtaatcgtcaccgcggcaagcgcatagccacagctctttccccaacgcgaactgcgcttcggcatagttcatggcaagcggcatttgctgcgaagtggcctcaaccagccagtcgagatcgataaggttgccgccgcgcacaaagcgcatcggatcgaaaaactggcgtgaagtggtgtagcgggtgataactttgcgggcatagccttgctgattacacatgtaggcggagaggttttgcgcgccggctgaagtacccagcatcaggtcaaaggggttaaatccggcgcgcataaattcgtccagcaccccggcagtaaaaatccctcgctgtcctccgccttcgcataccagcgccagcttgcctggtcggaagggtttaaccgccagcggggcgatattgcccagcgtgacgggaatgcgttgccccaccctgctttcctgttcgattgatcttctcctgacaaggtaacgcaatttgcccgccgcttaaaccgcgaaagccagtcctcaggactggctttgtgtaagatgacgtgtcagtaaaaatgcttaggcttcagtatcgcccgcatcgcgggccgcctaaggacgtctgcgtcctgtaaacaggctcaccaggaacaggataatcccgacgacaaagacgattttcgcagcgccagcggccgtacccgccagaccaccaaagcccagagccgcagcaattaatgcaatgaccagaaaaataattccccatcgaaacatacttttctccttaccataatggacggtgaacagcggtttgcgcaccctttctgtatagctcatcgctcagtggatgctgctattcgttcggcaaccttggccagacaacacttttgttaataactcggtttacttaacgctaagatcgttgcgcacgcttttcacaccggagaccgctttcgcaatctctgcggcacgctccgcctgcgccgcggaagccaccgtaccggtcagatgtaccgcgccggcgttggtttcgactttcacattgcgcgaagggacaatgtcatccgccagcagcttggctttcacttcgctggtaatggcggtatccccggcatagcctttcagcgtcgccgtctcgctcgatgatttatgatggaccgtcagcttgtcgttaacgtgtgagacgcctttgacctctttcgctacgctcagtgcctgacttttctgttcagcactggtgacgtcgccgctgagggtgaccactttattctccgttttcaccgaaatatcgccggagttaatatctttatgatcgatcagcgccgcttttacccgtgcggtaatggtactgtcgtccataaaatcgccgactttgttaatcgaattatctaccgcctctcccgcattgctggcagccgacttcgcactgtctaccgttgttttttccgtctctgccgaggcgttcaacgcggctaagcctaagaagagcgccagcaacatattggcattctttagtctggtcatcgttatgtcctcgttttttcaccagcgctggcgtcttatcgcagtgaattacgccagcatttttaaaaacacgaattaaatatagtagacagacgaaggggttgcggaggatatggataaaaaacagacgaattagcggtgttttaagaactttccagaaggaagggaacgggggcgtaaccagaaaaaagcgcggcctgagccgcgcttcgtcagggattagtgctcgcgcgttttgcggaacaccacgtcagggtaacgctcctgcgtcaggttcaggttgaccattgtcggggcgatgtaggtcaggttatcgccgccatccagcgccagctgaacttcatttttccgcttgaactcttcgaacttcttcacgtcagtagattcaacccagcgcgcggtggccacgttgaccgattcgtaaatcgcttccacgttgtattcgcttttcagacgcgctaccaccacgtcaaactgcagcacgccgacggcgccaacgatcagatcgttattagcgatcgggcggaagacctggaccgcgccctcttcagagagctgaaccagccctttcagcagctgtttctgcttcagcggatccttcaggcgaatacgacggaacagttccggcgcgaagttcggaataccggtgaacttcatcatctcgccctgggtaaaggtatcgccaatctgaatggtgccgtggttatgcaggccgatgatatcgcctgggtacgcttcttcaacgtgcgagcgatcgcccgccataaaggtcagcgcgtcggaaatcactacgtccttgccgatacgcacctgacgcagcttcatgcctttttcatatttgccggacaccacccgcatgaaagccacgcggtcgcggtgtttcggatccatgttggcctgaattttaaacacgaagccggtgaatttctcttccgtggcggtgacttcacgcgtgtcggtgttgcgcggcatcggcgcccgggcccactccaccaggccatccagcatatggtcaacgccgaagttacctaacgcggttccgaagaagaccggggtgatttccccggccaggaacagatctttgtcgaactcattcgacgccccctgcaccagctccagctcgtcacgcagctgctgcgccaggtcttcccccaccgccgcgtcgagatccgggttgttgagccccttcacgatacgcacttcctggatggtgtggcctttaccggtctgatacaggtaggtttcgtctttgtagagatgataaacgcctttgaacagcttgccgcagccgataggccaggtaatcggcgcgcagccgattttcagctcgttctcgacttcatccagcagctccatcggatcgcggatatcacggtcgagtttgttcataaaggtgaggatcggcgtatcgcgcagacgggtgacttccatcagcttacgggtccgatcttcgacgccttttgccgcgtcaatcaccatcaggcagcagtccaccgccgtcagggtacggtaggtatcttcggagaagtcttcgtgccccggggtatccagcaggttcaccaggcagtcatgatacgggaactgcattaccgaggtggtgatcgagataccacgctgcttttccatctccatccagtcggatttcgcgtgctggctggaaccacgaccttttactgtaccggcggtctgaatcgcctgtccgaacagcagcaccttttcggtgatggtggtcttaccggcatccgggtgagaaataatggcaaaagtgcggcgtttggccacctcttgcagataaggagacaacgtcataattaatcttctaagtaaacgcggccatgggccacgcatgtggaatacgaaaaattgcggctattttacccatcaacgggggggaggcaatcagtgtttacacaggagctgctccagttcgcttaacgaggtcaccgtccagtccggctcgagatccgccggcagctcgcgctgatgcgcattgagccagcaggtcgccagtccggcgttcacgccgccgcgaatatccgactcggcggtatcaccgaccatcagcacccgcgagcgcggtgggttacccgcctgcgccagcgcataatcgaaaatacgcgcgtccggcttggcgacacccacctgttcagaaataatcagcaaatcaaagtgatcgcgtaaacctgtccgctccagacgagtctgctgcagcgaggtaaagccgttggtgatgatgcccattctgaccttgccctgcagcgcgttgagcagcgagaccgcgcccggcaacggggcacagatttccgccatcgcattcataaacgcgtcgttgagttccccgggcggcacattcaaacgttccgcccagctgtcaaaacgctggtgctgcagctgcagcgaggtgatggcgccgttttggtaatccacccatagcggcttgttcacggcctgatagtcctgaaaatcttcggcggtaaaggtcacgctgtagtcgagaaacatccgctgcaagccactgaaagaatcaaacgtaaacagcgtttcatcggcatcaaagaaaatccagtcccatttcatcgtatcaccttgtgttacatactgattggcagagccataataatggcgtcttcgcgtccgtcggccgtaggatagtagttgcggcggatggttgcctcattgaaacctacgctctcatacagcgcgatggcggcaacgttggatgctcgcacctccagccacagcgtgacgacgccgagtttttcgacttcatcaatgacatgctccagcagcgctcgccccaggccgcggcgctggtacgcgggatcgacggcgatattgaacagcgtcgcctcatccagtaccacttgcgtaatggcgaaagctgccatttcgccatctaccgacagctgatagttgcaatagcgctccccctggttactggccagagtctgttcgctccacgggaaagcgtgggcgcgtttttcgatgtgccaggctttggttaaatcagccgtgctgagggtagaaatcgtgttcatgtgcgcagatttgttgccagagcgccctgcgagccggcgcgctggtctggagttcatcaaaagcgggggtggacatctgggcgcccgccagcggcagcgacgcctctgtgcccaaccgccagctgttgcagcggctgtcctgcggcagcatcgccacccgctccggagtcagctgcaggacctgatctggcgtcacggccagcgcgcgtaatatgtcgccaatcagcggctctgtcagcgacggcggggtttccgccaccatcaccagacgaatatgttcaggaagcgagatagcgatttcgccctgcaacgcccccggtcggcgcagcgaccactgggtaatgcccagctgctgtaattgccagtctcgtcgggatgtcatagcgaaacactcctgttaaacaagcgcgcaatatagcaaatccgtcgtatctgcgccaacaaactactataatcggcgccagtcttaatgaaggagtgtttcatgtccgcttttaccccggcaagtgaagtcttgctgcgccacagtgatgatttcgagtccgcccgcgttctgtttgccggtgacctgcaggatgacctgcctgcgcgtctggataccgcggccagccgcgcccacacccaacagttccaccactggcaggtcctcaaccgccagatgggtgacaccgtccgttttagcttagtggctgaggccgctgacgtcgccgaatgcgacaccctgatctactactggccaaagaacaaaccagaggcgcagttccagctgatgaacctgctctctctgctgccggtgggaagcgacattttcgtcgtcggtgaaaaccgcagcggcgtccgcagcgcggagcagatgctggctgaatacgcgccattaaacaaagtggatagcgcccgccgctgtggcctctatcatggccgtctggaaaagcagccgaccttcgacgccgacgcattctggggcgaatacacactggataatctgacgataaaaaccctgccgggcgtcttcagccgcgacggtctggacgtcggcagccagctgctgctctccaccctcgagccgcataccaaagggaaagtgctcgacgtcggctgcggcgcgggcgtgctggccgccgcgctggccagccattcgccgaaagtgcgcctcaccctgtgcgacgtcagcgccccggcggttgaagccagccgcgcgacgcttgccgccaacggcctggctggcgatgtgtttgccagcaacgtcttctccgaggtcaatggtcgcttcgacatgatcatctccaacccgccattccatgacggcctgcagaccagtctcgaagccgcccaggcgctgatccgcggcgcggttcgccatctgaacagcggcggcgagctgcgcattgtcgccaacgccttcctgccgtatccgcaggtgctggatgagacgttcggcttccatgaggtgatcgctcagaccgggcgctttaaggtctatcgcaccattatgacccgtcaggcgaaaaaataatcgtcttttcacgccggcggcccgctcctggtaccgctggcgcttcccgcgggcaaatccgcccatttttgcagcaatcgatacaacctgcataattaactattgacgtgtcgccgaaaaccactagaatgcgcctccgtggtaacgatactttcagagtatcgatggtatgcgaaggtggcggaattggtagacgcgctagcttcaggtgttagtgtccttacggacgtgggggttcaagtcccccccctcgcaccataatccacgaagatattgctcgcactgggcgaaggtggcggaattggtagacgcgctagcttcaggtgttagtgtccttacggacgtgggggttcaagtcccccccctcgcaccaacgaggcaatatcccaaagaaagaatactgtgcgaaggtggcggaattggtagacgcgctagcttcaggtgttagtgtccttacggacgtgggggttcaagtcccccccctcgcaccaatattcttccctctcccggcattatcctctcagtttaatatccacaatcatcagcattattccgccaatcaatgcgacgcacgatggcagcaggataaaatggcgcaattgacgatgccagatcatcgccgcggacatcagcatgcccaccgcgaccagtacccgccatacgtcagccgacactccggcatacccgagagcgacaattagcgcgccgggaatcatcactccccagccgcttcctaatgctcgctgcagcatggtttcacctctcacaacgataatgataaccaatatcatatgataatctttatcatttgtcatttgcgacgtgctctgcccctttttctttacgttcgcggtaatgacatacattcatgaaggtgataaattaagcggattatcgatatatattaaatattttgcttattttgcaaataacctttttttgcacattgttatcagactcttcatttttggctttcatcattttgaaatttaacgactaataatgattcttccgatatgactgcacaaacctggcgagcacactacgcacaaaaatatcaatattccttacggctttttttactgcttaatttcatttcttcctcgctgtcgctggtcacccccctatttacggtagttcgttttacgctgccctgcgccctgatcgtcgtctgcagcgggctgctgctgctctggcactggaaatggccgcaatcgaaaataaatattcccactatctcgttgttatttggcatgctatgggcatggcacgtagtgacaaaagcgatgctattgacaccgccgcattttaactatctggtgatcgccctattaagcattctgtttatcggcaccatcgctttttccaataatatcactgcctttaccctccactctttaccaactttccttgcctgcctgataatggcggagggggaacaatggttgcgtatgacttactgctttatgctgcctatagccggtattaccctgcaaaatattatccagaagcgcagcgatgcctttacgcagggtttaatggataaactgatgcatgaacgcaatacgctcaacgatctcagtatgctcgatcccctgaccggtttgtataatcgccgcggactgcagaaccgcctcgataccctgctggcgctggacggcgacaaccactacgtgctgctcctcgatatcgatcacttcaaggcctataacgatcactatggtcatatgatgggtgaccaggcgcttattcgcgtctctgctgccattcgcaacgctgtacgctcacgcgatattgtcgcccgctttggtggagaggagtttatggtgctgctgaccaatagcagcgaagaaacggcctggaagacagccgagcgtatacgtcagcgggtctatgacctgaagatcccgcatatgtttaatgaaagcgtcgccaccaacgtcaccatcagtattggcctgacgccgctcattaatgacaacattgaacaagcgctggcgcgcgccgacggcgcactctatgaggccaaaaataaaggccgcaacattattcttgccagttgacctgcgcgcgctgcgacatcgcggcgccgataaaagccttgccatgccgcctgcaagcaactaatatcagtaatcattatcatttagatttgtatctggaaatcgaatggcctggcgttcccttcctctcagcgatgaacttatctggcgggctcctttgccgacggctgagcatgccctggcggagagtattcgggaaaaaatcgccaccctgcgcccacacctgcttgatttcctgcgacttgacgaacccgccccacggcacgcgttaacgcttgccgaatggtcgcaacccatcgccttgcgctccctgctggccacctggtccgatcatatctatcgtcatcagccgacgctgcctcgggaacagaagcctctgctctcgctctgggcacaatggtatatcggcctgctggtgccgccgctgatgctggcgctgctcaatgaaccgcaaggcctcagcctggcgccagaacatttccatgtcgagtttcatgaaagcggccgggcggcctgcttctggattgatgtgcatagcgatgccgacatcgagaggctttcaccgcaggcgcgaatggatgccctggtaacgcgcaccctgcagccggttgttgaggcgctggcagcgacgggcgaaatcaatagcaaacttatctggagcaataccggctatctgattaactggtatcttggggaaatgcgcgcgctgctgggtgatgagcggcttgccgcgctacgtcagcactgtttttttgaaaaacaactcgccgatggccaggataacccgctgtggcgaacggtgatgctgcgtgaagggcagttagtccgacgcacctgctgtcagcgctatcgcctgccggatgtccaacagtgcggcgactgtacgcttaaataattaccacttacctgaaaagtaacgggcggcctttaccgcccgttgctatttatgcggtctgttgactctcctgctccgcccgctcggcctcttccgcttcctgagcaagcagttgtttctcatataccttaaagaatgggaagtagatgattgccgacacgcaggccagaacaatgaccagaatcgccgcccggaaatcccagcccaacgcccaggcgccgccaattggcgctggcgccgtccatggtacgacggagatgacgcggccaatcagatccagcttcattgccgcccaggccagcaccgcgttcaccatcggcgccagcaggaacggaataaagaacactgggttcatgacgataggcgtcccgaagatcaccggctcgttgatattgaacaggcttggcaccacgctcaaacgaccaatggagcgcaaatgcgctgaacggctgcgcagataacagaacaccagtcccatggtcgccccggaacctccgaccacgataaagaaggtccagaacgcctccataaagatatgcggcagaggcgcgccctgggccagcgcctgctggttcataccgaggttagtcagccagaacatctgcagcatcccggacacgatcgccgcaccgtggatcccggcaaaccacagcaggtggccgatcagcaccgccaacagaattgccggcagagagtcggctgccgaaaccagcggcttgaaaatggccataatggcctgcgggatcagcatgtcaaaatggtgctggataaacaggctcagcggatagagcgtcagcacgaccaccagcaccgggatcaacagatcaaacgagtttttgatcatcggcggaacctggtccggcaagcggatcccaatgttgtgcgctttcaagaaacgcatcatctccacgcagtagatcgccaccaggatggcggtaaagatcccggtccccccgaggctatccaccggcagcgtgccattggtcttcggcgcggcaatcagcaaaaaggccatgatcgacagcattgcgcacataaagggatcgagctgattggatttctcgtaatgcttaccgaggttataggagattgccgcgcagatgtagatcgacatgatccccatcgtcatatcaaagggggtcagaatacgcccctcaaactctttcgccagatccagccaggcgcgggcaaaaccccaggtggtatccggtgagaacggtggataagcaaacactaacaggaacgatccgacgatcataaacggcatcgctgagataaatccgtcacggatagccatgacgtggcgctgcgacgagatccgccctgctatggggcttatgtaattttctacaaagcgaaatatcaaattaaacgcagcatggttagcagacatagtagccctcctgacaggctattgatactggcccaacaacgattaccctgccgttacgatgaccgctttttgacgcagcaggccgctggcggatgtgcaaccggctatactgctcatgaggcaacgattcatacacggctcttttgttataaataaaaggagaagtgactgttccagtattcatctcaatgcagataaccgcaaccggttacagtaaccggttacggcgattgtgaaggagatcgacaaaatagaaagaatctggattgtccgcgctgatatttacactccgccaggcttgtgacagatttaaccaggcttaaatcaggagaatccaatgagtctgcagtctgtacggcagttttttgccgaacacgcccccgatatcgaaattattgagttaaatcagagtaccgccaccgtcgcacttgccgctgccgcacacaacgttgagccggggcaaattgccaaaacgctgtcgctcaagatcaaagataagattgtactgatcgtcgccaggggcgatgcgcggctggataataaaaagctgaaagagacctttggcgcgaaagcacgcatgctaagcagcgatgaagtggttacctggaccggtcatccggtcggcggcgtttgcccgtttggcctggaaaatccgctggcagtctactgcgacgtctctctcagacattatcaggaagtactacccgcagcgggagccatccatagcgcggttcgcattgaaccagaacgcatggcgcagctcaccgatgcaacatgggtagatgtgtgtttatagccgcattacgctacctgtttaacggcgctggtcgtactattgagcggtaaatgcaacaggatatccgccgcgtttaataaaccaatgtctgagcgaactccgagcttggtcatggcgttaaacttatgcgcgcggatcgttttaatattccggttgagctgtatcgcaatatcagaaagcgaatatccccacgacatataccgaaggatggcgtgctccgtcgggcttagcggatcgttgcacgcctctctgtcgcaaaattgttcgctgccgctgagatgatgattgtccagtagctgcagcaaacgctcctgtagcccgcgtcgcggcgcggatttattcagtatgccgtgcaaacaggccggcataagatggccgatcaggtgcatttcactttcattattagccagaataatcgtttggacttccggccggcaccgcgccatttcatgaacaaagagcagactctcggctcgtgaagaacgacttcccgaaagagaaaaaataatggttgaccagggaaacggtatttccgccgccctgagcatactgacatttttaaacagatgaatatgataacggcgattatcttcacgactaaagatatagcgccatgccatttccgtcatcacgcatttttctacgatggcgacatggcgggttgtactatttttttccattccatttgctccccgtaagctgaattgatattcagctcttgcattccctgcgcgctgttgatccaggcatacatttcagcgttgctgcgtagcgataagcgacgcattgcgctgtttttctgcgcgctgatcgtcttattactctttttcaacagcgcggcgatctggtttattccccaccccttcgccagaaggcgcagaactttacgctctgaaagagtgagcatcgccgcagagtggtagcttgcgaaatcgctgtcctcatccccggcaaacagcgtacggctaatctgttcagccgcacggctaccggcgcaaatcacctcaatcagccggttaaccggctcgctctcggagatcaacgagctttcaggacgaattaatagctcaacggccaacggatagaggctgtcgctgaccataaaaacccagtgaatatcacggtactgggtcatgagggagtaataacgctcgcagacggctcgggggtgcgcaatctcgccggagatatccgcgacaaccagcaccgcccgccgcagttgtaaaagggtgagctcatcatgagaacgacaaaaactcagttcgtaatcagggaggttctcattgaagatcacctttaaccctgattgcatgacgggaattttactaataacgacgccaaacttaccttgtcctggtaacataacacctccgcttcctgtcgaagttccttcgcttgcctgcaaacgatcggcgagcgactttatcgccatatcatttcctggatgaatattaaaatcatattcatggcctgcgcacacgatatacgtaacgaccgaaccgtggtcataccgtgtaaaatattattgccgtgtatacttgcgattaatattaacacagacattcctgcgctaataaattagaaaagataaaaacattatttagcaaaaataatttcagtactgaacattatgaagcattatctttaattgtttctctaaatgctttgggtgacataccgctatagcgacggaaaaaacgcgaaaaataggctgcatcgctaaaccccaaataatcagagagttgtgtaatcgtcatgcgggtgtactgcagattgcgtcgcgcttcaagcatcaaccgctgatgcaatactccaagagcgctacagccataaaactcacgacataaataatttaagtgcgtaaccgacagtccaatcagcttcgcatactccgccaacgggagatgctgtcggtagtggctctcgataaggcgggcgaagtgacgcatcatgctgcgcttccgctccgctttatcttccgcgggggacgcgggatggcactgtcggttcagccagaccaacagcgtccccagcagcgaatagagcatcatttctcgcgcatcgtgctcttcgcagtactcctcgcgaagcgctgaaaacagcgtatgcatgcgcccgcgagaacggcccaccggcacacactgcggcacgctaagcacatccagagggcgaccgaactgattttcaaaccggctcagcagcggcagcgccagagagagcacaaacccttgcgtcccgggtgaaaaattaaacccgtgaatacagagggcgggaaccacctggatgcaggactccgtcatcaccgcggtggcgccttcaatttcgatctccgcccgcccctgatgcagatagagaagctggaccatttccgcatgctgatggacgcgaatatgccactgatacaggctgctgcgctgtaaaatcgactcacagtgcagcaggtccggcgtcggccagccgcactcttcgccatacagcttaaatacgggcacggtttgaacgaacggcatgatgactcctcttaattcaggcgacacgctccatgggcaagcccacgtagttttccgcgatggtggtcagcccggcgcgcgagcccagatagtagcggcggtcggcggcctgcattttagcgtcgaacgcgttctgatccggaaaatcatgcagcaggcgggtcataaaccagctaaagcgttcccctttccagacccgatccagcgccagttgcgagtaggccgccagcagatcgctgcggccacgatggtagtattcgcgcagaatccgccacagatagttcacgtccgatgccgccagatttaatcctttcgccccggttggcggaacgatatgcgccgcatcccctaccaggaacaaccgcccatattgcattggctccacgacgaagctacgcaggggggcaatgctcttctcaagtgagtgaccagtcactaacctggatgccagctcctccggcaagcggcttttcagctcctgccagaagcgctcgtccgaccatgcttcaaccttatcgctcagcggaacctgcagataatagcggctgcgggtcagtgagcgttgactgcacaatacaaacccccgctgatggtgcgcataaataagctccggattgaccggcggcgtatccgccagcaggcctagccagccaaacggccacacgctctcgtaggtctgcaaaatgccagctggaatactttgccgcgatacgccgtggaaaccgtcgcaaccggcaataaaatcgcactccagacggcaggtttccccttcgctgaggtaggtgatcgtcggccggtcgcttttcgcgtcatggatagccacctcgctcacgccatagacgatcggcgcgccgctggcggcccgggcagccatcagatcgcgggtgacttcggtctggccataaaccattacgctcttaccgtcggttagctcgctcagtgcgacgggcacccgctggccgtcaaatagaaactccaccccatgatgcaccaggccttcggcatccatccgctgcgccacgcccgcttcgcgcagcagatcaacggtaccgctttccagaattcccgcgcggatgcgccccagcacatactgcggcgtttgacgctcaaggatcacggtatggatcccggcgttgtgcagcaactgccccagcagcagcccggaggggcccgcgccaataatcgcgacctgtgtcttcatagggatgtctcactcttgcagggttaattatttgtataatttttgtttaataaaagtgcttttctgcatttttgataagtcagtggggaaaaagaagggatgaatggcgacaaaaattgcacttttcaccaaactggcaaaagtgtgggatgcttcaaattctgccgccccgcagaccgggaatttttgcacattatttgatcccacccccctcagccgccactgcgcttcaggttaaagtatcggcagataccaggcgtcgtggacaatagaggaagtatgcaggttgatcggacacagcagcgggcaatcacacgtttatgcatccagtgtggtctttttctgttacagcacggcgccgagagtgcgctggtggaggaactgtcaacacgtctcgggctggcgttggggatggacagcgttgaaagcgccatctcttcgaatgccatcgtcctgaccaccattaaaaatggcgaatgtcttacctctacgcgcaaaaatgtcgatcgcggcattaatatgcatgtggtgacggaagtgcagcacattgtgatcctcgccgagcataagctgctggactatcgcgacgtcgagaagcgttttgcgcagatcgttcccctgcgctatccgcgctggctgctggtgctgatggtgggtctttcctgcgcctgtttctgcaaactgaataacggcggttgggatggggcgctggtcagcttctgcgccagcacggtagccatgtacattcgccaggtgctgacccatcgctccatgcatccgcagatcaacttctgcatcaccgcctttgtcgccaccaccatctccgggctgctgctgcgcctcccggcgtttgccagcacgccgaccattgccatggccgccagcgtcctgctgctggtcccgggttttccattaatcaatgccgtcgccgatatgtttaaagggcatatcaataccggactcgcccgctgggcgatcgccagcctgctaaccctcgccacctgcattggcgtggtgatggccatgaccgtatgggggctgcgcggatgggcataatctcatttatttttgcgctggcggaagacatgctgctggcggcgatccccgccgtcgggtttgcgatggtctttaatgtccctcagcgcgctctgcgctggtgcgcgctgctgggggcgattggccatggctcgcgtatgatcatgatgagcgccggttttaacattgaatgggccacctttctcgccgctctgctggtgggcagcattggcattcaatggtcgcgctggtatctggcgcatccgaagatttttaccgtcgccgccgtgatcccgatgtttcctggcatctcagcctacacggcgatgatttccgcggtaaaaatcagtcattttggttattcagaagagatgatgattttgctgctgagcaattttttaaaggcctcttcgattgtgggcgccctttcgattggcctgtcgatacccggcctgtggctgtatcgtaagcgtcctcgcgtctaaccccgacgtcgcggttaatccgcgacgctccttccgcgatagcctctgtgctactatgtgcagatcaccccactctttgcagttcagagttgagatagagttatgtcttcgcgaattttaacctcccattttagcggcctggaagagttcctccagcagcacgcggcgctgctggcaaaatcgactgacggcaccgttgccgtttttgccaataacgcgccggcattctatgcgctgacgccagcgcggctggcgcaactgctggagctggaagccaggctggcgcgccccggcagcgacatcgcgcttgacccgcagtttttcgaggagcccgccgcggcgccggttgcggtgccgatgggcaaatttgctatgtacgccgggtggcggcctgacgccgattttcagcgcctggccgcgctgtggggcattgccctgagccagccggttacccccgaagagctggccgctttcgtcgcttactggcaggcggaaggtaaagtctttcaccacgtgcagtggcagcagaagctggcgcgtagcgtgcaaatcagccgcgccagcaacggcggacagccgaagcgcgatgtgaacagcgttagcgaacccgacagccatattccgcgaggtttccgaggatgagcatgaaaaacgttggcgacctgatgaaacgcctgcagaaaatgatgccggcacatattgaaccggcgtttaaaaccggcgaagagctgctggcctggcaaaaagagcaaggccggctgcgttccgaagcgctggagcgagagaatcgcgcgatgaaaatgcagcgcaccttcaaccgctcggggatccgcccgctgcatcagaactgctcctttgataactatcgcgtcgagtgcgaggggcagatgaatgcgctcgcccgggcgcgccagtacgtggaagagttcgatggcaatatcgccagctttatcttctccggtaaaccgggcactggcaaaaaccacctggcggcagccatttgcaacgagctgctgctgcgcgggaagtcggtcttaatcatcaccgtggccgatattatgtcggcgatgaaagataccttcggcaaccgggaaacgagcgaagaacagttgcttaacgacctcagcatggtcgacctgctggtgatcgatgaaattggtatgcagacagagtctcgctatgaaaaggtcattatcaatcagatagttgaccggcgctcatcctccaaacgacctaccgggatgctcaccaacagcaatatggaagagatgaacaaactgctcggcgagcgggtgatggaccgtatgcggctcggcaacagcctgtgggttatcttcaattgggaaagttaccggcaccgcgttacaggcaaggagtattaagagatttccgggcgacgacggcgttatactaaagcgattattcagtcacgcttatgagtccgtctatgaaatcgtttaaaaatagcgttgttgccgcgcttgccgttagcgcgtttaccctctctggcgcccacgccgcctcctggcaggattcccttaacagcgctgccagccagctcagcggcagtaacgcccaggccagcggcggcatgtccgtctcctcgctaaccagcctgcttaacggcagcagccaatccctgaccgccagcagcatgaataatgcggccgggatcctgtcatattgcgcgaaacagaagctggcctccgtgaccagcgccgataacgtcaaaaatcaggtgctggataaactggggcttagcacgccggaaaaacaaaaacaggacaccagctatctggatggcctgcaggggctgctcaacagcaaaaacggccagcagttggacctgaatacgctcggcaatagctcgctggcgaaacaggtaaaaaccaaagcctgcgatctggtcttaaaacagggtgttaatttcctctcctgatcctgactgacaaggccgcatttgttgccttcgcggcggcgccgcggcctgaaacgcttttttttgcagttttcctgttccgttttcccattccacccgatgcgatgccgatcaaaaaaggcaacttctaaaccaattctgaataactgcacactttcatgacgctagaattgcagcaagatggcgctgcaattacagtggggcttgaaaagtaatctgttctgccagccgataactggcattaatgaggatgagctgtgtcagagttgttatccatcgccttatttttagcttcggtggtgctgtatgcctggaaagcgggtcgtaacacctggtggtttgccgccacgctcacggtgttaggcctgttcgtggtgctgaatatcaccctctacgccagtgactacttcaccggcgacggcatcaacgacgcggtactctacactctgaccaacagcctgaccggcgccgggatcggcaaatatatactgccgggggtcggcgtggccgtcgcactggtcgccgtctttggcgccctcggctgggtgctgcgccgccgtcggcatcatcctcatcacgtcggttacagcctggcggcgctactgctggcgctggcctccgttgatgccagcccggccttccatcagatcagcgagctggtgaaatcccagtcacgcgagggcgatccagactttgccgcgtactataaagagccgtcgaagcaaatcgacaatccgcagctgaacctggtctatatctatggcgaaagtctcgagcgcacctattttgataacgacgccttccccaacctcacccctgagcttggcagaattaaagctgaggccattgatttcagcaataccatgcagctgccggggaccgattacactatcgccggcatggtcgcctcacagtgcggcattccgctgttcgcgccgttcgaaggtaatgcctcagcctcagtctccagcttctttccacagaatatttgccttggcgatattctgaagaactccggttacgagaattactttgtgcagggggctaacctgcgctttgccggcaaagacgtgtttcttaaatcccacggcttcgatcacctgtacggggcggaagagctaaaaactacggtggcggatcctacctaccgcaacgactggggcttctatgacgacactgtgctcgacgagacctggaaaaaattcgaagagctgtcgcagtccgggaaacgcttctcgctcttcgccctgacggtggatacccaccatcccgacggttttatctcacgcacctgcgagcgtaaacgctatgatgtggacggcaagaaaaacctctctttcagcgccgttagctgcagtcaggaacatatcgccgcgctgatagagaagattaaagcctcaccctatttcaaaaacacggtcatcgtggtctcttccgatcacctggccatgaagaacagcgcctgggattatctcaacaagcacgatcgcagcaatctattcttcgtcctgcgcggcgataaaccgcagcaggagaccctggcggtgaaacgcaacaccatggataacggcgcgacggtgctggatattctcggcggcgataactatatcggcctcgggcgtagcagcctctccggccagtcgctctccggtattttcatgaatatgaaagagaaagtcctggcatggaagcctgacgtgatccgcctgtggaatttccccaaagaaatgaagaatttcaccatcgactcgcagaaaaatatgatcgctttctccggcagccatttccgtctgccgctgctgctgcgggtatctgaccagcgcgtagaaccgctgccagagagtgaatactctgcgccgctgcgcttccagctggccgatttcgcgccacgggataatttcgtgtgggtcgatcgctgctataaaatgggccagctgtggtcgcctgagctggcgctctccaccgactggtgcgtctcgcagggacagctggggggtgagcagaaggtccagcacgttgataagccgcagtggcaaggcaagaccgccttcagggacacccttatcgatatggagcgctataagggcaacgtcgatacgctgaaaattgtcgacaacgatattcgctataaggccgacagcttcgtgtttaacgtcgctggcgccccggaagaggttaaacagttcagcggtatttcgcgtcccgagtcgtgggggcggtggtccaatgctcagttgggcagcgacgtgaagattgaatataaagagccgttgccggagaaatttgatctggtgatcaccgccaaagcttatggcccaaacgccaataagccgattccggtgcgagttggagaaagtgagcaagtgctcactctggataatgacgtgactaccacgacgctgcattttgacaacccaacgcgcagcaacacgctgatcatcaccccgccggacccgcaaaccactaacgagggcaatatcctcggccactccccgcgtcagttggggatcggcatggtggagatcaaagtggtgaaaagcgaaggctaacgcaatcctgcccggcggattttcgcgccgggcagcggttgtcgtggcaggacgttaaccacacagcggctgtagttcatcagccgacagtccggtgatcttctgtaccatctctttgtcgaggccattctgtaacatactgccggcaatgcgcagcgcctcgcgtcggctgccttcctgcaagccctccaggtgcccttcttcccggccttcttcccgaccttcctgcttaagcttttgcgcgatagacatcaatgtctcctcatactgtggcagacggcgggccagccggcggagaaacacgcccggctcggccgtattaccgtactgcagcatatagtgaaacagcattctcaactgccgacggttagtgtatcccagcatcacaacggccgccaacgactccgttatgccgctgagatcgcgctggcgaatatgtttttgcatcagctccagcaaggcgactcgccgatgttgcacgatgtcatcgtccggcatcaccgtcacgtcgatcaatggaaacggacagccatacagcgtcttcgccagctgcgggtcggcaaattcatccagccagttgagggaaaaaggatacggactggttgcaccgtgataaaaaagcatcggcaccaccagcggcagcgttttgtgcccggcatccaggtggcgctgcattgcggcaatcgcatagcgcatcaggcgaaaggccatatggctatccggtgagctctggtgctctatcaccacgtaaacataccccgtgccgcaggtggtctgcaccgaccagaggacatctgaataccaggcgcgcagatcctcatcgataaagctcgccgattgcagcctcagggtagagaaatcgcaccgctgaaggatcgcttcgggaaggtagagggtgaggaaatcagtcgctgtctccgggtgacgaagaaatcgcttaaagaccgcatcgtgcggcgtcgaggtcatccgttttttcatggccatccgcttgcctgaaagagaaggtaagccggactctatcaccggtttttacccggttgggtttgacgacaattttctgggaagcgcctcggagaatagcatggcggccagcccggctggccgccatcaacacggcttagtaatcaaactgccggtagtaacggcggatattgaggtcgtggccggtatggtgttcaaagtgggccgccagccggtccaccagcagggtggacaccacgcacggcgccataatccagcggaacgcgtcatcaatgccgttcagcggatagtcgcgcgggtcgataaccaccagatggtcagttattttttcggcaaaacgctcgacgcgttcgtccagcgcccggcatctcccctcgcctttcaccagaaacagcggaacctctttttccagcagctccagggtgccgtggaaaaattcagcggagctcaccgacttcgtccgcttccactgcatctcttcgagaatacacattgagaacagatagacctcgccccacatttccgcgccgccaatccacatcatatagtcgcagtcatggtattgcgcggcaatgctatccgctcggggatcgaactggcgtttcgcctgcaggagattttccggcagtaactcgagctggctggcaaatcgcgcataatcagcaaactcgccgtgacgaaaaatgacgcggaagaataaccagtacagcagcatatattcatattccacgccatttttgtggcacatcggaatatgccagctggcggcggcagccaatggcgagtcggcgtgacgagtaatagccaccacgcggatcccctgtgccttgcaccattcggcaatggcgaccgactctttggtatcgccggatttagataacgtaacgacaaccgcatctttatttaattttttatgtccgcgatggattaactccgcggcctgttcaagatataccggcacgctggttaattctttggcaaattcattaattgccatcatcggcgccagggaaccacctaccgaagcaaaaaataatgcgctacagccgctgtcataaatatcgtcggctacggtttcagcctgtttacgcgcagcgatgatctcgcgagcactggtcaggtactcgtcctgattaaaacccaacatagttttctcctgaattttcagattttactttttaagacgcggtcaaaatcgtcgaaaatacgtttagccagatcgatgcctttcagtcctgcggtatgccaggcgagcatctgcactgggacaatcagcagcagaggcgccaggtgatgctcgcacggacagtttagcgccagcgtttgagcatcctcttcgtcacccagcgtcagggtaaaggcccggccaatggacggcgccagatagtcgcgcagcgcccgggttcgcgcgtccggcgtatcttcaataaacagcatcacatggcgggcattggcttccagataggggccatgcatataggcttccagctcaaagccgctggaaggcacgcgcaccgtctcggtaaatttggtttcgaactccttcgccacgccaaccagcgcgccgtagccggtggcgacaaagcgctcgccgctgcgcagcgtttcgctatggcggtcaataaagcgcgaggtgcggacgataacctccgggatcgccgctaccagccgctgcaattcagcgagatagtgctgctcctcgacctcgctggctttctcctgcttacgagcaatgatcagcgctatcagcaacaggttgagcaccgtcgcgctaaagccgcgggtcacaaaccctacgctctcgatcccggtattaatatccagaacgccatcgctggcgcctcctatcgggctttgcggatctgaggtcagggcgaaaaccgacttgccggaagcctgtaccttacgcatcgcctccagcgtcgacgcgctttttccgctctgtgaaatcgccaccaccagatcggcatgcgggtcgatcgcgtcgtaatgggtgaagttgtacggctctttaatgtcaagcagcacaccgaagcgttgctcaaagaaatagcgcgcgcacagagcggcattcagcgacgatccggtcgcgagcaataatatccgccgtaccgggtgctggcgggcgaaggtttcaatcggcgctagcttttgtcggtagtcgcgcaggatctgcgccaggcaggctggctcttcactgatatatgtcatcattgttggtcgcatagctcactcccgttaaaacaatccgatccacgaacccagaatgcccaccagcgccatgccgccaataattgagagcggtttaactttccgtcccagtagccagtagacgatgccaaaactcaccaacggcagcatgcagggcagaatgtcgttgataatgtcctgtacctgggttttggcctccccggcgccgaaggagagaggaatggtgatatcgatcattgaagcggtcatcgccccgactaccatcagaccgataatcgacgccccgtaggtcaggctctccatcattccgctcttctggatccgctgcaggaccccggtgcccagtacgtagccccagcgggtaaaacaccagcgcaccagaatgtgcggcacgttaaacaccagcagaaacaggatcggcccgaggatgttgcccttcagcgccaggctggtgccgatcccggtggcgatgaggcgcagcgtcccccagaagaaagagtcacccagcccggctaacggtcccatcagtgaggctttgacgttatcaatcgcagtggcatccatgtttttctgctgactgtttttctcttccatcgccgtggtgatccccagcagcagggtgacgatatgcggcgtggtattgaaaaaaaccagatgccgcttcagcgctgcggccagctcctctctgcgcggatagagcttcttcagcaccgggatcaacgcgtaaacaaaggcgagattcatctgccgctcatagttccacgagaactccatctggaaagagcgccagaacacccggcgtaaatcgcgcggcgtaatccgggtttcttcctgcgcctgcggctgcagggtctcttcagaaatcatcttcgtcgtcatcgctgactccttgttctgtcgtgatacgaggtgaattcaacgcggtgacgttaaccatgactaccgccacgatggcgccgagaatggcgataccggtcaccgggattttcaaataggccatcagcacaaaaccgaggaaaaaatacggcgccactttcttgttaatcagcagcctggcgagcatcgcgaagccgagggccgggatgatgccggtggcgacgctgagcccatgtttgataaattccgggatcgtatcgagcagggatttcaccgcgttgctgcccaccaggaatgagacggtgaccaccgcggcaagcatcagcgacaggccgaatccggcaatcaaatgcatccgctcaatgccgcggagatccgcccgttccgcatacccgtccgccttttggctaagcattggaatgaacatccccagatagatatttttcaggatcaaagtcagcgtggcgataggcaggccaagcagcaacgccgtttctgtgcctgcgccagaggtaatggcgaacgccacgccgagaataccgccggtcacgacgtcgggcgggatcgaggcgccaacggagaaagagccgataaacgccagctccagcgtcgcgcccataatgacgccggtctgtacatcccccagcaccagcccggtcaacagcccggtgacgataggccgtgaaattagcgacgtccctaaggcatattccgattgcgcgataaacgccaccagacccagtaagagagcctctaccataatctgtcctccggaattacacgcattccgcaaaaagctgtttgcgatcgttcgggacctggcgaatctccacttcgacgcccttgcccaccagttgttgtagctgttctatttctgtcggcagtaaattaatcgccttagagatatttttactgccctctttagcctttattccgccaagatttatgctttttatttcgtcgatggcgctggcaatacgccaggcgtcattaaccgactccacaacaataaataaattatatttatcggtaaccccgctttttattgcctcaatagaatcatttacatttttaatcaccagcttcaccgagggcggtttggcaagcttaatggtggttttccgcagctcatcaccagggacgctatcgttggcgattaaaatacaatcggcgccgacatattgggtccaggaaaaggccacctggccgtgaagtaatcgatggtctacccttaataatgtaatcatcatgcttcctcatttcagaagtctttatccatagtcatcgcgctggcaatcgtttgattgcagtactgaatgctctctttggcgtttgttaatgcctcggtaattaatttttcggtatcgtcttcggctgcggaaatcagcaagtcaataattaacggcagatttaaaccggataataaatggaaatgtgggcgagataaaaaacgaacaaactcgttattcacgctaccggcaaaaatatccgtaatcacgatcagctcatcctgcgccgggaaacgcgccattagcgcttccacctgctgcgtcagatcggcctcttcttccacgtaggcacacaaggtatgtatatcgggttgtttaccgaggatcagttccacggagttcaacaaaccgttagcaaagctgccatggctggcaaaaatatagtgtcgtttcatccttacctcgaaagcgcattccactgctttcttaattgcaaccgacgtgccagaaacagtggcgcgtcggctaacgcaaggataaaaaagaagagatgtgttaaaagtcttgatcttcctgaataaattctgtttcccgcgtcaggatatcgtgaatgtagcagagctctacaacgggaattttgacactatacccgctctctatgacactaaaggcctcgcgtagcgtagccagctcgcgatccggacactgccctccagtgtattgggctggggaagcgtgacgaattaatcgctctatcagacagctgatatgcacatacagcgcgaccttacgatcgttaggtacatcgcgcccggccagatgctcatagcgcagcaaaaactgctcaacctggttgatcaccttagccgtatcgaggatcgtcaccgactcgatcaaccggcgcagcgaaaagtttttcaggatcaggttgttgatctcgctgacctgctccgccgtcgccagttcgccaaaaatgcgcatcagcggacgactcccttcgccagagatcagcgaatccagcgagatccagggtagatcggcaagatgcggatccagggtgccgacgatcgccagcacctcatagcggcttagcatcggctcccgtcgcgcgtgatcggcaagggtctccacatcacaggccacaatatcaatgccaagcgcttcaggaatgctggcttttaacagcgccgacagattcgccgccgcgcccagaccggtcgcgcaggtggttaaaatcgcccgcggcttatcggtttgcgggtaatagagctggtgctcaaccgcaaggtcatcgccgatctcgcggacgatatcttccagcataacgccctgcaaaatgcgctccccgacgtacatcgccataccggtggagacattgttgatgatcgccatcggcgtactcaggcgacgattaaaatggcggtgaatggcgttcagcgatcccatgtcgaccaggattatcaatcctgatgccagggcatggctctctatgtaggccatcacctggttagcgatagcctccggcgtcacgtccagcggcatatcgaatgactcaaagagctggcttttcagcaagcggtttgccacgttggcgatgctgctggcggtagcgtaaccgtgagcgagaattatcgcccgggtcacctgctgctggctgatggcgccattcttgtggaaccacagcactaacagcagcaggtcgatacgctggggttcaatatccagcttcagcgtcaacgcaccgaggatcgcttcgcaaaagcgatacagcagcggaaacttctgtaccaggaagtcctccagctggcgggctttttcattgtttatcgtggactgcggctgtcgggatcggtggatcaggtagtggctcagcgcgtagaggcagttgccgttaaactggatattgaagcgcttttccaggcgataatactcctcccgaacctgatgagcgatcagcagcagcatctgcgagctactggagtcatgattatcaaagatcagccgatcgaagagggtttcaatctcttcccccatgctcctttgcgcctcttcccagaccgtttttttattcagcaccgcttcatactgcgccagaacccgacactgaacgtcatagatcagcccctgtaccgggtcgcgcgcacgcagcagccagaccaggctggtctgcggctcgataagcagcggctcctgcaggcccatcgcttcgctgagcgctggcgtcgcggccatgacattctccggcagatcgtgcagcctcacggtcagcatttcgcggcccggagacctggcccaggctgacgccacggcgtatttcaccacattcttcagctcgccgacgttgccccgataaacatactgcgtcaggacctgcaacagtcgcggcgttagttgcagccgggcggcaagcgtgcgcgcctcctgccagaaaaactgtagcgttagcgcctccttctcctcgcggctacggtgttgaagatcgggcaagctaaccaggatcggaattcggcgcaggaaggtggtgagaaaagtgctgtgaatatcttcggtggtggcaaacaccaaccgcagcgaaatcggcaagccttgcgcggtctcccccacccggtagatctccttacgatccagccaggtgaacagcttctcctgcccctgagcatccaggcgatggacctcatcgagaaacagcatcccgccgtttgccgcctcaaacgcccccgctttatcgctctgcgcaccggtaaacgcgcctttgacgtagccaaacaggttggcggccagcagctccggattactcgcatactgcgcgcagttaaagctcacaaagggggcatcgggcgccagcagcccctgggcgatggcgaactcatgcatcagctcagccatatagcttttgccggtcccgctgtcgccagtgatcagcagcggtagcccgccgttaggataaaacagcgcggttttcatctgctcaatcggtttacgcaggctgccgtcatgcccggtcagcaacgaaaaatggtccgcctgctccggctggcggtcgctctccgcgagtaactccgccatgctggcatactcactgcgagaaagcgggtagaactgctggcaaaaggcttttttatgcagaaaatagaccggccgggtgttgattttcaccagcacgtcctgagcgaccagctgattgagataatggctggcggtatttctttgcatcgcgaaacgccgggccagccagctggcggtaaagacctcgctcaggttatccggatcgaaaaaatcggtctgattttgcaaaaaagccaacagttccgttttacgcatcgcatccccctcttcgccattacgaagggatatgatgcgggaaaagagaggcttatcgacggcccgtgctgtttttttgcggtccagcgcacactcctggctaagccgacttcgcgtcggccagatccatcgtcatttcatactgctgcagcgagagcggcgtataaccggccgcggcaaacagcggcgtaaaagtttccgggaccgtcaccgaagtaccaatgcccgggaactgctgcgccagcgccatcagcagctcacgcgccagcccctggcggcgggcggcgggctccacccacaaaaacgacagtacagggcgcgagcccgccgtcgttagaaccgcgaaggcgcgctgttccagcgtcacgacctgacatggcagagtggcgaaggtaagcggatccagcagccagggaagctggctgttactctcctcaatggcgcgccgaagcagggacagggtgggataaagctgtaatacgcccggcaccgggggcagaagttctgtactcaggtagccgcagagcccatagcgtcgcgtaaagcccagcgactgatacagcgcgacggccgcatggttatcgcggatcacctccaggaataccgtctcgatcccctgctgttgcaaaagcatcagcagctcctgcatcagtttccggcccaggcctttgccgcgccaggacgggcgcagggcaaaggccgccaggcgagcggcactcccccggcgcgcgacgatcgcgatcgccgccggttcatctccggccagccagacgcgggaatcgaccaagctcatcccctcggcgctaaaacgctgaacaaatccctctaccgactgggtaacaggcaccaggtaggcttcaaaacaggcgttgagaatatccgttaactgcacgctgctgaactgcgtggcgggaacggcggtcagctccatacttttctcccgaaggctgctatgctgaggtgatgaaaactaacactataactgccggtgccgtattacgcctgactcaggagagcgatatcgcccttctgcccgccattgaacgttctgccgcccaggcatttcgccagatcccttctctcgcctggctggcggacagcgaggtgattagcgttgcgcgccatcatgattatctggaaacggagcatagcctgctggcggtagccgccgggcaacccgttggctttattctgaccgaaccgctcgacgatgcgttatttatcgtcgaagtcgccgtccaccaggcctggcagcaacagggcatcggccggatgctgctggagcgggttatcgagagcgcacggcagatgggctacccggcggtaaccctcaccaccttccgcgaggtgccgtggaatgcgccgttttatacccgtctgggattcgccatgctcgatgagctgaccctgcccgccgggctggcggcaaaaagggaacaggagacccggcacggcctgccgcccgagtcgcgctgcgccatgcgcctggcgttgtagacttcagcactgatttcagcggcgcaatatggtacaaagtaccattcaaaacttacccgttgttaccgtatgtcctggtcaatcgatattatttcctgcataaccgatcgctttgtggaactcacggcgaccgaaaaacgcattgcgcagtttattctcgatgatgtcgcggcggcggcggagctgcccatcgccgagatagcgcgtctgacgcaaaccagccaggcttcggtcacccgttttgcccgggcgctcggctgtaaagacgtccgcgagctgaagatgaagcttgcgcaatctcttgcggtcggccagcggtttatcctcgatgttccggatctcgaaggcgtccaggggatctatgagtcaatcatcagcgtactggagaccaaccggcgggcgctggatatcgaggcgctgaagcgcgcggtgagctggctgagcgatgcgcggcagatcctcgccctagggatgggcggcggttcgaccatctgcgctcaggaaattcagtatcgcctgtttcgcctcggtctgccggtagtcagccagagcgatggtctgctggtacgcatgatgagctcggcggtgacgccgcaggatgtggtgatcgtgctgtctctgggcggctatacccgggaaatcatcgagagcgcggcgattgccagccagtacggcgcgaaggttattgcgattacccccgccggaacaccgctggctgaacaggcggatctggtgctaccgctgctggtacgggaaaacgactatatctttaagcccagcacttcccgttacgcgatgctggcgatggtcgatgtgctggccaccgaactggcgatggccaacaaaacccaggcaaaaggcaaattacgccgtattaagctggcgctcgacagccaccgcggcggcgtcgatcggcagccgctgggggactaacttttactggcggagataaacctctccgcctgctcgcgggtacgttccacggcctgtccagcgcgataaagatcgctgcccagaccggcaccggcgcaccccgcctgtatccaggtcgccagattttccggcgtcacgccgccgaccgccagcaccggcacctccggcggcaacaccgcttttagcgcgcgaatatagtccgcgccgaatgctgatgacggaaagattttcagccattgcgccccggcatccagcgcactaaacgcctcggaggccgtcgcgcagccggcgcacaccagcatccccttatctaccgcgcggcggatcaccgccggggccgtattgggcgtcacgataagtttcgccccagcttcagcgagaaaatcaacctgttcaaccttcagcaccgttcccgcgccaatcatcgcccgctcgccaaactgacgcaccatcgccggaatactttgctgccagtccggcgaattgagcgggatttcgatatagcgaaagcctgcatttattagcgtctcaatatgatctgccgcctcagcgggttgaatgccgcgtaaaatcgccaccagcttaatcttgtccatcaatcatcctcgctatacccgaaagaaacgccgcctcgccggagcaacaggaaacggctaacccacgcgccgccatcgcctgctgataacgggcgttgagcgagtgctcaccaaccagcaccacgcggctggcgcgatagcgttcgctgaatgtcgccacctccgcgccaatcaacagcccggagagataatcgctcaccgaagtcgccgccagcgcgcctaacacccgcgcggcgcgggcgctaaaaagcccggacaataacgccggctgatttaaccctttttccataccgagggcgaaagcggcttcatccggcaactgcgcaggcagttgctggccgagcagcgaatggttaagcagcaggtgatgcagttcgccggtcatcgccgtggcgaactggcgcaccacgccgttttgcacctgcacccatttgcagtgggtgccgggcatcacgtaacactccgcgggcatcagttgccaggcgcccagcagctgcgtttcttcaccgcgcattacgtcgtaatctgcagcctgcgccactttcagccccggcacgatccacactttttccgccacctcatataactgaccgttgagcgcctccagcgccagcgggcaggccagataaggcaccggttgccaaccggcatcgctgccgatcatgcccgccatcaccaccggcagcgcggggtcaccgcgccacggcgccatctgctgctgaaataccgcttcggcgcgctgcccgttcagacgcgtgacgccgcagggcagtttcagcttgtcgatgcattcgccatcacgcatccgccatgcccgcagctgggtggagccccaatcgacggcaatatactcgttcatgattaccccttacccgcgtgaggtatgacgtttgccaatcggcagcggcggcggcgttgggcggctttcacgctcgcgggtaatcatctccagagcctgctcgcggctcatgctgctggccggggtcagtaacgtcaccacaaccgaagccaccaggctcgtcagcaccgccggaatacacgggttgccccagaacgccagccagtcgctatccaccagcaccgcaaccgatgccccggcgccgccggccagcgcggcgaccgcgccctgccagttaaagcgtgtccagaaacggccaagcatggtgcagataaacatcccggacataatcattgagatcattttggtgatgtagctgatgatgtcgttggaggtcagggcaaacagcagcgccagcgcaatcaccagaaccaggaagatccgcgacaggcgaatcgctttctccggcgcgggcatatggccggtcaccagggtgtagaggtcgcgcagcatgatggacaccgcggcgatggcatcagagctaccggaagacatattggccgacatcccggcaatcaggatcgccatcgccagcaccggcggcagcacctgggtggcaaacaagaaggcgaagccgctgttttccagctgcgggttcatggtccataccgccataccgatgatcgccggcaggaaggagaagcccagatacagcaggccggtaatggtaaaggactggcgcaccgaggagacggtcttcgccgagtaaatacgctggcgataagaaggcgtcgccagcacgccgacgccaatcaccatcgccaatgatagcgccggcagcacgcctaatttatcgaccgcgaacaggctttgcgccgccggatcgacggcctgctgaatatggctccagccgccaacgtgatgaaccgccagtatcgccattaaaataaagcccacgaacagcacgatcgattgaatggtatcgatccacaccaccgcggaatagccgccgataccgacataaaccacaaaagccagcgcgataataattttcgcgacattaatatcaatgccgctggcccacgccagatataatccgccgcctaatatatgcgcccccagccagccgatagaggcaataaaaataagtatcgcgacgaggtttttaataattttactgccgccggtgtaatacgacatttcttcactcatggtcatgaagcgaagtttacgtaccggtgcgaataaccatgccaccagcaggatccccaccgcgccgccgaggccgtaaagcatcccggcccagccgttgctgtagccaaagccgacggcgccgacgctggagccggtccccaccatggtgccgaccgtcgaaccgagagtgaggatcatcggcagcgaacgaccgccaagtaaaaagtcttcgccggttttctgtttgcgcgaaacgtaccagcctaaggtaatcatcgcgcaggcataaacggaaaaccaaatcataaatgacatattattcatggctcacatccagacgtaataaataatattcgtgccgctgaatattatgagttaacaggaaccatgcctgaaaaaaggcatagcgaacccagtggcaccgatttatttattcactctggtgccgatatcacacttttttgatgctccctcccgcaaagggagggatttattttaggtttcgagcgttattgtcgcgcagcgttaaaacaggtcacatccacttcgactttacaatccaccaccaggtccgctacgcagcagatgcgggcaggcgggttgtcgccaaagaactcgcgaaataccttattgaacgactgaaaatagcgcgcatcggtgaggatcactttaacatgcaccacgtcggccagggtgtagcccgcttcggtcatgatatctacgcagttctgaatcgccagacgcgactggtcgacaatcccgccttccacgacttcgccatttttcatcggcgtctggccggaaacgtacagccagcctcccgcttccaccgcccgcgcgaacggcaggtgctgcccgccggtaccggtaccaccttctacgccataacgcttgatactcatactcaactccttagtccatccgacgacgcaggaaacgccctgcccgtccggtaattttcttatcactgccgtagctcatcacgccgttgaccatcaccgcctcaatgccgtccgccggtcgtttcgggtcggagaaactggcgacatcgcgcaccgtctgcgggtcaaacagcaccaggtcggcaaagtagccaattttcaccagcccgcgatccgccagctggaagcgcgccgccgacagcccggtcatcttgtgtaccgcggtagtcagcgggaatagctgctcgtcgcggctatagtggccgagcacccgcgggaaggcgccccacaggcgcggatgcggcatcggatcgttcggcagtccgtcagagccaatcatggtgaccggatagcgcatcacccgccgtacgtcctgctcatccatgttgtgataaatagcgcccgccggcatcagccgcgccgcggcgtcgtgcaggctcacctgccactcatcggcgatctgctgcagcgttttccccgccagctccggctgcgcttcggaccaggtgatcacgatatcaaactcatcggtcacctgtttcatatccagcgtcgacgagctggcggaatagggataacagtcgcaggcgatatcctgctgctggcgcatctcatcaaaaaaggccagcgtctctttggtacgcccccagttttttgccccggcgcacttgtggtgcgaaaccaccaccggcacgttgccgtggcgaccaatacggaaggcttcgtccagcgcctcgagaatcggctcaaactctgaacgtaaatgggtggtatagacgcccttcccggccgccagctcttccgccagcgccatcacctcctcggtggtcgactggaaggcgctggcgtaggccagcccggtactgagccctaatgctccctggcgcagcgcatcgcgtagctgtacgcgcatgccggcgatttccgtctcgttcgccggacgaaacagatcgtccatatggttattacgcagcgcggtgtgaccgattaacgtgccgacattcagcgatggtcgcgccgcctccaccgcatgggcataagcctccacggtgggatagataaagtgctgctgctcgccgaggagattcattgggtccggcacttccccccgcatggtggcggtcgccgcactgatcccgcagttgccgacgatcaccgtcgtcaccccctggctgagcttcggcaagtactccggcatgcggatcacgttgatatcatcatgggtatgcacatcaataaagcccggcgccagtacccgcccctggccatcaatcacctgctccgccgcaacgtccagcgccggggcgatagccataattcgatcgcccttcaccgccacatcagcacggtattgcggcccgccgctcccgtcgatcaccgtgacgtttttgaaaagccagtcaactttcatagcaattactccctttcgacatgccgataagttaaccatttacaagcgcaaaaaacagtggaaaactacgcaaaactcagatcgttttgtgatacttttattcaaaacgaataacatttttatgttaaaaatatatttatcaaatagttataaatgatacccagcgactaaccgattataaaccctgaaaggatagtgttatgaaataccattcagcaccgatcatcccgcacaaatccgccttcatgtccgcgccggctaatctgctggcggaagaggtctgtctacccgccgcgctgctaaaaaagtcggcactggaaaataatatttcatggatgcagcgctacgccgacgcccgcggcgtatcgctggcaccgcatggtaaaacgacaatgacgccatggatatttcaggcgcagcagcgagcgggggcgtgggggatcggcgtgggcagcgcctggcaggctagcgcggcaatggccagcggcatccaacgcgtcctgatggtcaatcagctggtcggcaaagccaatatgcaggtggtcgcgcagctaaaagcccactatcgggcggtggattttatctgctgcgtcgatagcgaggtcaacgtgcacgccctctccgcattcttcgcagaccagggacaaacgctggatgtgctgattgaacttggcgtgcctggcgggcgctgcggctgtcgtagcgttgatgacgcgctggcgctggcgcagcgggtaagcgacctgccggggctacggctacgcggtctggaactgtatgaaggggtgctgcacggcgacgatccgcagccgcaggtggaagcgctgttacagcaggccgcggcgcttgcctgccgcatggagccgctggttgacggcgaatttattctcaccggcgcgggcaccgtctggtatgacgtggtgtgcaacatctggctggcggcggcaaaaccgcgccgctgccgtatcgttattcgccctggctgttatatcacccacgatcgcgggatctacgatctcgcccaacaagagctgatcgcccgcgatccgattgcctgcgatctcgccggcgatctcacttcagcgctggagctgatggcgatggtgcaatcggtgccggaggcggatcgcgcggtagtgaatttcggcaagcgcgactgcgctttcgacgccgggctgccgcagccgatcgcccattatcgtaatggccagcagttagcgctgcgcgcggagtcgatcgtcagcaccggcatcatggatcagcactgtatgctgcgcctggcgccgggcagcgatgtgcaggtcggcgatattctgctgttcggcacctcgcacccgtgtctgacctttgataagtggaagacgttgctgctggtcgatgacgactacaacgtgctggacgagctcgacacgctgttttgacaggcatccgggtagcggcgcttcgcgccttacccgccccggcgcaaggcgcaaatctcatcatgcaatgaacgactgataatgaccccctgccgttcactctgctggcggcaggcaaaacgccgctcgcccggtagacgcgccccttgttcctgcatacccatgaacagcgtttcggcgcgcgccagctgctctggtgcctgcgcgccgagaaagcgctgcggatccagcgccagaatcagctcgccgccgtaggggagaccgcccgcgccgttatcccacgccagcgattcggcgctggtcatatcgccgctaagcggcccggccaacagctcaaccattgccgccagcgccgagcccttatggccgccaaaggttaacatcgcgccgttcagcacctctgcggcatcggtcgttggctgtccctgactgtcgattccccagccttccggtagcgctttgccggcgcgctgatgcagctggatctcgccgcgcgccgcggcgctggtcgccatatcaacaataaacggcggcttatcccgccgcggccagccgaaggcgagggggttggtgccgaacagcggacgtgtgccgcccgccggggcgacccaggcgtggcttggcgtacaggccagccctaccagccctgcctcggtcaacggctcaatatcggcaaacagcgcggaaaaatgaacgcagcgattgattgccagcgccgcaatgccattgtggcgcgccttctccagcagcagcggcagcgcgcgctcgtaggccagcagtgaaaaagcgcccccggcgtccgcccgcgcaatccccggcgcctagtcatggatctgcggctcggcatcgggcgataccttacctttgcgcagggtatcgacaatgcccaacagccgccacaggccgtgggaagcgcagccgtcgcgctccccggcggtcacattgcgggcaatcgccgccgcgtggtcggcgctaaatccattggcgctgagtacctccagcgccaggtcataagcttcaggtaacgatagagttaccgactccatactgttctcctttactcttcttcgtctccgctaaagttagcctgcggcaggcagctgcgcgcgccccagtagtaaatccccaacgacatcgccgccatccgggaggtgaacggcgcgcggctgaatgcccgcccctccgcgcacagcgtgctgtttgaaaccgccgacggcggcggcgtggtttactggcagaaactgatcctctgctgcagcgcgggcggcctgcaggcggtggcggatacgatgaaccaggccggaggcgacgtgacgaatatcattgagcaagcgctgctcccggcgctggcagcgcttcgccgacgccataaaccgcaccttccggctggcggagtcgttgaaaaacgcggcgacgccggagagcctgctgtgccgttgcgaagatgtgcgctgcggcgacgtagctgccgccgacgactggctgcaggccaaactgacccagcgcccgctggttgtacggctggccgctgccgcagccgagagagccgctgtcccccgcccgcgcggaaacgcttattgccctcgcccggccgagcgccgagccgtaaccgctactcttcttcatcaccgcgcccggcagggacgccaagcgcaataaactcctccagcagggaggtcagttgctgcagcttttccgtggtgaactgggcctccagcaggcgataggtctcttccacctccgcctgggcgctttcgtacagcgcagttccggcaggcgtcagcgagacgtacagcttgcgctgatcgttaactggctttaagcgcagcaccagcccatcccgctccatgcgcgtcaaaataccggtcagactggggcgcaggatacaggcgcgaaaggccagatcgtgaaagtccatcgacggacgttcggcgagaattcgcacgatccgccactgctgttcggtgagattgtgccgtttgacgatcggtcgaaagtaggccatcgccgcttcacgcgcctgcaacaaggcaatggttaatgaatcatgcatagtatcccctcaacagcctcaccaaaaacttattaataacttaataattagcgttaatcctgccatgtacaaccggtttctgcacctgaaaagtaccagtcttttcctgaaaaatattcaacttattgattgacaacaaataagtaattgttatgtaaatattgtgttaatccgatcacaaaacattcacttccagttgctaaacctcagcgcaaagcataaaagatgatcattaacatattaatgaaatccctttgaaccgaaatctgtcccagaggagtggtgaatgaaaggtaccatcttcgccgttgcgctcaatcatcgcagccagctcgacgcctggcgcgaggcgtttcaacaggccccctacaagacgccgccgaaaaccgcggtctggtttatcaagccgcgcaataccgtaattggcgatggcgaagcgatcccgtatccgcagggcgagaccgtacaaagcggcgcaacggtggcgctgattgtcggcaaaaccgcgcgtaaagtggcggcggaagaggcggcgaactatatcgctggctacgcgctggctaacgatgtgagtctgccggaagagagtttttatcgcccggcgatcaaagccaagtgccgcgatggcttctgccccatcggcacgctatcggcggtacgcaacgtcgacgatctgaccatcatcaccgaaattaacggccgcgaggcggatagctggcataccggcgatctgcagcgtaatgcggcgcagctgctgagcgccttgagcgagttcgccaccctcaatcccggcgacgcgatccttatcggcacgccccactcccgcgtcacgctgcgccccggcgaccgggtacgtattctcgccgacggtttcccggcgctcgaaaacccggttgtcgcagaaggagagctggcatgaaacaggcacgcattgaatggcaaggacaggtacgcgacgtgctggtcaatgaacgcgaccaggtgcgcctggacgatggcacggtattaaaagaaggtgaattccgctggctgccgcccgccgacggcacgctgttcgcgctggggctgaattacgccgatcacgccagcgagctggaatttaaaccgccaaccgagccgttggtgtttatcaaagcgccgaacacctttactggccaccagcagcagtcggtacgcccggataacgtcgaatacatgcactacgaagccgaactggtggtggtgattgggaaaaccgcgcgccgcgtcagcgaagccgaggctatggattatgtcgccggctataccctgtgcaatgactacgcgatccgcgactatctggaaaactactaccgcccgaacctgcgggtgaaaagccgcgacaccctgacgccgatcggcccgtggatcgtcagcaaagaggcgatcccggatccgcataatctggccctgcgcacctgggtcaacggcgagctacgccagcagggcaccaccgccgatctgatcttcagcatcccgttcctcatcgcttatttaagcgaatttatgaccctgcaaccgggcgacatgatcgccaccggcacgccgaaagggctatccgacgtggtaccgggcgacgaggtgatcgttgaagtcgagggcgtgggccgcctggtcaaccatatcatcagccagcaagcgtatgaggagacactgtcatgaaaaagattaaccattggatcaacggtaaaaacgttgccggcgcagactattttcataccaccaacccggccaccggcgaggtactggcggaagtcgcctccggcggtgaagccgaaataaaccaggcggtggcggcggcgaaagaggccttcccgaagtgggctaacctgccgatgaaagagcgcgcgcgcctgatgcgccgcctgggggatctgatcgatcagaacgtcccggagatcgcggcgatggaaaccgccgataccggcctgccgatccaccagaccaaaaacgtgttgatcccgcgcgcctcacacaatttcgaatttttcgccgaagtatgccagcagatgaacggcaagacctatccggtcaacgacaagatgctgaactacaccctcgtgcagccggttggcgtctgcgcgctggtgtcgccgtggaacgtgccgtttatgaccgccacctggaaggtggcgccgtgcctggcgctggggaataccgcggtgctgaaaatgtccgagctgtcgccgctgaccgccgatcgtctgggcgagctggcgctggaagccgggatcccggctggcgtgctcaacgtggtgcagggctacggcgccaccgctggcgacgcgctggtgcgccatcatgatgtgcgcgccgtctccttcaccggcggcaccgccaccggccgcaacatcatgaaaaacgccggcctgaaaaagtactccatggagcttggcggaaaatcgccggtgctgatttttgaagatgccgatatcgagcgcgcgcttgacgccgcgctgttcaccatcttctcgatcaacggcgaacgctgcaccgccggctcgcgcatctttattcagcagagtatctaccccgagttcgttaaacgcttcgccgagcgcgccaatcgcctgcgcgtaggcgatccgaccgatccgaacacccagatcggcgcgctgattagccagcagcactgggagaaagtgtccggctacattcgcctcggcatcgaagagggggccaccctgctggctggcggcgcggataaaccgtccgacctgccggcgcatctgaaagccggcaacttcctgcgcccgacggtgctggcggatgtcgacaaccgtatgcgcgtcgcccaggaagagatttttggcccgggcgcctgcctgctgccgttcaaagacgaagcggaagggctgcgcctggcgaacgatgtagaatacggcctggcgtcgtatatctggactcaggacgtcagcaaagtgctgcgtctggcgcgcggtattgaagccgggatggtgttcgtcaacacccagaacgtgcgcgacctgcgtcagccgttcggcggcgtgaaggcctccggcaccggccgcgaaggcggcgagtacagctttgaagtgttcgccgaaatgaaaaacgtctgcatctcgatgggcgaccatccgatcccgaaatggggagtctgatatgggtaagttagcgttagcagcaaaaatcactcacgtgccgtcgatgtatctgtctgagctgccggggaaaaaccacggctgccgtcagggcgcgatcgacgggcataaagaaattggcaagcgctgccgtgaaatgggcgtcgataccatcatcgtgtttgatacccactggctggtcaacagcgcctaccacatcaactgcgccgaccattttcagggcgtctacaccagtaacgaactgccgcatttcattcgcgacatgacctacgactacgacggcaacccggagctgggccagcttattgccgacgaggcggtgaagctcggggtgcgtgccaaagcgcacaatattcccagcctgaagctggagtacggcaccctggtgccgatgcgctacatgaacagcgataagcacttcaaagtggtgtccatttccgccttctgtaccgttcacgattttgccgacagccgcaggctgggtgaggccatcctcaaagccattgagaaatacgacggcaccgtggcagtgctggccagcggttcgctgtcgcaccgctttatcgacgaccagcgcgccgaagaggggatgaacagctacacccgcgagtttgatcatcagatggatgagcgggtggtgaagctgtggcgcgagggcaaattcaaagagttctgcaccatgctgccggagtatgccgactactgctacggcgaaggcaacatgcacgacacggtgatgctgctcggcctgctgggttgggataaatacgacggcaaggtggagtttatcaccgagctattcgccagctccggtaccggccaggttaacgccgtgttcccgttgccagcgcaggcgtaagggggccccatgccgcattttatcgccgaatgtaccgacaacatccgcgagcaggccgatctgcctgggctgttcgccaaagtcaacgaggcgctggccgccaccggcatctttccgatcggcgggatccgcagccgcgcccactggctggatacctggcagatggccgacggcaggcaggattacgccttcgtgcatatgaccctgaagatcggcgccgggcgcagcctggagagccgtcaggacgtgggagatatgctgttcgcgctgatcaaatcccacttcgcgacgctaatggagagccgctatctggcgctgtcgttcgccatggaagagctcgacccgacgctgaactacaaacaaaacaacgtgcacgcgttatttaaataatgtgcaaattgcccggtggcgctgcgcttaccgggcctacaacggccatgaatttgtaggccggataagcgaagcgccatccggcaatacaatgccacaggaatcactatgctcgataaacagacccgaaccctgatcgcccagcggttaaaccaggccgaaaaacagcgtgaacagatccgcgcgatctcgctggattatccatcgatcaccattgaggacgcgtacgccgtccagcgcgagtgggtcgagatgaagatcgccgaaggccgcgtgctcaaaggccacaagatcggcctgacctctaaagcgatgcaggccagttcgcagatcagcgagccggactacggcgcgctgctcgacgatatgttctttcacgacggcagcgatattcccaccgaccgctttatcgtgccgcgtatcgaagtcgagctggcctttgtgctggctaaaccgctgcgcggcccgaactgtacgctgtttgatgtctacaacgccaccgactacgttatcccggcgcttgagcttatcgacgcgcgctgccacaacatcgacccggaaacccagcgtccgcgcaaagtgttcgacaccatctccgacaacgccgccaacgccggggtgatcctcggcggccggccgattaaaccggacgagctcgacctgcgctggatctccgccctgctgtatcgcaacggcgtaattgaagagaccggcgtcgccgcgggcgtactcaatcatccggccaacggcgtggcctggctggccaacaagctggcgccgtacgatgtccagctcgaagccgggcagattatcctcggcggctccttcacccgcccggtcccggcgcgcaagggcgataccttccacgtcgactacggcaacatgggcgccatcagctgccggtttgtctaggagaaacaccatgaataacgcctttaaagacgccttaaaagcgggccgtccgcaaatcggcctgtggcttgggctgtgcagcagctacagcgccgaactgctggccggcgcgggcttcgactggctgctgatcgacggcgaacacgcgcccaacaatgtaccaacggtgctgacccagctgcaggccattgcgccctaccccagccagccggtggtgcgtccgtcgtggaacgatccggtgcagatcaaacagctgctggatgtcggcgcgcaaaccctgctggtgccgatggtgcagaatgccgaagaggcgcggctggcggtcagagccacccgctatccgccagccggcatccgcggcgtcggcagcgcgctggcccgcgcctcacgctggaatcgcgtcccggattatatccaccaggccaatgacgccatgtgcgtgctggtacagattgagactcgcgaagcgctgaaaaatctgccgcagatcctcgatgtcgacggggtagatggtgtgtttatcggcccggcggatctcagcgctgatatgggccacggcggcaatccgcagcacccggaagtgcaggccgccattgaagatgccatccagcaaatccgtcaggccggcaaggcgccggggatcctgatggccaatgaacagctggcgaaacgctatctcgaactgggcgcgctgttcgtcgccgtcggcgtcgataccaccctgctggcccgcggcgcagaagcgctggcggcccggtttacccacaacgcaaccaccacaaccgataacaataaatccgtctattgaacggataatgtggagcgcaacatgactacctctaccctgcaacacaatgataataaagccgttgaagtagaaaaccgggtgatcaaaaagctgttccgccgcctgattaccttcctgtttgttctctttgttttctcatttttggatcgaattaatatcggcttcgccggtctgacgatgggtaaagatctcggcctgacctccaccatgttcggcctggcggcgacgctgttctacgtcacctacgtgctgtgcgggatccccagcaatatcatgctggcgaaagttggcgcgcgccgctggatcgccgggatcatggtggtctgggggatcgcctcgacctgcaccatgttcgccaccagcccgcatacgctgtacatcctgcgcatgctggtcggcatcgccgaggctggttttctgccggggatcctcgtctatctgacctggtggttcccggcctaccatcgcgcccgcgccaacgccctgtttatgatcgccatgccggtgaccatgatgctcggctcgatactttccggctatattctggcgctcgacggcctgtggaacctgaaaggctggcaatggctatttctgctggaaggcctgccgtcggtggtactcggcgtcgtcacctggttcttcctcaacgacacgccggataaagccaactggctggataacgaagagaaacaggcgctgaaggcgatgatcgatcgcgaacgggaacatgcggcgatcgtcccggcttcgccgcgttccacgctgcgcgaagtactgacgccagcggtgctgatgtataccctcgcctacttctgcctgaccaataccctcagcgccattaatatctggacgccgcagatcctgcagagcttcaacaccggcagcagcaacatcatgattggcctgctggcggcgatcccgcagttctgcactattttcggcatgatctggtggagccgccgatccgatcgccgcaaagagcgcaagatgcataccatcctgccctacctgttcgccgcggcaggttggctgctggcttcggcaacgcaccacagcctgatccaactgatcggcattattatggcttcggtgggatcctttaccgcgatggccattttctggaccaccccggatcgggtgatcagcctgcagtcgcgcgcggtggcgctggcggtgatcaacgctatcggcaacgtcggctctgccgtcagcccgctgttgatcggcattttgcgcgataccaccggcagctttagctccgggctgtggtttgtcgccggattactgatcgtcggcgcgctggtgcttacccgcattccaatgagccagcgtgaggacgccgccgccgcgccgggcttagcggcgcaaaaaggccactaaggagcgggtatgtgccagcattccatcgccaacatcgacatcaataaagattacgacgagagtctgggtaccgaagaggtgcactaccagtcgttctcccgcatggcggccttttttggccgcgacatgcaggcgcatcgccacgaccgctatttccagatgcactaccttgataccggacagattgagctgcagcttgatgaccatcgctattcggtgcaggcgccgctgtttgtgataacgccgccctcggtaccgcacgcttttattaccgagtccgatagcgatggccatgtgttgacggtccatgaggagctgatctggccgctgctggaggtactttatcccggcacgcgggagaccttcggcctgccggggatctgcctgtcgctggcggataaacccgacgagctggcggcgctggcccactactggcagctgattcgccgggaatctaccgcccagttgccggggcgggagcataccctggcgctactggcgcaggcggtctttaccctgctgctgcgtaacgcaaagctcgacgatcacgccgccagcgggatgcgcggcgagctgaagctattccagcgctttaaccagatgatcgacagccactaccatcagcactggacggtaccggattacgccagggagctgcatctgaccgaatcgcggttgaccgacatctgccgccgcttcgccaaccgttcgccgaagcggctgatattcgaccgccagctgcgcgaggcgaagcgcctgctgctgttttccgatagcgcggtcaatgagattgcctggcagctggggtttaaagaccccgcctattttgcgcgcttttttagccgccaggtcggctgctcgcccagcagctaccgggcgcaaaaagtaccggtgtcgtaataccccggcggcgctgcgcttgcctgggctacagaccgtagggcgggccagcgccgcgccagccggtaaaagttgcagagatcacaaaattcactcccgcctgaaaagtacccgccgttgtcgcaaacgtcccttcacgacaagcgccataaccgcttcaattaaacaacaaaaacaaaacatatatttaacataattattccgataaatactgaagaggcccctatgaaacctgaagatttccgcgccgacgcgaaacgcccgttaaccggtgaagagtatttaaaaagcctgcaggatggccgcgaaatttatatctacggcgagcgcgtgaaagacgtcaccacgcatccggccttccgtaatgccgcggcctccgtcgctcagctgtacgatgcgctgcacaaaccggagatgcaggattccctgtgctggggcaccgataccggcagcggcggctacacccataaattcctccgcgtggcgaaaagcgccgacgatctgcgccagcagcgcgacgccatcgccgaatggtcgcgcttaagctacggctggatgggccgcaccccagactacaaagccgccttcggctgcgcgctgggcgccaacccggcgttttatggccagttcgagcagaacgcccgcaactggtacacccgcattcaggaaaccggcctgtactttaaccacgcgatcgtcaacccgccgatcgaccgccacaagccggctgatgaagtgaaggatgtctacatcaagctggaaaaagagaccgatgccgggatcatcgtcagcggcgcgaaagtggtcgccaccaactcggcgctgacccactacaacatgatcggcttcggctccgcacaggtgatgggcgagaacccggacttcgcgctgatgttcgtcgcgccgatggatgccgaaggcgtcaagcttatctcccgcgcctcctatgagatggtcgccggcgcgaccggatcgccgtacgactatccgctttccagccgtttcgacgagaacgacgcgattctggtaatggataaggtgctgatcccatgggagaacgtactaatttatcgcgactttgaccgctgccgtcgctggaccatggaaggcggttttgcccgcatgtaccccctgcaggcctgcgtgcgtctggcggtcaaactggactttatcactgccctgctgaagcgttctctggaatgtaccggcaccctcgaattccgtggcgtgcaggccgaccttggcgaagtggtggcgtggcgcaacatgttctgggcgctgagcgattccatgtgctcggaagcgacgccgtgggtcaacggcgcatggctgccggatcatgccgcgctgcagacctatcgcgtgatggcgccgatggcctacgccaagatcaagaacatcatcgagcgcaacgtcaccagcggcctgatttatctgccgtccagcgcccgcgatctgaacaacccgcagatcgatcagtatctggcgaagtacgtgcgcggctccaacggtatggaccacgttgaacgtatcaaaatcctcaaactgatgtgggacgccatcggcagcgaattcggcggccgccatgaactgtatgagatcaactactccggtagccaggatgaaattcgcctgcagtgtctgcgccaggcgcagagctccggcaatatggacaaaatgatggcgatggtcgaccgctgcctgtccgagtacgaccagaacggctggacggtgccgcatctgcacaataatgctgatatcaacatgttggataagctgctgaagtaattcacagcgggaggtcataatgcaattagatgaacaacgcctgcgttttcgcgatgccatggccagcctgtcggcggcggttaacgttgtcaccaccgcaggcaaagccggccgctgcggcattaccgccacggcggtatgctcggtgacggatacgccgccatcggtgatggtttgtatcaacgccaacagcgcgatgaacccggtgtttcagggcaacggcaagttgtgcatcaacgtgctgaaccacgaacaggaaatcatggcccgtcatttcgccgggatgaccggggtgacgatggaagagcggttcgccctcagcggctggcagcagggcgcgctcgggcagccggtgctgaagggctcgctggccagcctcgaaggcgaaattagccaggtgcaaaccatcggtacccacctggtgtatctggtggagatccgcaatatttccctgagcccgcaagggcacggcctgatttactttaaacgccgtttccacccggtgatgatggaaatggaagtcgcggtgtaatggcctcgcctgcctctccccggataacggggaggggctacacagattcgcgttagccttcctgctgggcaaactgtgtcagcactgcgccaccttctggtactttccgcccgtgtcgtagtccgtcgtcgccgtccggctcacctgcgcgctgatttgctcctcgctcgggctgccattccctcccgctacctattacgatttttcttgtagccctggtaataaatccaccaacaaccagtagctatcaacgcccctgtgaaacatgcagcttttgtatacttccatgtatcactccaaatcagctcaaatgggatgtggtaaatcaataagaggtaacctctaatgagcacgtatataattaaaaacaatacgatcattgctacattgcaagcaaaaaatagatagaaaaaaataaagaaccacgattttctattcatttttgtttccctttttggaatttcacacctgttttacccgcttgatcattgaggatctctgtcaccgcactacccaaggcattaccagcaataccaggtactggattaatcggcagcggtttggatattcccatcccgacatctgtccagatccagtctttccatggcttcattggattaaggactttatcaaacggcaattcaactagtttacctgcaccatagctcatcccagaggccaaaccattaattaagccgcctgtaaaaggattatcccctttcaatagctggatgttgcaccacctgccgcattccagctcattgttccctttaatcctgtatttctggtaaaagctccaacatacgtcgcaatgagcacatccgttggattaacttctccattaataagatactgaataccagcatttgccgttccgcctatcgcgccagtaatctgcattcctcccggcagatagattagccccgctgacttccaatcctcttggctataaatagcgctactaattggtaataagtagacaatcttttaaacatgagttaattgccccctcatattcataacatatattaaaaccctttaactctaaaaaaatgaaacaaagaaaatcctacaccacctacagctccaccacaaaagctaaccttcacagctctccatatatcactccagcagataaaatattcaccaccaacgagccaaagcaaaaatgatataaataatttaaagtccacacaaacgacaaccacacttaaggaaacaataaaaaaaatcaaaaaagctacaagtatacgcttaaaaaaatcattcattagtatcacttaacttttcaataaggagttcaactcctttcccccaccgatggcagctgttaccaaagcccccttaggcaatatgcctaacccaacagtatctgcctgatgggctgatactactgcattcccttctgccacatcttcagcaagttttcctttatagtctgtatcgcagtctggcgtctggctgaaccagaacccgaggtttgttccagcgctcgctccgaaagcattattctccacactaatcccaactctgtggatgaatttttatcctatctttgctctaaaatccttttagtttaaatagtctggcaataacaaaaaccgcaccagtgaaggttccaatcacacaaccaattttaatggttttgagtatatcggcttttgtcaaatcgaaagttcctgttagcatccaaactaaaacgtctatagacaaagttatacataggaaactaacaataatcccaagaatacaggcgataaatagaatcagcaggtttagtattttctcatggaaggatttcatttcaatttctcctcaatgattggttcgagttttttcccccatattctgaagagaaagatgctcctatgtcgccaaaactgcctggaatgttactcggtgtaacttcttttaagataccaaagtcacctttaatctcagtatacttttgcagaacaggattaaacttcggatcccaaccgtctttccaccagtttacccctgcatttgtaccccaagaaattcctttgcctataccgtaaccaatgccagcaccaataccatttgttattgccccagttagcggatctttattgtctatccagtttcctaatgcaccacccgcagcattccagccaacggtacctgcgagaccgttacccatgctgataacgttcacccaacctgctatagccgcatttgccggatctatcgtgccatccgccagataactgatgcctgcattcgcaccggctccaagaccccacatagcctgaacgccacccggtaacaaggtaacactacctgtagctagcgcaagtccaacagcatcccgctcatttatcgctttctgacatgcgctcccgccaggattatcagaacaactcgccatatcgacaccatgctgacgtatccatatggcctgagcatcttcacttccactcagtaaattattctccaccgcgttcttcccggcctgcgcacccgccaccgcatccgcgctgctgcctccgctaagcacccccatcagtcccgccgccagcgtactcagcgcgcttatcgtcgacttctgctcttccgacagctcttctgtcttaacacccggataatattccgccgctatccagcgccccagcagctcgccactcactgcgcctgccgctcccgccagcgcgctgttatttcccgatgccgccgctatcgctccccacaccgcgtgcgccatcgcattggcttccacattcaccttacccgtcgcgctgtccgtcgtctggctgtgaatgatttccgccacatacggactcactgccccgctcgccgcctgcgccaggttgccgcccgccagaccctgcatcgccgccgttaccgcctgcgccaccttctggtactttccgcccgtatcgtagtccgccgtcgccgtccggctcacctgcgcgctgatttgctcctcgctcgggctgccattccctcccgctaccagcttcgcccgcgccgccgggtcgctctgcgccgcctgcgcgttcagcttgccctgcgtcaccagcacatcactcacctggcgcccgatttcacctgtcttctgcgctgtcgccagccggttctgctctttctccttatcaaatatcggactcagcgtctggttcgcatgcgccgcatcccggcttaaccccgtcacgtcctgctgctgattcgcgccgtcgcggataacgatactgccctcgctcaccgccgcccgcgtcagcgaactgtcgctgccgctcccgttcgcccccatcagcagaccgctggccgcattcccgaggaactgccctgccacgctaccgctcgtgctcactcccgcgctctgctgctccacgctgtactcggcatagtttttaatatcccggaaacccagcgtcccggtatccagccggttcagctccgccgcctccgtgctcgccagcacgctgccattcagctgcgtatgcccgcccaccttcacatcaaaaccaccctcaccggcaaaaatccccgtctgcgcctccaccgacgcccaggtgctgtgcattttgctctggctcaggttaagagaccccgaaccgccgcccatgctgccgctcgcccccacgctgccgctacgctgcttcgaatcgtagttatcgctgtcctgctcgctggtcagcgtcaggttacgcccgacgtccattgtcacctgatgaccgctcacctgcgccccggtcagcgtcgtatcgcgaccgctgacgatagtcacccgctcaccggcgctgagggtcgtttcgttatgcgtcaggctgttgcccttctcgtggcccttcgcggcgttggcgctggcgctgaccgtcagcccgttcgcgccctgaccgaagttaataccgacgccaaacgaactcccatggctctcgtttttaccgctcagggtgctggcgttctccgcagagaataaattcacatcgcgcgcggcattgagcaatgcgctgccgctggcctgcagctggctgccctcaacgttgatatccgtctccgtggcgataatgctgagattgttgccggccatcaggctgctgccgcggctggtgttctgcgtttgtcgctgagtggatttcgaggactgtctaccccaggaaaggttgacccctatcatgctctccggactggaatccgcagtctgcatctgcgatgcctgatacgcctgtacgcccgataatgccgactgcagcccgctcagcgcggcgagacggccattgctctcggtgctggcctggttggcgctggaaaccgcggtattaatggcgctgcccaccatcccggataacgccagcgtcaggccgctggttttctgctccacggtatgggtctgggtgctctggttttccgctgccagaatattcacggttttaccggtcaacgccatattgttgccggccaccaggtcagatccctgaaccgtcaatacattaccggcgctcaggctaaggttgccctgtgagcttccgacggtactggcggcgctactcagcgccgtcgtcacatcgttggctttcagcgacgaactgccgacgctgaagccgacaccgccggtgccggaaaagccgctatgtttctctttacgtagatggttttcctggcgactctcctcggcggtggtaatggtcaggttacgccccgccacaaggttgacgtcctgggtgccggcaacactgctgccggataccagcaggtcgcgcccggcctgcatcacaatacggtcaccgctaaaattgctgccgatggcgttctgcgcccacacttcatcgtgagtggtgagcgagcggcgagccagcaggccgctgctgctttgatggctattttccgtcaggtgccatgaggactcgccgctgctgaggttaatatcattgccggcggcaaccgtcaggctgctggtcgccgtcacgctggcggcgcgggcaatcatatcgtggccggcggacagtgccaccgcgccgccgttaatttgcatgccgatatcactacgctgagtcaaggaacgatcgttgcctttcccccagtttccgctttcgctatgggtggtggcgagcgtctgcaggttgagatcgttgccggcgataatctgcgtctggctgcccgccgcgctgttactcaccatgcttgccgtcagattaatgttatgtaacgcctgcagccccaactggccgttttcattctggacataaatccccgccggccgatcgaggctgatgttacccgggccgccgccgagggtgctggcgctgttgatatcacgcccggcttgcgcgatcaggctatcgccgccctgcagcgttccgccaatattgttgatatcagtacgcgcgtttagcgtgagctggttgccgccgatatagccgctgttatgaatgttttccgcggttagctgggtcacgccgcggctgtggatgtgcccgctgttggtcacatcacggctcacgctgaacgccacgttttcaccgccgagcaacgcgccgctgccatcgagatcgcccgctttaacccgcgcataaacctgcggcaccagcacctgctgcacggagccatccgttagcgtgacctctctggcgaccagccagaccatatcgctggtcagcagcgccatctgcgctggcgtcagcgccaccccgaccgtcaggttgtactgtttggcgaaggcgacgcccgcgtccatcagcgcccgatactgctcttcatcgttactgtagccctgcaggtagcgcccgccgctcagcttaacgatctgctcacgcaccagccgctgttcgtaatagccgtcgccaagccgcttcatcgcctgatcaacgcccagctgattttgcatgtagtcgctggcgagccacgctttaccgttggtaaaacgcggatcggtttccaccagatagcctgctttagcctgcgggtcgatctgatacaggctgctgacaggaagccgggtatccggtgtgacgacgcgaataaccgttccgtcagcgttaaccggcgtcacttccaccagccgtccggcgggtagttcgcctgtttcatcggcgcgatcgcgcggattaatcacgccgctatggccatcaatttgggtattgccctgccacttcatggtttgcaaatcgatggtctgaaccgtcggcgtcggttcatattcgctgctttttttcccctggctggttttggtgccgccaaacgggcggctggtctttttctcataccaacgggtctgggtgccgacgtcggtggtcacccgtttgccggtcgtggcgacgttgtttagttcgccaatcacgccaccgagcgctccttcggcgataatctggctatcgtagttattcagcttatcgctgttgatgatgagccgggcgccggagaggattttgccaggatcgctttccaccacctgcgtttccacaacggtacgctggtactggtattcatagaactcatcgccgcggcttccgtccggcatgatggcgtcgtgaacgccgtatttgtttttatagctggtatcgaccagcgaccagtcgaagcgctgtaccgatcctttcagcgccgcctcatggcgccatgactgctcgaccatcacatctttcgtcactagatggtcgttgtagttattgatttgttggatatcgagcgccatatcaccggcggactcaagcgttgcgctgtggttattaaacactcccgcccggccgctgagcgaaccgtcttcggcaagctggccgccaatggcgagcgtaccgtcgctgtagatcagcgcgtgatcctggttattgagcgtgccgacgcccattgccagcgatgcccgtgcggcaatcgtcgccgccacgccgttctccgcggcgttagtcagcgttgccgcctgcagcgcgacggcgtcgccgtacaggcgcccgctgccgatattggttaacgtcgtggcgacaatatgggttaagccaccgtcaatcagcccccgattgaccagctcgccgttgaccgtcaaatggttctcgccagcgctgatttcgccttcctgacggttatccagctttgccgcatagagattgagcgcccggccggcgctgataaccccctgattaatcagccccagtccggagagattccactgcaggttgccgttggcgatgatcctcccggcgttatgaaacgcctgacgcaacgtgagcgacatatcgctctgagagagcacctcgccatcgccgctgagggaatcggcatcgaggctaagtttgctcgcggcaagtaacgtcccgcccgtattagccagcgccaggttgacgcctgctatttccagagcggcggcggagacgatctgcccctgtcggttatccagcctccggttgtggatggtgatattgagattaccgccggactgcagttctccctgccggttatcaacggtggcgctctgaatacccagggcatcaaaggcggtaattgtgccctgctgattatccagcaaaccgctcgtcgtcaggttgacgctgccccgctgcgccgtgcctacctgcccgtgacgattattaagattttcagcctgtagccggatgtcgccgctggcgatgatattcccctgcgagttattcaccccatggcgcgcagtgagctgaacgtcgccctgcgccgcgctgatttttccgccatggttggtcagattgtcggcgtcaagcttgatattgccatttgcggtaagcacgccttcgcggttatccagcccttcttcagcgctcatggccaggtcgccctgcgccgcaatcaattgcccctgctggttccgaaggctggccacttgtagagaaaggctgccgccagcaacgatattcccttgcgaattttccagctcgtgacgcgtagtgagctgagcattgccctgcgtcgtgctgattttaccgctgcgattattaatgttatcggagtgcaaaacgatattgccgttagcggcaatagtgccttcgccgttgtccagcgcgccttcgctggtaatagacatgccgccgctgccggtatgcagcagcgttccgttttgattgagcaactggctggtgctgagcgtcaaagcatggctgttgctggcaatctcaccgccgcggttatccaatcccgcacgaaaatcaaggcgtagatcgtcctcgcccgtctgctggattacgccctgttggttatccagcgccattgctttcagctcaagcttgctggccgtcaacaggccactgtggttgttgagtttgccgctggcggccaactggagtttttcgctggccgccaccaccgcatctcgggtggtgatatcgccggacgcggcgctgaccacgatccgcgcccccgaggttcgactgttatcaagatccaccgtcctgccctgcgccgtcagcattcctgccgccatattgcggccattcagcgccagcgagctctggctattcagcgtcagcgcgccgctgctggcggtagaaccatcgctatttaatccggcggcgagcgtactgttttgcgcgctacgcaaagcgttggcggcaatccgcgtatcgccttgcgcggcaatcatgccgtcattggttagcgtcgcgctggccgtcaccacgctatcttttccggcgtacagctggccctggttgtgaagatcgcccttaacggacagttgcagattctgcgcggactgaatcacgccgcggttgctgagcgcgccatccgcgctgattgctacgtcccccgccgccgcgccgatattgccggcattgtgaacgcctacgccgcgctcggtaccgacaagacgaattttatgggcgtacatcccgcccagcgcgctgacgtcgatcgccaccgcaggcagcgcactgccgtcggctgattttgccgtcgtccggctgtgcgccgcatcgatctgattacgccctgcggtgacctttagctcctgcgcccaaaccccggcgttgattttcaccgcgcgggcgagcaggtcggtgctgtctaccgagctcgcatcaaggccgccgccctgtacgagaatttcgccgcgattgacatcataaccgctaatctgcccgttaccgtactgtacctggcctgtcgtcagcgtcgcgcggttggcattgatgaacccgcagccgtcgcagctaattccggcagggttagcgataaccacctgcgctttttgtccggcaacctcgatatagccattcagccggctcggatcgcgggtattcacctcgttgaggatcactctggcttcccctttcgccagattcgggttcccggcgaccatcccggccagttgggttgaagtgttagcacggctgttattcagcaccacgccgcgcccatcgacgtcaaactggctgtaaacgttgcgtgaaacgcctgcgccgctcggtgtctgaatattgacctgcggcgtgccattggcgctcttggcgatctgcggttgctggccgcctggcgcatggttatcggcgacaatcgccgcctgagccgaggtaagacaggaaaaagcgagcagaaagctaaaggccagcggcgccagggaggagattaacgtcgacccggttcgcgcgtcggcgccggattgcggcgatacgccagcccgatgagagcgggtcgtttccgccaccaccatcagcatcccgcgagccttattaaatacgattcgataaaagcgtttattcattgccgttactcgtcatccgttgtccaccgcggcgcggaagatcgtccatgtgcgcagcacgcgccgccgggcggcgcgtgagtgaaagtcagtagctccagctgacgctgaaaccaaaagttgccggatcggttttaaagccatcgggtttggctaaagggataccggcgaacaggtcgtagctggcgcggtggtactggccgcgcagccctgccacgcccccggcgaggtgtttgcccaccagcgtttcactgcctgcgccgccgacttcgccgtaatccgcccccagataaaactcctgccccggcaacggagtcgaccaggcgatatcgttacgtacgtaccagccgtgactggcggtcagggtgcgctcgccgtcgaagccgcgtaccgtccagcgattgccgatggaaaacatatccggcgaagtcagcgtcgtgctgctcatctgccgctgatagcggctggtaaagcgaaaattttggccgcccagggcaaaaggcaaattgagctgagcattgaattgcaggattttgctgagggcggttgcttccccccattgctcttccggcgcgggctgagcgccaaaccagcgggtaccgcgctgatagctcactccggcatcgagagtggcgttgcccaggtaatggcgatgctgcagaccaagcttccaggccgccgtttgccgccgctgaacggcaatctcggtgtcgttaatgaagttgcgctgctcgcgggctaacacatcggcgctaagcgtggtcttctgactaccgctacggtgcagtacgcggctcatctggaaatcaacgttcttgcttttaccgctgtactggtaatcgccgttggcccccgccacggtttgcacgtaatcgtactggctggcggttaatccgaactgccagtaacccagcgggaccgaatagtgaccggtcaggttctttgaggatttaccgccgttgccatcgaggttatgtgagccggaaaggtaaaaaagatcgcttaaggctaacgggttatccagggacaacgtcaggttaccctgatagcggccggtggcattagagccggaatcatcgagcgaggcgtcaacgcgccagaagcgttcctgttggcggttaatgacaatatcgctttgcccaggcgtttcgcccggaacaatttccatgctggcctgtaccgtcggcagacgctgcaagttttccagcccctgctcaatatcgcgcaggtccagtagtttcccgtcggtcgccggaaacgcgctcgccagccatagataatcatcgctgtcctgcgtaagcctggcttcacggatataacccggcatcaccaccaggcgcaaaacaccgctttttaaatcctgctgcggggcaaggatccggctggtgatataaccgcgatcgattaatatattctgcaactgggccatcagtagattaatgcccttccctcccagacaacgcccaaccgctttatttgcctggcgctggagcggaagccaatgcggtaaggcatcggcgccctgtaaaataatctgtgaaatagcaaagcaaggttgttccacgggaaataaaccatcatcggtatttatttctcccactgataaatgaatatccggtgacggcggcgcgagctggttttccagcgcctgctggcgctgctgctggttgatgaactgctgctcacgtacggtatccacaggcgcagcccatgcccaggcaggcaatatacagataattaaaactttatgaatgaaagtccatttattcattataattaagtcacaacgttccatctcgagtaatagaaagcaaagcgtggcaattaatacaaccaaacccatgttaatatcaacatatattattcaagccacttcaaaaaatattacttaaaattataaacgcgttcattaccccagtttcatgatatggatgaatcaccgttaagttctgccgaagacaatatgaaatcatcatgaaataagtatatgagattatgaattaatatcgattcacactgagagcattagcgcgacctctttttacgttctgccgctcccccatcgcactgggttgaaatatgccgtgatctcaatcacataattatctcttgttcacttgatggccaaccgcttatttcagctagcgaccgcttaaccttccatacaaccactcaccgatttacccaactttacgcgcgcgctgttctggcaagatcggaggcagcctagctaatcaatacctccatcaacccttacttaaaaccagacggcttcggccaattattcatctaattaacgccaggttttactatggataccaaaaaactattcaagcacataccctgggtgattctcggaatcatcggggcattttgcctctcagtcgtcgcgttgcgccgcggtgagcacgtcagcgccctgtggatcgtcgtcgcgtcggtttccgtgtacctcgtcgcctaccgttattacagcctgtacatcgcgcagaaggtgatgaagcttgacccgacgcgctccacgccggcggtcattaataacgatggcctgaactatgtgccaaccaaccgctacgtgctgtttggccaccactttgccgcgatcgccggcgccggcccgctggttggcccggtactggccgcgcaaatgggttatctgccgggtaccctgtggctgctggccggcgtggtgctggcgggcgcggtacaggacttcatggtgctgtttatctcctcgcggcgtaacggcgcctcgctgggcgagatgattaaacaggagatggggccggttccgggctctatcgccctgttcggctgcttcctgattatgatcatcatcctcgcggtgctggcgctcatcgtggtgaaagcgctggcggaaagcccgtggggcgtgtttaccgtctgctcgacggtgcctatcgccctgtttatggggatctacatgcgcttcctgcgcccaggccgcgtcggtgaagtgtcggttatcggtatcgtgctgctggtggcctctatctggttcggcggcgtgattgcccacgacccgtactggggcccggcgctgacctttaaagacaccaccatcacctttaccctgattggctacgcgtttatttccgcgctgctgccggtatggctgattctggcgccgcgtgactatctggccaccttcctgaaaatcggcgtgatcgtcggcctggcgctggggatcgttatccttaacccggacctgaaaatgccggcggtgacccagtacattgatggtaccggtccgctgtggaaaggcgcgctgttcccgttcctgtttatcaccatcgcctgcggcgcggtctccggcttccacgcgctgatcgcctccggcaccacgccgaagctgctggccaacgaaaccgatgcccgctttatcggctacggcgcgatgctgatggaatcctttgttgcagtcatggcgctggttgcggcctcgattatcgaaccgggcctttatttcgcgatgaacaccccgccggcgggcctgggcatcgtcatgccgaacctgcatgaaatgggcggtgaaaacgcggcgatgatcgcagcgcagttgaaagaagtcaccgtccacgcggcggcgaccgtcagctcctggggctttgtgatttcacctgagcagatcctgcagacggcgaaagatatcggcgaaccttcggtactgaaccgcgctggcggcgcgccgacgctggccgtcggtatcgcccacgtattccataaaatcatcccgatggcggatatgggcttctggtaccacttcggtatcctgtttgaagcgctgtttatcctcaccgcgctggatgcgggtacccgcgcaggccgctttatgctgcaggatctgttgggtaacttcgtgccgttcctgaaaaaaaccgactcgctggtcgccgggattatcggtaccgccggctgcgtcgggctgtggggctacctgctgtatcagggcgtggtcgacccgctgggcggcgtgaagagcctgtggccgctgttcgggatctctaaccagatgctggccgccgtggcgctggtgcttggcaccgtggtgctggtcaagatgcagcgcaccaaatatatctgggtcaccgttatcccggcggcatggctgctgctgtgcaccacctgggcgctgggcctgaagctgttcagcagcaacccgcagatggaaggcttcttctttatggctcagcagtataaagagaagattgccgccggcggcgagctgaccgcgcagcagatcgccaacatgaaccatatcgtggtcaacaactacaccaacgccggcctgagtattctgttcctggtggtggtgtatagcatcatcttctacggcatcaaaacctggctcaatgtccgcaacaataaggtgcgtaccgacaaagagactccgtatgtgccggtaccggaaggcggcgtgaagacctcgtcacatcattaaccctgatgccggatagcgctacgcgtatccggcctaccaaaagcgcattaacgtaggccggatatggcgctagccgccatccggctttattcgttatctggaacttataatgtttggtaacttaggtcaggcaaaaaaatatctcggtcaggcggcaaaaatgctgattggcattccggattacgacaactacgtcacgcatatgcaaaccaaccatccggatcagccgtacatgacttatgaagaattcttccgcgaacgccagcaggcccgctacggcggcgacggcaaaggcggcgtacgctgctgttaatggaggcaataatggcaccgattgcagtcaccctactcaccggttttctcggcgcaggaaaaaccaccctcctgcgccatatcctcaatgagcagcacggtttcaaaatcgccgtaattgaaaacgaattcggcgaagtcgccgttgacgatcagctcatcggcgaccgcgccacgcagattaaaaccctgaccaacggctgtatctgctgtacacgctccaacgaactggaagacgccctgctcgatctcctcgacagtcgcgatcgcggcgaaatcgagtttgaccggctggtgattgaatgcaccggcatggccgacccggggccgattatccagacctttttctcccatcaggtgctctgcgagcgctatctgctggacggcgtgatcgccctggtggacgccgtccatgccgaccagcagatggatcagttcaccatcgcccagtcgcaggtcggctacgcggaccggatcctgttaaccaaaaccgacgtcgccggcgacaccgaaaagctgcgtgaacggctggcgcgcattaacgcgcgggcgccgatttataccgtcattcacggcgatatcgatttaagccagttgtttaacaccagcggttttatgctggaagagaaggttgtcagcgccacaccgcgctttcattttgtggcagaaaaacagaatgacgtctcgtcgattgtggtcgagctcgactatccggtggatatcagtgaagtttcacgggtaatggaaaatctgctgctctccttcgccgagcaattgatgcgttataaaggcatgctgtggatcgacggcgagccaaatcgcctgctgttccagggcgtgcagcgcctctacagcgccgactgggatcgcccgtggggcgatgaaacgccgcacagcacgctggtgtttatcggcattcagttgccggaagaggaaattcgcgcggcgtttgccgggttacgacgctaacctgcccgcctgcgccctaaggcgcaggcccccttctctctgagacctcgtcaaaaacagggaccaaacgtcggcagcgcgtcgaaaaatgtaaagcaacgttttaataagtaacagtagaaacatttttggaaattataagaaactgaatgaataggccccttaataattaatgactgctctgttcagtttctgtttagcccaccaattaaaccacggctaaacaggctaaatttgctgattgacctcgccgtaacccaacgtcattacaacattttcaaaacaccttcctgacaaaactagcataaaaaatcgacgcaagtcacatttgcagaggtaaacatcgcttgttaaggtgccctcagacaactttattgacgaggagtaaaccatgagaaagcttaacatccttattcttgcagccctgaccgcggtctctggttccgccatggcggtggggtttaccgttgaacagggtaaaaacttcactaatctgaatatggaaatgggtaaatcctcttctggcctgtacgccgaaagccactggctgaagaataccgatgatggtagccagaccggcggcgtgggcgcgggttacaacctggaagtgggcccggtgatgctcaacgccggcgcgaaagccatctacctcgggccgaaaaaaggcgataacggcgtcgcgtttccggtcggcggcggagtgaacgtggccctgaccgacagcatccacgtgtttggcgaagggtatgtcgcgccggatggtctgaacaacagcgtgaaaaactatgttgaagcgaacggcggcgtgagctggtctccgattggtccagtgacgttgaaagtgggttaccgccatgtgagcgttgacggtaaagagggtcgcccgaaccacaccctgattgatggcgcctatgtgggcggcggggtcaccttctgattatggtcaacgccccgcgataaagttaaggtgcgctgagcattagccataaaaaaacctgccgaatggcaggtttttttatggccgggtcataggcttagcggcgcaccaccaccagcttctggttcacaaactctttgatgccgagatcggagagctcccgtccgtaaccggaacgcttcacgccgccaaacggcagctccggcgcggtatcggtgagccagttgatataaaccattccggtttcaatggcggaggccatccgtttggcgcgttcgatatcctgactgaacaccgcgccgcccagaccatagtgggaatcattggccagctggattgcctcctcatcgtttttcaccacgtagatctgcgccaccgggccaaagaactcttcgaagtacgccggattatcacgggtgataccggtcaaaatggtgggttcaaagaaattgccttctcgagccaccgctttgccgcccagatgcagcttagcgccatttttcaccgcctcgtccacctgtttgcttagggtatccagcgcatctttggaagagagcggccccagcgtggtgctttcatccagcggatcgccgattttcacctggcgaaacgcctcgctaaattttgtcaggaacgcatccgcgatattttcgtgcaggataaagcgcttggcagcggtacacacctggccggcgttgttcagccgcgcctggacgccgattttcaccgcgcgctccaggtcggcatcgtccagcacgacaaacacatcattgccgcccagttccagcgttgatttcttaatatgcttcgccgcctgcgccgccaccacgctgccggctttctccgaccccgttagcgccgcgccctgcacgcgatcgtcagcgataatcttcgccacctgatcctggtagataaacaggttggtccacgccccctccggagcgccggcctcacgcaccagatgggcaaaggtctccgcgcagtgcggcacaatgctggcgtgtttggcgataaccgggttaccggccgccaggtttggcgccaggacgcgcatcagttggtaataggggaagttccacggctccaccgccagtaagacgccaatgggatggtgctcaacccaggcttcacccaggtcggagggatacttcaccggcgccaggaacgatttggcgttatcggcgtaatagcgggcgatctgcgcgcaaagtttcacttcgccgcggctctgcttaatgagtttccccatctcctggctagcgatttttgccagctcctccgcccggctatcgatcagatccgccagcttatgcagtaccgccagccgcggttcaatatcgccttttgcccaggcagaatggtagagcgcatccgcctgctgcagcgccgcctccacatccgcatcgctgtgcgccgggtacgttttaataagctgattgttcgcaggattcaccgtctgataggccatatcgcatgtctccttgttatcgctactaaggcagtcaaaaatgccgttaaagatattaagggtagtcgagatggctggcgatgcgggtaaagttaggtatatccggaatattccataacgaggctaaccggggcgaccgtcaggccgccccggcgttatcaatgcgccagcgcggcgatctcgtcggcggtcaggccggtgattttcaccaccgtctcgcgggcaatgccgtcagccagcatcctctgggcaatgcgcagcgcctcggcatgctgtccttcttgtctgccttcttgtctgccttcaagccggccttcccgtttgccttttctgcggcccacttcctgtaatctttcagcaatagtcatcaatctctccctgtgctgaggaacccgttgcgccacttcgtggataaaccggccaaagcggcgcgcgttgccagtctgcagcagataattaaacagcgtttttagctgtctgtcattagcgtccccgctaagtaaaatcgtcgtcagttgctcaacaatgcccattaaatcgcgctggcgaatatgcttctgtatcagctcgagtaatgccacgcgccggtggcgaacgatctcatcgtcggggatcaccgtgacatccaccagcggaaagggcgagatataaagctcactcgccagctgtggatcggcaaaacagtccagccagttgagtgaccacgggtatggcgtggtcgctccgtgatagaacagcatcggcaccaccagcggcagttttgtatgaccgccatcaagatggcgctgcatcgcggcgatggcgtagcgcatcaggcggaaggccatctgcgcatccggcgagctctgatgttcgataaccacataaatgtagccctcgccagacgcggttttgagtgaccacagcacatcggagtaccaggcccgcaggctctcctcgataaagcttgccgactccagctgtaaggtatcgaggtcgcagcgctgacgcagcgcaggcggtagatggatcgccagaaaatcgcgcgcggtgtcggcctgagtgaggaactgtttaaacaccgcatcatgcggcgtcgaggtggtgccctttgccatcggctcatccctgcctgcttatcctgcagggactctacatcccatgaatgtctctggcaccccggaaaccgggattttacattccgctacgaaaacatatttccccggactgcaagcgtgacatcctttttcgacgcggtacgcaaatccaggcgggcgacagcctcggcgcagcatgctataaacggcttatccccgcagcaaaggccaaagcagtgaaccatacccgagatatcccccaaaccttctggcgagacgatcgtctgccgtggctggagctgcgcagcacccggcgcagccgccgggcctataagcgccacagccacccccagctttccgtaggggcgattatcgagggggaaacgcgctgcctgtgcgctggccaggagtacctgctacagcccggggatctgatcgtgatcccgccgcacgcgccgcatagctgtaatccgctgcatggcaggccgcgcagctatcacatgctttacctggacgcgacatggtgccacgcgcagcgcccggatattccccctggcgccagtatcacctcgccgcagccgctgctgcgcgacagccctctctttgccagtttccagcaggttgtcgccctgatgagccgcgggagccttgaacaactgcccgcccggctggcgcaactcctgcacgcgctgccgctgtgcgccgccgcgccgcaggcgccacatcacgccagcgccctgctgtttcagcgcctggcgatggatctgccggcgtcgccgtcgctggataagctggcccacgacagcgcgcttcgtaaagagaccgttatccgcgccgtgaaacaagataccggcctgacgcctgccagtttgatcaacatggcgcgcatcgaatatgcgaaaacgcgcttacgcgccggggatcctatcgccgacgttggctatcaggctggctttgccgatcagagccatttccataaaacctttgtcagctataccgccgccacgccgcggcagtatgcgcaaagcagatcaatatctgacaataagtaatacgccacctggcgtagggtggcctctgcaccattatcgaggccactatgcataccttatcgacgctctttcccgccgtcttcccggcgctagccctgtcccactttgtcgctctgctcagtccgggccctgatttttttctgctgatcggctacgccgtgcgctaccggatccgcggcagcatcggattgtgtctcggcatcgccgcaggcaatgcgctgtatattgtgctcgccatcgtcggctgggggcttctgcgccaggcgccgctgctttttttgctcatcgagctgctgggggcgggctatttattgtggattggcagcctgctgatacgcagccgtcccgcgacgctggcgatggagagcgttcgcgcagcgcgtccggggttcggcaggcagctgctgctggggctggggtcatcgctgctcaaccccaaaaacgccctgttttatctggcgctgatgacttccctgctcgggccggctgtgaccctgcttcagcaaacggtgagcgggctgtggatggtcagcgtggtgttcttctgggatttactgctggtgagcgcgattgcgctgccgcagatacagcgccgcctgggcgccatcgtctggcgagtcgagcgggcggcgggggcgatcctgatgctcttcggcctggggattatctggcgatttttgcacgacctcgccgtcaggctatatgcttaagcatatggaaaaactcgctgaactgaaacgcgccaaactgctggcgctgtcgctgctgctgattgcagccgccatttttatcactaccctcgcgctaccaccgtcgccctgggtcggtgcgctaaaagctatttccgaagcggcgatggtcggggcgctggccgactggtttgcggtcgtggctctgtttcgccgtattccgctgccctttgtcgcccgccatacggcgattattccgcgcaataaagaccgcatcgccgacaacctcggccgctttgtcgaggaaaagttccttgataccccgtcgctggtcgcgctgatccgccgctatcagccagccctgatgctcggcaactggttcagccagccggagaacgcccgacgggtcggccagcacctgctgcaggtgatgagcggttttctcgaactgaccgatgacgcgcgcattcaacgtctgctgcgacgcgcggtgcataaggctatcgataaggtcgacctgacgcagaccagcgccatgatgctggagggactgacccgcgacaatcgccatcaaaagctgctcgattcgctgatgaaccaactgatcgccctgctgcagcgcgacagctcccgcgcctttatcgcccgcggcatcgtacactggctggagaccgaacacccgctgaaggccaaactcctacccaccgagtggctcggcgagcacagcgctgagatggtcaccgacgcggtgaataccctgctggacgaggtgactcacgaccgtacgcatcagatccgtcagacttttgaccgcgccgtgcaaaagcttatcgataacctgaaatccgacccggatatggcgcagaaggccgataacatcaaagcctggctaaaaaatgatgagacctttaaccactatcttggcgaagtatggggcgacctgcgcggctgggtaaaaaacgatatcagcagcgacgactcacgtattaagcagcgcatcgccgaggcggggcagtggttcggtgaaaccttactccgcgacgacgcgctgcgcgaatcgcttaacgaacacctggagcaggcggcgcaccgggtggcgccggagttcgccgccttcctcacccgccatatcagcgacacagtgaagagctgggacgcccgcgatatgtcgcggcagatcgagctcaatatcggtaaagatctgcagttcatccgcatcaacggtaccctggtggggggaaccatcggcctgttgttgtggctgctctcgcagatcccctcgctgctgcatctgcatattggttagcaatgatactatccgaacaatagcgctgataaatattccacagggagggcgaaatgatgcacaggatttcccactggctgagccgacacgccgccgcgctgttcttcccggcggcgttaattctgtatgatttttccgcttatctcactaccgatctgatccagccggggatcctgcacgtggtgcgggatttcaatgctgatgtggcgctggctccggcctcggtgagtctgtatatggccggcggcatggcgctacagtggctgctggggccgctctctgaccggataggacggcgtccggtgctgctcaccggcgcgctgattttcaccctcgcatgcctggcgaccctgttcaccacctccatgacgcagttcctgattgcccgcttcgtgcagggcaccagcatctgctttatcgccaccgtcggctacgtcaccgtacaggaggcctttgaggaaaaaagatcgatcagactgatggcggtgatcacctccgtcgtgctggtggcgccgatcgtcggcccgctctccggcgcggcgctgatgcatttcattcactggaaagcgctgttcggcattatcgccgccatgggattggtggcctggctcggcctgctgttgaccatgccggagacggtgcgccgcggcgatgtgccgttcagccccctgggcgtgctgcgcgattttcgcaacgtctttcgcaaccgcatctttttactcggcgccgccacgctgtcgctgagctatattccgctgatgagctgggtggcggtatcgccagtgattttaatggacgccggcggactgaccaccagcgagttcgcctggagccaggtgccggtcttcagcgccgttatcatcgccaacctgtcggtggcgcgctgggtaaaagaccctacccgcccgcgctttgtcctcagcgcggtgccggtacagatgctcggcctggccatcctgatcgttggcaatctggtatggccccacgtctggctgtggtcggtgctcggcacctgcttctacgccttcggcatcgggctgattttcccgacgctgtttcgctttaccctcttttccaacgacctgccgaaaggcacggtctccgcctcgctgaatatcgtgatcctcagcgtcagcgcgttatcaattgaaggcgcgcgctggctgtggttccatggcggcagactccccttccacctgttggcggtggccgccgggattgtcgccgcctgctgcctggccggactgttacgccaccagcgcggacaagcggtgatcgaagcccggcagtcgtgagcccttttacggagaaagccccatcatgaatgacattgaactcagccaggcgcagcgcgacctgctgcgcgacaagctcagcaagtactgcgcagagaccttcgacctcgaactggagcagtttgacgccgaatttttcgtcgactttatcgccaaagagctggggccgctgttttacaacgccggtatcgaagaggccatccgcacccatcaggcgtggagcgagcgtatccaggaagagatggatttgaaaaaggtctattaacaccgcgtacagacgcaggagatcaataaaaccctgcatacaccatggctataatggcgactctttcagcatctcccgtgtacggggaaggaaaaccatgtcgcttatcaccgatctacccgccatttttgaccagttctcagaagctcgccagaagggctttctcaccgtcatggatcttaaagagcagaacgtaccgctggtgggcacttactgcacctttatgccccaggagatcgccatggcggcgggcgccgttgtcgtctcgctgtgctcaacctccgatgaaaccatcgaggaagcggaaaaagatctcccgcgcaacctctgcccgcttatcaaaagcagctacggcttcggcaaaaccgataaatgtccctacttctatttctctgacctggtggttggggaaaccacctgcgacggcaaaaagaaaatgtatgagtacatggccgagttcaaggcggtccacgtcatgcagttgccgaacagcgccagcgatgccgcctcgcgcgcactgtggaaaacggagatcctgcgcctgcagcaggtgattgaggcccggtttggcacgccgattagcgaggcggcgctgcgcgaagccatcgtgttgaaaaatcgcgagcgccgggcgctggcccacttttatcgtctcgggcagctcaatccgccggcgctcagcggcggcgacatcctgaaagtggtgtacggcgccacttttcgtttcgacaaaaccgccctgattgatgaactgcatgccatggcggagcgcatccatcaggagtggcagcagggtaaacggctggaacctcgtccgcggatcctgatcaccggctgcccgatcggcggcgcggcggaaaaagtggtccgcgccatcgaggaaaacggcggctgggtggtcggctatgagaactgcaccggcgcgaaagcgaccgagcgctgcgtggcggaagagggcgacgtctacgacgccttaaccgataaatatctcgccatcggctgctcctgtatctcccccaacgaccagcgtctgcagctgctgagccagatggtggaggagtatcaggccgacggggtgatcgacgtcattttgcaggcctgccatacctatgccgtggaatcgctggcgattaaacgccatctgcgccaacggcacgatcttccttacatggcgattgaaaccgactattcgacagcggacctcggccagctcagcacccgcgtcgcggcctttatcgaaatgctgtaaggagctggcgtgaactatacggttggcattgattccggctccaccgccacaaaaggcatcctactggcggacggcgtcatcgtgcgccgcttcctctgccccaccccctttcgccccgccgacgccatccacgaggcctgggagacactgcgcgctggcctcacggagacgccttttttaaccctcaccggctatggccgccagctggtggattttgccgataagcaggtgacggagatctcttgtcacggcctcggcgcccgcctgctggcgccggacacccgcacggtgattgatatcggcggccaggacagcaaagttatccagctggacgccgggggaaacctcagcgacttcctgatgaatgacaaatgcgccgccggcaccggccgctttctggaagtcatttcacgcaccctcggcgccagcgtcgaacaactggacgccattaccgacggcgtggaaccgcacgccattaccagtatgtgcacggtgtttgccgaatcggaggtcattagcctgcggtcggccggtgtcgcgccggaggcgattctggcgggggtgattaacgccatggcccggcgcagcgcgaactttatcggccgcttatcggcgcaggggccgctgctgtttaccggcggcgtcagccactgcgccgcctttgcccggatgctggaaagccatgtcggcatggcggtgacaacccatcccgacgcccagtttgccggggcgatcggcgcggcgctgatcggccagcgccagcggaggcgcggatgacaacgtttctgtttttatttcactccacggtgggggtggttcggatgcgcaaagccatgcaggcggcgggagtagccttcgaggtcaaagatataccccgccagctgcgcagcggctgcgggctgtgcatcctgctggaggggacggaagccgatgcgcgaggctggatcgtcccggaacagacggcggcgctgtatcagcagaacggggaagcatggcgctgtctcgccaccttcccacctgcagattaatcgctcaccacaaagcgcgtcgccgcgaaacagttcagcaggcggtgcatgagaaaaaccagggtcagcgtcaccaccagcgagaccgtcaccgaggtgatgcggtacagatcgctgaacaccagatcctgatacggatgcaggttctggccgaacataatgccgatggtagtgatgctggcgaagcccaccccggcgcccactttctccatcacgtggaggcgggcgctgaaggccagcccgagaccaatcagcggcatcatcaggatcatgtggttgctgaaatcatagataatcagctgcaccaccagtatatagagacaggccagcaccaccccgacgacgcgccagatcgagctgatcaccgccccacgatagtgcatcgggaacaggatcaggatcccggccatcagcgccgacagcgagtcgctgagatcgcagatctgaaacaccacaaagatgatcgtcgctaccgtaccggagagcagcgactcatgacggatgcgggcggcgtctttctcaatccgcggcggcggcttgcgcggttcgacgtccgggatcaggtaatgcagcagcgcgctcagcgccacggccatcacgcaggcttccatattggagaacatcagggtgtgccagttgctggtgggatagctcataaagttgagcatcgtgctctggcacaccacccccatcgatcccaacaggaacagcggtccctggctcataaagcggaaacgcatcacgtacagggcaaacaccaccagggtcatgatcaccggccactgcgacaaatagccgacaattagcaccatttcgacacagtttaccgccgcgctaaatataaactggcgggcgacgtgcaggttgaacatcggtaccagcgacatcagcatcagcggataaacgacgaaaaatacgccgtactgtacgtcgtagaaggtggagatgctgagcgcaatggtcccggccacggcgatacgcaccgtctggcgaaaatcattcgccgtgtagacgatattgccgtgcggcgtaaagacgtgcgccagggtattaatagacatagtgcaaccagctcaccaggtggatctgcaggccggcgaaggtgcgggcgaaaggtccctcgctattgtacagctgcaccgtggcgcgagcgccggtcggcagcggtttgtccagcggctgatccagcgcgacgtgaatgcgcatccgctgggcgtcgcgcacccagcgggtggactgctcgggctgcgacagctggccgttcaccgcctcctgtcccgccagaatcccggcgtcgctgctggtcacgtgcgccgggaagacttgacccggcagggcgtcaaagaccaccgccgcatcggtattcaccgcggtgtggcgcaggcttttttcgcggaagtcggcgacgatgtcagtgttgttgttaaccaatgccagcacagccgtcgccgcggtggcgtagatccccgggttcagctgcaggttgctgaccatgccgtcagtttccgcacgcactttggtccaggccaggttcagctgcgcctcctccagcgcattgcggtatttttgcagggtgacgttgcgcttatcgtcgcgctcgccgcgctggatcagcaggttctggatctgcgcgttcagcgccgagaccgactgctcgctggtctgccaggtggttcgcaccttatcgaggtcggactgcgagacgttctgcatcgtactcaagcgctggtagcgatcgagcgtgaccttatcgttacgcgcggtgtactgcgcggtgcgcaggttggcgcgggcggcggcgatttgcgcgtccagctgctggttgctcagtttcgcctgctcgagggcgatctgcgccgcttcaactttattaatgaatggcgttgggtcgagctcatacagcaggtcgccctttttcacctggctgttgttgtgcacgtagacgtgcgagacatagccggagacccgcgacgaaaccggggtcaccacgcgcatgacggtggagtccggcgtcagcgggatccagatatcggcaacgataaaccaggcgaatattcccagaaaagcggcaatactcacccgtacccagcgggcaaatttttgttcaggcgtcatcatagtgtgttagatcttgttatcttcttcgcggatattccgcaaacggcaggcgatttgatttaacgtggcgctgaaggtggcgagatcggcctccgggatggtctgggttacgcgctcctgataggtctcgatcacgcagctcagtttttccagaatagcccgcccctcagcggtcagcgtcagcaggcgaatgcgtttgtcatatggcgatgtggaacgcatcagatagccctgcttttccagtaatgagagggtgcgcattagcggcggcagttcaatgccctgcacctccgccagttcgctgaccgagacgttgtctcccagctgatgcagttgcatcagcaccgtccagctggactgggtgagtccggtatcggtgatagcggagtcaataatggcgcgccactggcgcaccaccatagccatccgcatccccagcgggcggcgggcaaacagttcgtcttcagtcacgggtcttcctctcattattgagaagaaaataatacttatcagggtaagtatcaagaaacggaagctcgtgccgcatcaattgataaatttcgtgaatgtatcccggcggcactttgcgctcaccgggataatgaagaaggtttgcctgtaaaaaactgcacgttttaattgatctggtcccgacgcaggccgatatctttcagctgttcgtcgctcatttgctgcaaaactctgcgcgtttgctgctgaagccaccattttttgataaaccgcaccagcaatacgaaaccgataaatggctgtcttgccctgttctcgtgaaattccatcctctacctcctcaccttgccagaggctttatcttcacggatttgggggtaaggaatacagattcacaaaacgcttttctttaacatacagattagctaaaacgtacaccagagcccaatttttacgcccatctgtactggttattccatctgtatggcggcaattaaggatacagcatgacccgctaccaacatctcgctacgctgctggccgaacgcatcgaacagggcctgtatcgccatggcgaaaagctgccgtcggtgcgcagcctgagccaggagcacggcgtcagcatcagcaccgtccagcaggcctatcagctgcttgagcagcagcaaatgattgtgccgcagccgcgatcgggctatttcgtcgccccgcgcaaagcccagccgccggtgccgccgatgtcgcgtccggtccagcgcccggtggagatcacccagtgggatcaggtgctgaccatgcttgacgcccgctacgataaatcgatcatccccttcggcggcggctcgccggacgtgacgcagccaagcctgaagcccatctggcgtgaactgagccgggctatccagcacaacctcactgaggtgttgaactatgacgaactggccgggcgtcgcgagctacgggagcagatcgcccgcctgatgctcgacggcggatcggtggtaactgccgacgatctggtgctcaccagcggctgccacagcgcgctgtcgctggccctgctgtcggtgtgccagccaggggacatcatcgccgtggaatccccctgctactacggcaccatgcagatgctgcgcgggctgggattaaagacgattgagatccccaccgatccggaaaccgggatcagcatcgaggccctggagctggcgctggatcagtggccgatcaaaggggtgatcctcgtgccaaactgcaataacccgctgggctttatcatgccggacgcccgcaagcgcgcggtgctgaaccttgcccaacgctacgatatcgttattttcgaggatgatatttacggcgagctggccaccgaatacccgcgcccgcgcacgatccactcctgggatatcgacggccgggtgatgctctgcagctcctttaccaaaaccatcgcccccgggctgcgtatcggctggatcgcccccgggcgctactacgacaagctgctacagatgaagtacgccgccagcgggaccaacgtcccctccactcagctggcggcctgcaattttattcgcgaaggccactaccaccgccacgtgcggcggatgcggcagatctatcagcgcaatatcgagatctacacctgctggctgcgggaatttttcccctgcgggatctgcgtcacccggccgaagggcggttttatgctgtgggttgagctcccggagcaggtagatatggtctgcgtcgccaagcagctgtgccggctgaagatccaggtcgcgccgggctcgctgttttcggcagcgggcaagtatcgcaactgcgtcaggatcaactgcgccctgccgccgaccgaaaaacataaagcggtgatggtgaagctgggagaagcggtgaaggtggcgatggagtgaatttaacctgttctccccggtggcgctgcgcttaccggggctacgggtgatctaacgtctgcgtagcagcttcactgatcaaaaaacaccattcccttatacggctgctcgcggcaggcggccagacgctgggcgagactgccgacgtgcagctccagcttatggccatcgggatcgaggaaatagtgcgaggcaccttcgctacggttcagcttccagatcgccacgccggcagcctcaaggcgggcggcgaagctagcaaaatcggcttcgctaatactaaacgcataatgggtgtagtcgctctcttccggcggagtaacgcgccgctgcggatccagcgacaggcacagccacaaatcgccgcaggagagataagccccgctgtcccagcgggcatgcagcgtcatgcccagctgctgctgataaaacgccacgctcggcgccagctggctgactgccagggtcagatgattcagtccactcagcatgtctgttcctctagtgaattcacaatgaactgacgcagccattgatgcgccgggtcgcggtgccagcgctcgtgccacagcatcagcatctcaaagccggcgaccgccagcggcggctcgacgaccaccagcccgctctgcccgcgcaccagccgctccggcaggaccgccaccagatcgctattgcgcagggtctccagcataaacaggaaatgtggcacggaaaggacaacccgccgcatcagtccgaggttcgccagcgcgatatcggtcgccgcgctgaagccgcccccgtccggggagacgatcacgtgctccagctgacagaacgtttccaggctaagcccaggccgcagcgctggatgttccgcccggccagccagcacgtagcgttcgcgaaacagcaggcgctgatgcagccccggcggcgcgccctcgcgggtatgaaagaaaagatctactgtatcgctggccgcctgctgctccagccgcgccggctgcagttcgactaccgccagccgactgccgggagaggcctggcgtaacccagccagcatcggcaggaggatcgccgaggccatatagtccgtcgccgccacccgccaggtctccgccgccgtggccggatcaaaagggctgaccggcgccaccgcctgctccagcgcggctaacgcagcgcgcaacggctgacgaagctcatcggcgcgggcggtgggctgcatgccgcgcgggcccggcatcagtagcggatcggcgaaaatctcccgcagcctggcgagctgaatactcaccgagggctgcgacagattcagccgctgcgccgcccgggtaacgttgttttcgctaagcagcacatccagggtgcgcaacagattgagatccagacgctgtaaattaatcacgactataccgggaatttaagtaattaatttctactatagcgtcagctttcctactctgcagctctccatacgccagaggtgatattatgaaagtactgctgatttacgcccatccggaaccgcgctcgctcaatggcgcgctgaaaaatttcgccatccgccatctgcagcaggccgggcatgaagtgcaggtttccgatctctatgccatgcgctggaaggccgggtatgacgccgacgacagcggcgcgccgccggtcggcgagttctggcggccgaccctcgattccaaacaggccttttcccagggcacccaaagtgcggatatcgtagccgagcaggaaaagctgctgtgggccgatacagtgatttttcagttcccgctatggtggttctcgatgcccgccatcatgaagggctggatcgaccgggtgtacgcctggggctttgcctatggcgtcggcgagcacagcgaccgccactggggcgatcgctacggggaaggcactttcgtcggcaaacgggcgatgctgatcgtcaccgccggcggctgggcagaacactattcaccgcgcgggatcaatggccccatcgacgacatcctgttccccattcagcacggtatgctgttctatcccggctttgaggtgcttccgccgctggtgttctaccgcacggataaaaccgatgccgggcagttcgccgatcagtgcgccgccctggccgagcggctggacacgctgtggcaaaccgagcccattccattccgccggcagaatcatggcgattatctgatcccgtcgctgacgctgcgcccggagctggcgccagggcaaagcggcctggcggtgcatttgcgtagcgaataactggctatcccgtcttcgcccccgaggacgggtcatttacccggctctctccagtcccagcatgcctcgcgcctggataaagcacagcagcaatacgccccacagcgccatcgtcagataggggctgataccgaggatattgaacccactctcaataatctgcagcaggaacagcgcgagcaccatcccaacgatgcgcccgctaccgccatccggattcacgccgccaagcaccgccgcgaggatcgacaccagcaaatacgattccccataagatgctttggctgagttcagcttcgacatcatcagaaacgcagccaccgcgcagagcagggccgagatgacatatacccacatcaacacccgccgggtattgatcccggaataatgggtcgcccgttcgttggatccgatcaacatgatcgcccgacccagcgggcttttctccagcagcacccacagcccggccgccaccaccgcaaaaagccacattggcagcggaataccgaaccactgggcgtgattcagccacagcacccactgcggatagttagcgatggcgctgccgccggtgatcagaatatttatccctttgagcagggtcatcatgccaagggtagccaggatcggcgaaacgcggatcccggcgatcaatatcccgttgcacaggccaatgatcatcgccgcccctccgccggccagcagcgtcgccagcgcggtagcgcccccaggcggatagctcgtcgccacccaggccatcaccagcgagcaggcgttagccgtcgcgataattgacaaattaatgccgccgcaaagcatagtcatggccatcgccagcgccaggatccccagcaccggcatttgcgaggcaatcgactggaaattgctgacagaccagaagatgtttggcatggcgatgctaaaggcgataaccatcagcagcagcaggccgatcaggtaaaactcaacgttgttgcgccacgattttttcataacaagctccggttctgatgctggctccatgccgttacgctgatgctgacgacgatgatcgccccagtgatcagggtctgccagtaggaggagacccctagcaggttcaggccattctgcatcaccgccagtaaaatcacccccagcagcgtaccggtgagagttccgcgcccgccaatcaggctggtgccgcccagcaccaccgccgccagcaccgtcagctcatagcccagcagtgaatccggcgcaacggtcatcactgtccacgcctgcacgacacctgcggcccccgacattagccccatatagccataaacgaacagctgcaggcggagcacgctgaagccgacgcggctggcggattcccggttgccgcccatggcatagatcttgcggccaacggtggtgaaattcatgataaacgcggtcaacagcaccacggcgatcatcgtcagcagcggcagccccagaccgtaatcgtaaccatcggcatcggtatatttgaacagcataacccccttttcaaaccacggagggaagtcgtagagccagacacctttgcttaaccacagcagcaaaccgtagaaaatgttgagcgtagaaatggtgataatgatcgaggggacccgcagacgattaaccaacagcgcgttcaccagccccagcagcacgccgatgccgccggcaagcacaaaagccaccgcgaagttgccgcctactttttgcagcatcaccaccatgccgtactgggcgataatggtcatagccgggaaggagatatcaatcccgccggcgatcagcaccacgaacagaccacaggcgagaatggtcagcatcgcatagttattagcgaggtcgtaaagattgccgaaagtgaaaaattcctcactgcgccagcccagcagcaggcacagcgcagtaatgaacatgcctaaccagaattcatgtcgtttcaacagattagccattgaccacctccgctatctgctgctgggtactgctgtccggcaggaagctatgggtcaactcgccctgcttcatcaccaggatgcgatgactctggtaccacgcctcttcaatctcgtcgcaaatcatcagcacggcgataccatgggcagccaaatcgctgatgatatgatagatcccggctttgtttgcgatatccacccccacggttgggctatcgaggatcagcagcttaggagagatcgccagccatttggcgatagaaacgcgctgggcattaccaccggagagggtattcaccggcagatgcgtatccggcgccttaatggtcaacgcgttgaccattcttgcgaccagctgctgagctttactatcactcaatagtccgcaagcgcctttcactttatgaaacacggtgctgataatgttgttttcaatcgactgactcatcaccaggccgcgcgacatacggtcctcggagacatagccgataccgtggcggatagcgtcctgattgctacgcaaccgcaccggctggccatttatcaggatctcgccgctgtcagggcaggtcatgccgaaaaggctcaggcacagctctgttcgcccggcgcccaacaggccgactatcgacaccacttctccggcttcgaccttcagggagacgttatgatattcccccttgcggctgagattgcgcacctccagcaccggcgtactgccctgcccctgccacagatcgcgcacctgaaagtcaaactcctggcccgtcatcagaaaaccgagccggcgggtggttacctctgccgccggcaaggtgccgaccagattgccatccttcagcacgctgatgcggtccgatacggccatgacctcttccagacggtggcttacgaagacgatgcagatccccctctcacgcagctggcgcaccacatgcaataatccctccacttcctgatgggtcaatgaggccgtgggttcatccataatgataagccgggcatcctgcgccagcgcgcggcagatagccaccagttgacagcgagcgatggagagcgattccacggcggcatccagcggcagcgagacgttaatactgcgcatcgcctgctccgcactgcgtcgcagttcgctgcgcctcaccagcacgccgcgatgatagtggtttatagcaatgttctcccacacgctgagattgggaaacagcgacagatcctgataaatcacctggatcccatgggcgacagaggccgctggcgtcagtttgggccacgtcttgccgcccagcgtcatcgctgcgccctcatccgggcgatagacgccagagataattttgatcaacgtcgacttcccgcaaccgttctgcccggccaggcagtgcacttctccgggcataaagtcgatgctgatatcattgagcgcgcggttggcgtggaaggttttgctgacgtgtcgaagggaaaggaaaggttccatagcatcccctggctggttaagccggggcggctggcgccccggaaggtggattagtagagcgaatcaatattgtctttatttaccagcagcactttatggaagcggataatatgcttgtcgctatcgacctccgctttaccgagctctttcagttcaaatcccggctcaatggttttgccgttcagcagggtgctggcgacggccgcgagggcatagccggctgtcgccggatcgtaggtgatcccttcggtaatatcgccgctcttaataagagaggccgcctgcgaggggatcatcatcccgtagaccgcgactttatttttcgcacgcttctctttcaccgcgcgccccgcgccaatcgggccattcgaaccaaaagagaccaccgctttcagatccgggtaagttttcatcagatcgagcgtggtacggcgggaatcatcaacactttccgccaccggcattcggcgggtgacttcatgcatgtccgggtaatgttctttttggtatttcaccagcagatcggcccacaggttgtgctgcggtaccgtaaggctaccgacatagataacgtagccgcctttgccacccatccgcttggccatatgctccacgtattcagcagcgaacttctcgttatcgattatctccacatcccagttggcgctcggctgcccgggcgattcgttggtcagtaccacgatgccggcgtcacgggcttttttgaataccggctccagcacgttggcatcgttaggcacgatagtgatggcatccactttacgtgcaatcaggtcctcaataattttcacctgctgcggcgcatcggtgctggacggccctacctgggaggcgttgaggttaaactctttcccggcctggactaccccttcacccatccggttaaaccatggcatgccgtccacttttgaaatattgactacggttttttccgccgcatataccggcgcggaaataagcgcagcccccaacagcaaggatgaaaaaatattaacgaccagacgtttatgcataataattagcctcaatacgttgtagtcagacaggggtatgacgcaaagcggaaaaatagatagaaattgtaataatgttaataatttagaagagaataaacacaagctgtaacagcagacaggtaatattcagctataaatatggataataatactataatcctgtggcgtgagctttttcacaaaaaaaatgcaacatactttgttgttccagaataatgatcgggtcgcagagaaaatatatttttcccgcttcgttatttaccgaaaaacaatcacataaataacatcaggaaaagtatgtgatttttgattgcgcctccagccccttccgtggcaggatactccctatgaacagaaacgttatcgttacctatccccgccgttggtggctgcctgcataacaggcggcacgatacacgtttccattttcaaagccgccggaaggcggctttggtgttttcaggacgtctttcggctgaacagtctgataaggagtccctgatgaaccatccacaaaccatcctcaccggcgaccgcccgaccggccaacttcatcttggccactacgtcggctcgctgcgccagcgcgtcgcgctgcagcataaccaccagcaatttatcctgatcgccgacctgcaagggctcacggacaacggcagcaatccgcaaaaaatcagccaccatatcctcgaagtcatggccgattatctggccgtcggcatcgacaccaggctcaccactatttgcctgcagtccgccctgccggcgctggcggagctcagcgcgctgtatatgaatatcgtcaccgtcgcccgcgtagaacgtaatccgacggtcaaaaatgagattgcccagaagggattcgcccgctcgctgccggtgggttttctcgcctatccgattagccaggcggccgatatcaccgccttcaaagccgagctggtgccggtgggcgacgatcagctaccgatgattgagcagaccaacgagatcgtccacaagatgaatagcctcaccggcgagccggtgctgcgccactgtaaggcgctactcagcgaagtgagccgcctgccgggcgtcgatggcaacgccaaaatgtcgaaatcgctgggcaatacgctgacgttatcggccacagaggaggagatccaccacgcggtcagcgcgatgtataccgacccgacgcacctgagagtcagcgatccggggcatgtcaagggcaacgtggtgtttacctatctcgatgcattccacagcgataaggcgcgggtggcagagatgaaagcccactatcagcgcggcgggctgggcgatcgccagtgtaagaatgagctggagacctgcttgcagacgctactggcgccgatccgcgaacgcagggtcacttttattcaggataaagggatgctgctggagctgctgcgccagggcagcgaacgcgcccaccacctcacacagcagacgctgcatgaggtgaagcgtgggctgggtctgccggtgctgttctgagatggtgaaatactccctgtgcggataattttgttaacacgccgacaagaccctgtctttcgtatggacaatatcgccccggctgttactatcgcgttaacggtagctctcactatgcgtgtttcattaaggccaggatcgctgatgatgaccacataagtagcccagcgagcggctgcgcatcggcgcggcagagcgcggcgtcagcggccctccctccactttttcgtccttcgcaagaaggacgctccgcccgccggaggaaacacgcgcaccactcagcacagggaatcaagcgagtcgcgtatggacaaaataaagaaacgttgggcagggtattttgtcggcttactggtggtgctcgccgccgccgcatggtggctgctgcgcccgccgggactcccggcggggtttgccagcagcaacggccgaatcgaagccaccgaagttgatattgccagtaaaatcgccgggcgtatcgacaccattctggtcaaagagggtcagttcgtgcaccagggagaggtgctggcgagaatggatacccgggtactgaacgagcagcgtcttgaagccgccgcgcaaatcaaggaggcggaaagcgcggtcctggccgccagagccttgctcgatcagcgacaaagtgaaatgcgcgccagcgaagcggtagtgaagcagcgtcaggcggagctggattccacggcgaaacgccatgttcgctccaacaccctctcccagcgtggcgccgtctccgcccagcagctggatgacgatcgcgcggccgcagagagcgcccgcgcggcgctggaatcggcgaaagcccaggtctccgccgcccgcgccgccatcgaagctgcccgcaccagcattattcaggcgcaaacccgcgtcgaagccgcccaggcgaccgagcggcggatcctcgccgatattgacgatagcgagctgaaagccccccgcgatggccgcattcagtatcgcgtcgctgagccaggcgaagtcctggccgccggtggccgggtactgaacatggtcgatctcgccgatgtctatatgaccttttttctgcccaccgaacaggcaggtctgctggcgctcggcagcgaagcgcgcttggtccttgatgccgcgccggatctggtgatcccggccaatatcagctttgtcgccagcgtcgcccagttcacgccgaaaacggtcgagaccagcgacgagcgccttaagctaatgttccgcgtcaaagcgcgtatcccgccggagctgctggcgcagcacctggagtatgtcaaaaccggcctgcccggtatggcttacgtacggctggataaacaacaaccctggcctgaagccctggcggtgaggttgccgcaatgaaactaacgccgcaggatacctcgccccccgtcgccctgctggaacacgttggtcagcagtttggcgccaccatcgcgctgcgcgatatcagtctggcgatcccggcacggcgtatggttggcctgattggcccggacggcgtcggcaaatcgagcctgctttcgctgatcgccggggcgcggaccatcgagcaggggaacgtgatggtgcttggcggcgatatgcgcgatgtgcatcaccgccgcgaggtgtgtccgaaaatcgcgtggatgccgcaggggctggggaaaaacctctatcacactctctcggtgtatgaaaacgtcgacttcttcgcccgcctgttcggccacgataaagccgaacgcgaactgcgcatcaacgagctgctgcagagtaccgggctggcgccgtttcgcgatcgccccgccggaaaactctccggtgggatgaagcaaaagctcggcctgtgctgcgcgctgatccacgatccgcagctgctgatccttgatgaaccgaccaccggcgtcgatcccctctcccgggcgcagttctgggagcttatcgacagtattcgccagcgccagccggcgatgagcgtgctggtggccaccgcctacatggaagaggccgagcgctttgactggctggtggcgatgaacgccggcgaggtgctggcgaccggcagcgccgcagagctcaaagcccagaccggcagccagaccctggagcaggcgtttatcgccctgctgccagaagcacagcgtcaggcgcatagggcggtagttatcccaccgcgcgacagccgtgaggaagagatcgctatcgaagcgcgcggcctgaccatgcgcttcggcaactttgtggccgtcgaccacgttaactttcgcatcgcccgcggcgaaatctttggcttccttggatctaacggctgcggcaaatccaccaccatgaagatgctcaccggcctgctgcccgccagcgaaggtgaagcctggctgttcggccagccggtcgacccgaaggatatcgccacccgccagcgggtgggctatatgtcgcaggccttttcgctctatagcgaactgagcgtccggcaaaatctcgagctgcacgcccgcctgtttcatatcccggatgacgaaatagcccaccgggtcgctgagatgagcgagcgctttatgctgaccgaggttgaagacgcgcttcccgccgatctgccgctggggatccgtcagcgcctgtcgttagcggtggcggtcatccaccgcccggagatgctgatcctcgacgagccgacctccggcgtcgacccggtagcgcgggatatgttctggcagctgatggtagacctcgcgcggcaggatcaggtgaccatttttatctccacccactttatgaatgaggcggaacgctgcgatcgtatctccctgatgcacgccggcaaagtgctggccagcgatacgccgcaggcgctggtcgagcagcgcggttcaaacagcctggaagaggcgtttatcgcctggcttaaagaggcccagccgtcctctccagtaccagaagaacccacgtctgctgtggcatcgtattccggacacacggctccacggcaggccttcagtcttcgccggctgtttagctatagccgccgcgaggcgctggagctgcgccgcgatccggtacgatcgacgctggcgctgctggggacggtgatcctgatgtttatcatggggtatgggatcagcatggacgttgaggatctgcgctttgccgtcctcgaccgcgatcaaaccctcagcagccagggctggtcgcagaacatagccggttcacgctactttatcgagcaggcgccgctgcacagctatgacgaactggaccgccggatgcgcgatggcgagctggcggtggcaatagagatcccgccgaactttggtcgcgatatcgcccgcggcacgccggtgcaaatcggcgcgtgggtggacggcgcgatgcccaaccgcgcggaaaccgtgcgcggctacgtacaggcgatgcatctggcctggctgcaggagatggccggccggcagagcagcccgcagcgcgatacctcgctcatctccatcgagacccgctatcgctacaatccagacgtgaagagcctgccggccatcgtcccggcggtgatcccgctgctgctgatgatgatcccggcgatgctcagcgccctgagcgtagtacgtgaaaaagagctcgggtcgattatcaacttgtacgtgacgccgaccacccgtagcgagttcctgctcggcaagcagctgccttacatcgtactggggatgtttaacttcttcctgctgtgcgcgctgtcggtctttgtctttggcgtcgcgcataaggggagtttcctgacgctgaccctggcggcgctgctgtatgtcaccatcgccactggtctggggctgctgatctcaacctttatgaagagccaaatcgccgctattttcggtaccgcgattattacgctgatcccggcaacccagttttccggaatgatcgatccggtggcctcgctggaaggtcccgggcgctggattgggcaaatctacccgaccagccacttcctgactatcgcccgcgggaccttttcgaaagcgctgaatattagcgatttgtggggctcattcattccgctactgattgcggtgccgctggtgctcgggttgagcgtgctgctgctgcagaaacaggagggatgatgcgcggattacgcaatatttataatcttggcgtcaaagagctgcgcagcctgctcggtgataaagcgatgctggcgctgatcgtgtttgcgtttaccgtgtcggtgtactcctcggccacggtgatgcccggttcgctgcacctggcgccgatcgcggttgctgatatggataaatcccagctctcttcacgcatcattaacgctttctaccgtccctggtttcttgagccggagctgatcaccgctgatgagatggatgccgggctggatgccgggcgctacacgttcgccatcaacatcccgcctaacttccagcgcgatgtactggccggtcggcagccggaaatccaggtcaacgtcgacgccacgcgcatgagtcaggcctttaccggcaacggttacatccagaatattatcaccggcgaagtaaacagttttatcgcccgctatcgggataacagcgtgctgccggtagagctggcggtcaggatgcgttttaatcctaaccttgagcaggagcgctttggcgcggtgatggcgatcatcaacaatatcaccatgctggccattgtcctcaccggttcggcgctgatccgcgagcgggaacatggcaccattgagcatctgctggtgatgccggtcacgccgtttgaaatcatgatggccaagatctggtcgatgggcctggtggtgctggtggtctccgggctgtcgctggtgctgatggtacaggggattttgcaggtgcccattgaagggtcgattcccctgtttatgctgggggtggcgctcagcctgttcgccactacctcgatcggcatttttatgggcaccctcgcccgctcgatgccgcagctggggctgctgatgatcctggtcttactgccgctgcagatgctctccggcggatccacgccgcgagaaagtatgccgcagctggtacaggatattatgttgaccatgccgaccacctacttcgtcagcctggcgcaggcgatattgtatcgaggcgccagcttcgccatcgtctggccgcagttcttaaccttgctggctatcggcggagtgttctttagtatcgcgttgctgcgttttcgtaagactatcggtgagatggcataaaggcttaagaagggccgtcgacttacggcggccgaatggtttatttatggcgattcataaagcgacgtaaaccccaggtgaaggccatcgccatactgaagagaatgaacagcaacaccacccagctgatggagatgcgcagcagcgtgccgggggtcataaacggctgcagatacacggtgaaggactgggcgggtgattttcccagcagttcataaacgttatcggtgagccacacgccgacccgacagaacaaccagataatcgctggccagcagagcagcaccagaaaggtaaagcgctcctgaatgtaagtgaagagctggcgcaatggcgaccagttaagcaggattttcatttctattctcatttgccagccgagaacctgcatatgtctcgcaaggcatttcgggcagcatccatacaggcaatcatccctctttgtatatcaaatttgctgccatataaaccagatcaagttaacaaagtgttaatgataaagctcatttagacaaaaacagggaagaagcataccgttcgccacaatacatccggaagcgaagtatccagtcacggaaatattttttctgaagcgtaaacgcgttattttgtgggaggaagaggccgcatcattattttaccggggcacaatataatggcgctgaaataaagagataatattaatcgtagctgctgataattattttccgacttgtatcatccggtaaattcactatccggttgaccatgccacaagcattcgtcacgctattttgcgaagcaataaaggcggtgctgcgcactttgtccggggtacggttttgtagccccggtaagcgcagcgccaccgggggagatataccccacacagcaaaaaaccccgcacctttcggggcggggttctttttaaacgcaaaaacaaaaagcccggtctttcgaccgggctttctgctttatttgatgcctggcagttccctactctcacatggggagaccccacactaccatcggcgctacggcgtttcacttctgagttcggcatggggtcaggtgggaccaccgcgctagtgccgccaggcaaattctttgtgctcagtacgcaattctttatattgcgtactcaactctgaatctaagctgaaaattctctcaatccgccaaaacatcttcggcgttgtaaggttaagcctcacggttcattagtaccggttagctcaacgcatcgctgcgcttacacacccggcctatcaacgtcgtcgtcttcaacgttccttcaggagacttaaagtctcagggagaactcatctcggggcaagtttcgtgcttagatgctttcagcacttatctcttccgcatttagctaccgggcagtgccattggcatgacaaccc
